United States Patent 11,098,302 (IDENTIFICATION OF POLYNUCLEOTIDES ASSOCIATED WITH A SAMPLE) - sequence listing, part 3

SEQ ID NO: 6250 - DNA, 847 bp, Homo sapiens
  misc_feature: GYAE6OF02JUGBS.24.76.G10.1.454.CMB.1.raw
  modified_base (373)..(373): a, c, t, g, unknown or other
  misc_feature (373)..(373): n is a, c, g, or t
  modified_base (505)..(505): a, c, t, g, unknown or other
  misc_feature (505)..(505): n is a, c, g, or t
tcagactactatgtcacgaccggtgctcgatttagtcactcatacaggggggagaggagcccagcactagaagtcggcggtgtttccattcggtgatcagcactgaacacagaggactcaccatggagtttggcctgaactgggtttcctcgttgctcttttaagaggtgtccagtgtcaggtgcagctgggtggagtcgtgggggaggcggtggtccaggccgtgggaggtcccgtgacgtactggtcctgtcgcagcgtcgtggacacgtatcttacaacttacctatcggacatcgacctacgtcggggtcccgccgacgggtcctacccgaggggtaccgaacgggggtctacggggagggttcggggngggtaccttaagggttttagttttgggtttagacgttacgggtaaactttaaggtggtaaaacttacgttagtacggactaaggtacggttaccggtaaggaacggggtaccctaagtttcccaaacccgtntttcccggaaccgaaggtaacgtaaccgttaaactccggaaagggttaacgtttaaagtttttcggtaaccttacgttttacgaaacgggttataacccgggtaaaacgtacgggttaccctaagggtaacggtaccggttaacggggttaaaccgaacccggttaggtaacccgttttaagttacgggttaacgtttttacccgggttaggttaaccgggtaccggttaaaagtaaaccgggggtaaaacggacccggttaaaacgggggggtttaggtaaacccgggtttttccgggggggtttttaaaacgggcccgggggttaagggggttaacccgg

SEQ ID NO: 6251 - DNA, 635 bp, Homo sapiens
  misc_feature: GYAE6OF02GTG58.24.76.G10.1.454.CMB.1.raw
  modified_base (315)..(315): a, c, t, g, unknown or other
  misc_feature (315)..(315): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccaggccgtggggacggtccctggacacgtcgtcctgtgcagcgtcgtggacacattcttacaattacctagtcggctatcgactacgtcggggtcccnccgaggcctaccgaggtaccgaagggggtcctggggaggttggggtcggactaggttttatttgggtttagagttagggtaaactaagttgaaatttactaagtgactaggtacgttccggtaggaacgggccgtattccacactccgtacagacgactaattccgaggtagttaacttttgatttcgtacgagtatacgaacacgtctaggacgtagtacggaaggtaccgtacggtacttagtagttacttacgtggtcgtacgtagtaacgaaacggcgaagggtacggtaggttacgggtacgtagggtggtaacg

SEQ ID NO: 6252 - DNA, 544 bp, Homo sapiens
  misc_feature: GYAE6OF02HC44R.24.76.G10.1.454.CMB.1.raw
  modified_base (295)..(295): a, c, t, g, unknown or other
  misc_feature (295)..(295): n is a, c, g, or t
  modified_base (509)..(509): a, c, t, g, unknown or other
  misc_feature (509)..(509): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtgggtccagcctgggaggtccctgagactgtcctgtgcagcgtctggacacatcttcaatacctatggcatgcactgggtccnccaggctccgaggcgaaggggctgggagtgggtggctagttagtttggttgatgggaactaatgaaatactatgacagagtccgtgaagggccattcgaccatctccagagacaattccaggacgtaattttgtattcttcagtatggaacaggcctagaggtacgtcggaaggaacacggagtattagtattactggtgacgtagtaggaagngaagggaggtagtagggttcgagggtgggtaacgg

SEQ ID NO: 6253 - DNA, 716 bp, Homo sapiens
  misc_feature: GYAE6OF02FIG5J.24.76.G10.1.454.CMB.1.raw
  modified_base (626)..(626): a, c, t, g, unknown or other
  misc_feature (626)..(626): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcggctggtggagtcgtgggggagcgtggtccagcctgggacggtccctgagactgtcctgtgcagcgtctggacacatcttcaatacctatggcagtgcacgtggtcccgcaggctccgaggccaaggggctgggagtggggtggctaggttttagtttgggtttagagttacgggtaaacttaaagtcggtaaaattaccgtaagttcgacgtaagggtaccgtttcccggtaagggaaaccgggggtccctaatttacccgaaccctatcccgtaccgaaggaacgtaacctaaacgttacccgaagggtaacgttaagtttttcggtaactttaccgtttacgaggtattaaccggaaacgtacggtcccttaaggacggtacggttaccgggaaacgggtaccgaaccggtacgttagttacggttaactttacgnggtacggtaaccggtagtaaacgggtaaagccggtaaggggtaacggttaggttacggggttacggtaaggggtcggggtaacttcccgg

SEQ ID NO: 6254 - DNA, 576 bp, Homo sapiens
  misc_feature: GYAE6OF02I35K6.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggagtccctgagactgtcctgtgcagcgtctggacacatcttcaatacctatggcatgcactgggtccgccaggcctccgaggcaaggggctgggacgtggggtgctaggtttagtttgggttgagttaggaaactaagtgaattacgtagtgactagagttccggtaggaacgggtcctagttccaaccgtatccgtacgagacgaacaacttccgaaggtagttaatttgtacttcgttacgagtatagaactgaccgtgagtagtacgacgacgacggtagtagtgttattacgtagtgtacgtagtaggaagtcggaaggtaggtacgttgggtacggtaggtggtacgg

SEQ ID NO: 6255 - DNA, 716 bp, Homo sapiens
  misc_feature: GYAE6OF02GFMTV.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctggagactgtcctgtgcagcgtctggacacatcttcaatacctatggcatgcacgtgggtcccgccgaggcctccgaggcgaagggggctgggagtggggtggcgtaggtttattttgggtttgagttagggaaacttaagtaggtaaattactagtgacgaagacggttccggtagtaacggggcctagttaccgaacctacgtcctacccgaaggacgtaaccgtaaacgttcccgaaagggtacgttaaagtttttacggtaatttaccgtttacgtaacgtaacgtacgtaaaccgaacggtaccttagggaacgtaacgggttaccggaaggggtaaccgtaccgggtaaccttaacgttacggtttaacgtttaaccggtagggttacggtaccggttaagtaacgggaaaacgttacgggaaaggggtacggggtaacggtttacggggttacgggtagggttacgggggtaaccgg

SEQ ID NO: 6256 - DNA, 680 bp, Homo sapiens
  misc_feature: GYAE6OF02JPYD8.24.76.G10.1.454.CMB.1.raw
  modified_base (478)..(478): a, c, t, g, unknown or other
  misc_feature (478)..(478): n is a, c, g, or t
  modified_base (537)..(537): a, c, t, g, unknown or other
  misc_feature (537)..(537): n is a, c, g, or t
  modified_base (542)..(542): a, c, t, g, unknown or other
  misc_feature (542)..(542): n is a, c, g, or t
  modified_base (550)..(550): a, c, t, g, unknown or other
  misc_feature (550)..(550): n is a, c, g, or t
  modified_base (660)..(660): a, c, t, g, unknown or other
  misc_feature (660)..(660): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggtttcctcgttgctcttttaagaggtgtccagtgtcaggtgcagctgggtggagtcgtgggggaggcggtggtccaggccgtggggacggtccctggagactgtcctggtgcaggtcgtcgtggacactattccttacaactaccctatcggctagtcgcgtcgtcgggtcccgccgagggtccctccggaggccggaaggggtcgtgggtagggtgggtacgtcgttaggtttaggttggttagacgtaacggtaataatacgtaagttactagtagtacgaaggtaccggtacggtaacgggacggtaccgtacgttaaccacccgttacnccgttaacgaacgtaaccgtaacgtaaccgtcgtaagtaagtttaattcgttatcgtanagtanacggaacncgtactagacggtcgtaacggcgtaaacgtcgtacgttaagttcgtacttacgtagggtacctaaggtacgtaaacggaaggtcgtaaggggtacgtggtttaacggggngggttaggtacggggtaccg

SEQ ID NO: 6257 - DNA, 610 bp, Homo sapiens
  misc_feature: GYAE6OF02I5CS0.24.76.G10.1.454.CMB.1.raw
  modified_base (305)..(305): a, c, t, g, unknown or other
  misc_feature (305)..(305): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagccgtggggacggtccctgagctgtcctgtgcagcgtctggacacattcttacaatacctagtcggctatgcacgtcgggtcccnccgaggcctccgaggcgaagggggctgggaggtggggtgacgtaggtttagtttgggttgagttaggaaacttaagtgtaatactatgacgagtacgtccggtaggaacgggcctattccgaccagttccaccaagactaactaacgttccgaaggtagttaagttttcgtacttcgttacagtaactagaacacgccgtagaagggtacgtacggaaggtaccgacgtacgtagtagttattacgtggtcgacgtaagtagaaacgtcggagggtaggtaggttagggtaggtaggtgggtacg

SEQ ID NO: 6258 - DNA, 731 bp, Homo sapiens
  misc_feature: GYAE6OF02JWQPJ.24.76.G10.1.454.CMB.1.raw
tcagactactatgtcacgaccggtgctcgatttagtcactcatacaggggggagaggagcccagcactagaagtcggcggtgtttccattcggtgatcagcactgaacacagaggactcaccatggagtttggcctgaactgggttttcctgttgcttcttttaagaggtgtccagtgtcaggtgcagcgtgggtggagtcggtgggggaggcggtggtccgaggccgtgggggacggttccctggacggtactggtcccgttgtcgcgacggtcgttcgtggaccactattccttacaaattaccttagtcggtacagttcgccctacggttccgggtcccgccgtacggtccctccgagggccgaaggggctggggagtggggtgacgtgtttagtttggttgagttggaaacttagtagtaattactagtgacgtagtacggttcggtaaggaacgggtcctaatccgacgtattccgaccgaagtacgaactaaacgttccgaaggtaagttacgttttagtaacgtttcgtaacgttaacgagttaacgtaacgtaacggtccgtaaggtaacgtacggttaacggaacggtaccggtaaaccggtcgttaacgttcggtttaacttaacggttggtacggttaaccggtaataaaccggggtaaacgtacgggtagggtaaccggtaaggtttacggggttaacgggtagggttaccgggtacgg

SEQ ID NO: 6259 - DNA, 702 bp, Homo sapiens
  misc_feature: GYAE6OF02F2W2Z.24.76.G10.1.454.CMB.1.raw
  modified_base (274)..(274): a, c, t, g, unknown or other
  misc_feature (274)..(274): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagtctggtggagtcgtgggggagcgtggtccagcctgggagtccctgagactgtcctgtcgcagcgtctaggacacgatccttanaactacctagtggactatcgccacggtcgggtcccgccgaggtcctccggaggcggaaggggtccgtagggaggtgggtaggcttaggtttgtttggttagagtggaaacttagtagtaaacttcgtagtcgtacgagtaacggttcccgggttaagggaaaccggggcccttaacgttaccgtaaacccgtacgtacctaccgaacggtaaacgtaaacctaacgttacccggaaagggttacgtttaaacgtttttacgtaactttcgttacgtaagtaacgtaccgtaaacgtaccgtaccgtaggtaaggtaacggtacgggaacggtaacgtaacggtacttagttacttagtaccgtggtacgacgtaagtaagaacggtacggaaggtagggtaggttacggtagggtacggtcgggtacg

SEQ ID NO: 6260 - DNA, 669 bp, Homo sapiens
  misc_feature: GYAE6OF02F2QOK.24.76.G10.1.454.CMB.1.raw
  modified_base (303)..(303): a, c, t, g, unknown or other
  misc_feature (303)..(303): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggaggtccctgagactgtcctgtgcagcgtctggacacatcttacaatacctatggcatgactacgtcggggtcccnccaggtcctcccgagggccgaagggggtctagggaggtggggtggactaaggttttagtttgggttgagtagggaaacttaagtacgaaattacgtagtgactaagtacggtaccggtaggaacgggtccctaagttccaacccgtattaccaccgaaggaacgaacgtaacttaccgaaggtaacgttaattttaggtactttcgttacgtaagtatacgaactacgtacctaggaacgacggtacggaacggacgacggttactaagttacgttattaaccgtgggtacgtacggtaattaagggaaacgtcggtaacggggtaacggttacggttaggggttacggtacgggtaggggtaacg

SEQ ID NO: 6261 - DNA, 809 bp, Homo sapiens
  misc_feature: GYAE6OF02ISH5E.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggtagtttggcctgaacgttgggttttcctcgttgcttcttttaagaggtgtccagtgtcgaggtgcagcgtgggtggagtcggtggggggaggtcggtcggtaccgacggccgttgggggacggttccccgtggacgacttcggtccgtggtcgccgtaggccgtcgtaggaaccactaacttccttacaaacttaacccgttagcggtctaacgttcggcctaaccggttccggggtcccccaccggaacggtccctacccgaaggggaccggaacgggggtcgtaggggtagggttcggggtggaccgttaaggttttggttttgggtttagagttaacgggtaacttaaaggttagaaaatttaccgttaggacgtacaaggtacgttaccgggtaggaacggggtacctagttaccaacccgtagttaccctacgtaaacgaacggtaacttaaaccgttccgaaggttaaacttagtttagttacgtactttagaacgtataacggtaactacggtacgttaaggaagtaacgttacccgggaagtaacccggttacgacgttaagttcgtttaaacgttcgtttacgggtggaaccgttaaggttaaaggaaccggaggttaacgggaagggtaaccggttttgggggtaaacgttacgggggtgtttaaacccggg

SEQ ID NO: 6262 - DNA, 689 bp, Homo sapiens
  misc_feature: GYAE6OF02IERLL.24.76.G10.1.454.CMB.1.raw
  modified_base (337)..(337): a, c, t, g, unknown or other
  misc_feature (337)..(337): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagagtgtccagtgtcaggtgcagctggtggagtcgtgggggaggcgtggtccagcctgggaggtccctgagacgtgtcctgtgcagcgtcgtggacacatcttacaatacctatggctatgcaacgtgggtcccgccgaggcctaccgaggccgaaggggctgggagtgggngctagtttatttgggttagagtaggtaaactaagtacgtaagttactaagtggacgaagtacggtcccggttaagggaaccggggtcccgttaagttacccaccgtaatacccgttaccaaaggtacggtaacctaagttcccggaaggtaacgttaatttttacggaaactttcgttaccgaagtactaacggaactcggtaccgtagtaacgaggttaccggaaagaacccgtaccgggtattaacgttcggttaactttaccggttaaggcggtaaggtaacggtaaggaaaacgttcggaacgggtacggttaagggttgggtaaccggtagggttacgggtaaccgg

SEQ ID NO: 6263 - DNA, 606 bp, Homo sapiens
  misc_feature: GYAE6OF02IQF5G.24.76.G10.1.454.CMB.1.raw
  modified_base (238)..(238): a, c, t, g, unknown or other
  misc_feature (238)..(238): n is a, c, g, or t
  modified_base (353)..(353): a, c, t, g, unknown or other
  misc_feature (353)..(353): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggtttttcctcgttgctcttttaagaggtgtccagtgtctaggtgcagctggtggagtctgggggagcgtggtccagccgtgggaggtccctganactgtcctgtgcagtcgtctggacacatccttacaactacctatggcatgcacgtcggtcccgccaggctccgaggcgaaggggctgggagtggggtgctagtttagttttggtnagttaggaacttagtagtaattactagtgacaggtacttcggtaggaacgggcctattcgacctactcctcaagacgtaactaacgttccgaaggtacgttaagttttgtaacttcgttacagtacgtacgacgagtacctacggtagacggttacggaggtaccgacggtacttagtagttaccgttataggtgtaacgtaagtacggaaagcgtaagggaggttacgtagggttacggtaggtgggtaccg

SEQ ID NO: 6264 - DNA, 577 bp, Homo sapiens
  misc_feature: GYAE6OF02GOWLS.24.76.G10.1.454.CMB.1.raw
  modified_base (431)..(431): a, c, t, g, unknown or other
  misc_feature (431)..(431): n is a, c, g, or t
  modified_base (473)..(473): a, c, t, g, unknown or other
  misc_feature (473)..(473): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggacggtccctgagctgtcctgtgcagcgtctggacacatcttcaatacctatggcatgccacgtcgggtcccgccgaggtcctccgagggcgaagggggctgggaggtggggtgctaggtttagtttgggttgagtagggaactaagtgaatactagtgcagtagtccggtaggaacgggccgtacttacacctatcctacaganacaattccgaagtagtaatttgtattcttacagtatagaacngccgtagagtaggtacgacggacacggtctagttagttattacgtggtgtacggtataggaagacgaagggtaggtagttgggttacggtagggtagggtacgg

SEQ ID NO: 6265 - DNA, 563 bp, Homo sapiens
  misc_feature: GYAE6OF02FM22I.24.76.G10.1.454.CMB.1.raw
  modified_base (154)..(154): a, c, t, g, unknown or other
  misc_feature (154)..(154): n is a, c, g, or t
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
  modified_base (473)..(473): a, c, t, g, unknown or other
  misc_feature (473)..(473): n is a, c, g, or t
tcagactactatgtcacgaccggtgctcgatttagtcactcatacagggggggggagaggagcccagcactagaagtcggcggtgtttccattcggtgatcagcactgaacacagaggactcaccatggagtttggcctgaactgggttttccncgttgctcttttaagaggtgtccagtgtcaggtgcagctgggtggagtctggggggagcgtggtccagcctggggagtccctgagactggtcctgtgcagcgtctggacacatcttacaaatacctatggcatgcacgtgggcccncaggcctcgaggcaaggggctggaggtgggnggctaggttatttgggttgacgtggaactaatgaatactatgacaggcgtccggtaggaacgggctagttccgaaccagttccacgagacgtaactaagttccgaaggtattaagttttgaactttctacgagtatgaaacngaccgtgagaggtacgaagacgacggattacgtgtacttactggtcgacgtagtagaacgcgaggtaggatgggtacggtaggtggtacg

SEQ ID NO: 6266 - DNA, 652 bp, Homo sapiens
  misc_feature: GYAE6OF02FX3YH.24.76.G10.1.454.CMB.1.raw
  modified_base (153)..(153): a, c, t, g, unknown or other
  misc_feature (153)..(153): n is a, c, g, or t
  modified_base (254)..(254): a, c, t, g, unknown or other
  misc_feature (254)..(254): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttccncgttgctcttttaagaggtgtccagtgtcaggtgcagctggtggagtcgtgggggagcgtggtccagcctgggagtccctgagctgtcctgtgcagcgtcnggacacatctcaatacctatggcatgcacgtgggtcccgccaggcctccgaggcgaaggggctgggaggtggggtggcgtagtttagtttggttgagttggaaactaagtagtaattactagtgacgtagtacggtccggtaggaacggggccctattccgaacctactcctaccgtaggaacgaacctaaacttacgacgggtaagttaagtttttgtattcttactaagtatacgtaacgacgtaccgtaggaacggtacggtacgggaacggtaaccgtaacgggtaccttaagttacggtttatttacccgttgggtacggtaccgtaaggtaaggaacggtaggaacgggtaagggttacgttaggggttacgggtagggttaggggtaccgg

SEQ ID NO: 6267 - DNA, 747 bp, Homo sapiens
  misc_feature: GYAE6OF02IEORM.24.76.G10.1.454.CMB.1.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtgggcggtccctgagactgtcctgtgcagcgtctggacacatcttacaactacctagtcggctatgcacgtgggtcccnccgaggcctccgaggcgaaggggctgggaggttgggngacttaggtttagttttgggttgaagttacgggaaacttaagtggaaaactttacttagtcgacgtaagtacggttccggtagggaaccggggtccctatttacccgaaccctacttaccgtaccgaaggaacgtaacctaaacgtttacccgaaggggttaacttaaagttttttcggtaactttaccgtttacgaaggttaactacggaaacctacggtacccgttagggaacggtaacggttaccgggaaacggtaaccggtaaccggtacctttaagttcggtttaacgtttacgggttaggtacggtaccggtaaaggtaagggtaaaaccggacggtaagggggtaacggttaaggggtttaccggggttaacggggtaacggggttagggggtaaccggg

SEQ ID NO: 6268 - DNA, 737 bp, Homo sapiens
  misc_feature: GYAE6OF02HKV1L.24.76.G10.1.454.CMB.1.raw
  modified_base (172)..(172): a, c, t, g, unknown or other
  misc_feature (172)..(172): n is a, c, g, or t
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaacttgggtttttcctcgttgcttcttttaagnggtcgtccagtgtcaggtgcagctgggtggagtcgtgggggaggcgtggtccagccgtgggacgtccctgagactgtcctgngcagcgtcnggacactattccttacaacttacctagtcggactagtgacctacggttcggggtaccccgaccgacgggtccctaccggagggtccggaacgggggtctagggggtaggtggggtacggtcgttaaggttttagtttgggtttagaacgttacgggtaaacttaagtaggtaaacttacgtagtcggacgtaaggtacgttccggtaaggaacgggtccctataccaccgtagtcctacgaagtacgtaactaacgttaccgaaaggtacgtttaagttttacgtactttaccgttaacaagtactaacggaactcggtacgtaggtaagtaccgggtacgaacgggtaaccgtacggtaacgtttacgttagtttacgttaacggttcggtccggtaggtaaacgttacggaaaggtaccgggtaggtaacgggttaggttaccgggggtacggtaacggggttgggaaccgg

SEQ ID NO: 6269 - DNA, 596 bp, Homo sapiens
  misc_feature: GYAE6OF02ICRZ5.24.76.G10.1.454.CMB.1.raw
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (477)..(477): a, c, t, g, unknown or other
  misc_feature (477)..(477): n is a, c, g, or t
  modified_base (532)..(532): a, c, t, g, unknown or other
  misc_feature (532)..(532): n is a, c, g, or t
tcagactactatgtcacgaccggtgctcgatttagtcactcatacagggggggggagaggagcccagcactagaagtcggcggtgtttccattcggtgatcagcactgaacacagaggactcaccatggagtttggcctgaacttgggttttcctgttgcttcttttaagaggtgtccagtgtcaggtgcagctggtggagtcgtgggggagcgtggtccagcctggggagtcccngagactgtcctgtgcagctcnggacacatctcaatacctagtggcatgctacgtgggtcccncaggcctccgaggcgaaggggctggaggtgggcgctagttntttggtnagtagaactaagtgaatactagtgctaagacgttccggaggacgggtctagttccgaaccctagttcctaccgagacgtaactaacgttccgaaggtaacttagttttcgtattccttagagtactagaancgtccgtagaagtagtacgtacggaactcggtacctaagtttagtagtttaccgnggttcggacgtagtaaggaacgtacgagggtacgtaggtttacgggtaggtaggtaggtaccgg

SEQ ID NO: 6270 - DNA, 730 bp, Homo sapiens
  misc_feature: GYAE6OF02GZTHH.24.76.G10.1.454.CMB.1.raw
  modified_base (175)..(175): a, c, t, g, unknown or other
  misc_feature (175)..(175): n is a, c, g, or t
  modified_base (190)..(190): a, c, t, g, unknown or other
  misc_feature (190)..(190): n is a, c, g, or t
  modified_base (308)..(308): a, c, t, g, unknown or other
  misc_feature (308)..(308): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttcggcctgaactgggttttcctcgttgcttcttttaagaggtntccaggtgtcaggtncagctggtgagtcgtgggggagcgtggtccagccgtggggacggttccctggagtactgtcctgtgcagcgtctggacactatcttcaatacctagtggcatgctacgttgggtcccncgacggcctccgagggtccgaagggggtcctagggacggtggggtcgcgtaggtttagttttgggtttcggagttacgggaaacttaagtaggtaaacttaacgttaagtcggtacaagggtacggttacccgggtagggaaacggggtccctaagtttaccaacccgtacgtccgtaacccgaagtaacgaaacctaacgttaccgaagggtaactttaagttttagtacttaccgtttacaagtaagttaacggaacgtaccgtccgttaaggtacgtacgggtacgaacgggaaccgtacggtaacgtacgttaacgtttagttaaccgttgggtaacggtagtaacggtaacggtaaggtacggtaacgggtaagggttaccggtaggggtttaacgggtagggttacggggtaacgg

SEQ ID NO: 6271 - DNA, 594 bp, Homo sapiens
  misc_feature: GYAE6OF02H319R.24.76.G10.1.454.CMB.1.raw
  modified_base (332)..(332): a, c, t, g, unknown or other
  misc_feature (332)..(332): n is a, c, g, or t
  modified_base (416)..(416): a, c, t, g, unknown or other
  misc_feature (416)..(416): n is a, c, g, or t
  modified_base (469)..(469): a, c, t, g, unknown or other
  misc_feature (469)..(469): n is a, c, g, or t
tcagactactatgtcacgaccggtgctcgatttagtcactcatacaggggggggaggaggagcccagcactagaagtcggcggtgtttccattcggtgatcagcactgaacacagaggactcaccatggagtttggcctgaactgggtttttcctcgtttgctcttttaagaggtgtccagtgtcaggtgcagctggtggagtcgtgggggaggcgtggtccagcctgggaggtccctgagactgtcctgtgcagcgtctggacacatccttcaatacctatggcatgcactgggtccgccaggctccgaggcaaggggctaggagtggggngcagtttatttggttgagttggaactatgaattactatgacagtagtccggtgaacgggcctaattcacctatcctaccagtanactaatccgaaggtaattaagttttgtaattcgttacaagttataacggaacngtacctaggaagtacgggtacgtaaagggtaccaacgggttacttagttagttagttaaccgtggtacgtaccgagtaaggaacgagaaggacggtagttcgggttaacgtgggttaggggtacg

SEQ ID NO: 6272 - DNA, 691 bp, Homo sapiens
  misc_feature: GYAE6OF02HA7JI.24.76.G10.1.454.CMB.1.raw
  modified_base (298)..(298): a, c, t, g, unknown or other
  misc_feature (298)..(298): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcgtctggacacatcttcaatacctatggcatgcacgtggggtcccnccaggcctccgagggccgaagggggcctgggaggttggggtggcgtaggtttagttttgggtttagagttagggaaacttagtacgaattactagtgactagacgtccgtaggaacgggccgtattccaaccgtatcctaccgaaggacgtaaccgtaaacgttcccgaaggtaacgttaagtttttacgtaattaccgtttacgaagtagtacgtaacctacgcccgttaagggaacgtaacggttaccgggaagggtaacccgtaacgggtaccttaagttgtttaacgtttaaccgtttgggtaccggtaccgttaagtaagggtaaacggtcggaacggggtaaggggttaccggttagggggtttaccggtaaggggtggggtaacgg

SEQ ID NO: 6273 - DNA, 701 bp, Homo sapiens
  misc_feature: GYAE6OF02F0D7H.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctggggagtccctgagactgtcctgtgcagcgtctggacacatcttacaatacctatggcatgcacgtcggggtacccgccgaggcctcgtaggcgaaggggctgggaggtgggtggctaggtttatttgggttgagttagggaaactaagtagtaaattacgtagtgaccgaaggtacgttcccggtaggaaacgggcccgtaagtttccaaccgtacttccgtacccgaacggaacgtaacctaacgtttaacccggaagggtaacgttaaagttttttacgtaacttcgtttaacgaagtaagttaacggaaaccgtacggtaccgttaggtaacgggtaacgggtacgggaaacggggtaaccgtaccgggtacttaaggtttcgttaacgtttacgttcggtacggtacgtaaggtaaggaaaacgtggaacgggtacgggttaggttacgggttacggttagggtagggtacgg

SEQ ID NO: 6274 - DNA, 605 bp, Homo sapiens
  misc_feature: GYAE6OF02H2QS1.24.76.G10.1.454.CMB.1.raw
  modified_base (267)..(267): a, c, t, g, unknown or other
  misc_feature (267)..(267): n is a, c, g, or t
  modified_base (510)..(510): a, c, t, g, unknown or other
  misc_feature (510)..(510): n is a, c, g, or t
tcagactactatgtcacgaccggtgctcgatttagtcactcatacagggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactggtcctggtgcagcgtctggacacntcttcaataccatggctatcgcactgggtcccgccaggcctccgaggccaaggggcctgggagtgggtggctaggttatttgggttgagtggaaacttaagtgaattactagtcgactagacgtccggtaggaacggggtcccgtaattccgaacctacttccgtacccgagaacgtactaaacgttaccgaagggtacgttaagttttcgtattcttacagtatacggaactacgtctaggngtaaggtccgaacggacgacggtactagttgtacgttacgtggtacgcggtataggaacgcgtagggacggtgtagggtacgtaggtagggtacg

SEQ ID NO: 6275 - DNA, 620 bp, Homo sapiens
  misc_feature: GYAE6OF02GM43B.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcgtctggacacatcttcaatacctatggcatgcacgtgggtcccgcgaggcctccgaggcgaaggggctggggagtggggtgcgtaggtttagtttgggttagagttagggaaactaagtgtaaattactagtgactaggtacggtccggtaggaacgggcctagttacacctatcctacgagacgtaactaacgttccgaagggtagttaattttgtacttcttacgaagtatacgaacgtacgtaccgtaggacgtacgtacggaacggaccgtacggtactagttagttagttacgtggtcgtacggtaagtaggaaacgtcggaagggtaggtacggttaggggttaggagggttgggtaacgg

SEQ ID NO: 6276 - DNA, 714 bp, Homo sapiens
  misc_feature: GYAE6OF02JCWSW.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttgcctgaacttgggtttcctcgttgcttcttttaagaggtgtccagtgtcaggtgcagctggtggagtcgtgggggagcgtggtccaggccgtgggacgtccctgagactgtcctgtcgcagcgtctggacacatcttacaaattacctagtcggacagtcgcctacggttcggggtccccaccgagggtccctacccgaaggggtaccgaaacggggggtcctaggggaggttcgggggtcggtaccgttaaggttttacgttttggggtttagtaagttacggggtaaactttaagtagtaaacttacgtagtgacgaggtacggttcccggtagggaacgggtcctagttaccaccgtactaccgtaccgaaggtaacgtaacctaacgttaccgaagggtaatttaaagttttacgtaacttaccgttacaagtacgtaacggaactacggtcctagggaaggtaacgtaccgggtaacgtaccgaacggtacttaagttcgttacttacgtaggtacggtaccgaagtacggaagtacggaagggtacggtagtttgggtacggtaggtgggtaacg

SEQ ID NO: 6277 - DNA, 713 bp, Homo sapiens
  misc_feature: GYAE6OF02HP6YB.24.76.G10.1.454.CMB.1.raw
  modified_base (262)..(262): a, c, t, g, unknown or other
  misc_feature (262)..(262): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaacttgggttttcctcgttgcttacttttaagaggtgtccagtgtcaggtgcagctgggtggagtcgtgggggagcgtggtccagccgtggggacgtccctgagactgtcctgtgcagcgtcnggaccactattcttacaatacctagtggactatggccgtacgtcgggtaccgccgaggtcctccgaagggcgaagggggcgtggggtaggtggggtacggacgttaggttttaggtttgggtttagaaggttacggtaaacttaaagtggtaaacttactagttgaccgtaggtacgttaccggtaggaacgggtaccgtacttaccaccgtattaccgaccgaagtacgaaaccgtaacgttcggaaggtaattaaagttttcgttaacttccgtttaacgaaagtaccgttaaaggaacgtaccgtacgtacgggaaagtacggtacggtaacgggaaccgtacggtactttaagttcgttaacgttacgttgggactaggtaacgtaaggaaagggcccgtaaaggggtcgtaacggggtttcggtaacggggtcggtaggggtaccg

SEQ ID NO: 6278 - DNA, 727 bp, Homo sapiens
  misc_feature: GYAE6OF02IHU3G.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagcctgggaggtccctgagactgtcctggtgcagcgtctggacacatcttcaatacctatggcatgcacgtggtcccgccaggctccgaggcaaggggctgggagtgggtgctagtttagtttggttgagtaggaacttaagtcggtaaattacgtagtcgacgaagtacggttccgtaaggaaacggggtcccgtaatttacccgaacccgtacgttacccgttacccgaaggtaaccgtaaccgttaaacgtttacccgaagggttaaacgttaaagttttttaggtaaacttttccgttacgtaaggtaacgttaacggtaaaccgtacggtacccgttaggaagttaacggttaccgggaaacgggtaaccgtaacgggtacctttaaggttacgttaacgtttaccggttaggttacgtaccgggtaagttaacggaaaagtaccggtaaggggtaacgggtaacggtttaggggttaccggtaggggttacggggtaacgg

SEQ ID NO: 6279 - DNA, 608 bp, Homo sapiens
  misc_feature: GYAE6OF02GCCOK.24.76.G10.1.454.CMB.1.raw
  modified_base (293)..(293): a, c, t, g, unknown or other
  misc_feature (293)..(293): n is a, c, g, or t
  modified_base (349)..(349): a, c, t, g, unknown or other
  misc_feature (349)..(349): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctggggaggtccctgagactgtcctgtgcagcgtctggacacatcttcaatcctatggcatgcactgggtccnccaggcctccgaggccaagggggctgggaggtggggtgctagtttacgtttggttnagtaggaacttatgaaattacatgactaggtacgtccggtaggaacgggtcctatccaaccattcctacccaggtacgaactaacttcccgaaggtagttaacttttagtacttcttacgaagtactagaaactggtacctaggaacgtagtccgaaggaacgaccggtacttagtacgttattcgtaggttacgacgtaacggtaggaaacgtcggaaggggtacggtagttcggggtttacggaggttggggtaacg

SEQ ID NO: 6280 - DNA, 600 bp, Homo sapiens
  misc_feature: GYAE6OF02IVF6C.24.76.G10.1.454.CMB.1.raw
  modified_base (300)..(300): a, c, t, g, unknown or other
  misc_feature (300)..(300): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagcctgggaggtccctgagactgtcctgtgcagcgtctggacacatcttcaattaccctatggcatgcacttcggggtcccnccgaggcctccgagggccgaagggggctgggagtggggtggcgtagtttagttttggttgagttgggaaacttaagtgaaacttactagtggacaggtacgtccgtaggaacgggtccctagttaccacacttcctaccacgagaactaacgttccgaaggtagttaatttgtactcttacagtatacgacacgtacgtagagacgtacggacgacgacggtacgtagttagtacgttacgtcgtggtacgtaggtaagaacggacgaggaggtaggtcggtacggtaggtagggtacgg

SEQ ID NO: 6281 - DNA, 708 bp, Homo sapiens
  misc_feature: GYAE6OF02GNYZ2.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgcttcttttaagaggtgtccagtgtcgaggtgcagctggtggagtcgtgggggagcgtggtccagccgtgggacgtccctgagtactgtcctgtgcagcgtctggacacattccttcaaacttacctatggacatgacctacgtcgggtcccgccgaggcctaccggaggcgaaggggcgtagggaggtggggtgtcgttaggtttagttttgggttagaagttaggtaaacttaagtggtaaatttacgttagtcggactaacggtacggtccggtagggaacgggtacccgtagttacccgaacctactcctaccgtaaggacgtaactaacgttaccgaaggtagttaagttttgtactttaccgttagtaagtatacgaacgtacgtaccgtaggaacgtacggttacggaacggtaaccggtacggtaccgttagttagtttacgttacggttacggttacggaacggttaacgtaacgggtaaaggtccggtaaggggtacggttaggtttacggggtttacgggtaacggggttcgggtaacgg

SEQ ID NO: 6282 - DNA, 615 bp, Homo sapiens
  misc_feature: GYAE6OF02G1PBJ.24.76.G10.1.454.CMB.1.raw
  modified_base (296)..(296): a, c, t, g, unknown or other
  misc_feature (296)..(296): n is a, c, g, or t
  modified_base (475)..(475): a, c, t, g, unknown or other
  misc_feature (475)..(475): n is a, c, g, or t
tcagactactatgtcacgaccggtgctcgatttagtcactcatacagggggggagaggagcccagcactagaagtcggcggtgttccattcggtgatcagcactgaacacagaggactcaccatggagtttggcctgaactgggttttcctcgttgctcttttaagaggtgtccagtgtcaggtgcagctggtggagtcgtggggggaggcgtggtccagcctgggaggtccctgagactgtcctggtgcagcgtctggacacatcttcaatacctatggcatgcactgggtcccnccaggcctccgaggccgaaggggcctgggagtggggtgctaggtttattttgggttgattgggaaacttataggtaatacgtaatggcaagacgtccgtaggaacgggccgtattccaacctatccgtaccaagacgactaaacttcccggaaggtagtaattttagtacttccgttanaacgtatacgaactgtacccgtgacgtagtacggaacggaacgtaccggtacttagtagttacttcgtaggtacggacgtaggtaacggaaaggcgaaggggtacggtagttacggggttacggtagggtacggggtacg

SEQ ID NO: 6283 - DNA, 780 bp, Homo sapiens
  misc_feature: GYAE6OF02HNSTT.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagccgtgggacggtccctgagactgtcctgtgcagcgtctggacacatcttcaatacctatggcagtgcacgtgggtcccgccgaggctccgaggcgaagggggctgggaggtggggtggctaggtttagtttgggtttgagttagggaaacttaagtagtaaattacgtaagtgacgtaaggacggttcccggtaggaaacggggcccgtaagtttaccaacccgtattaccgtacccgaaaggtaacggtaaacctaaaagtttaccccgaaaggggtaaacgtttaaaagttttttacggttaactttaccgttttacgaaaggttaattaacggtaaaaccgtaacggtaaccccgttagggaaacggtaacggttaccgggaaacgggtaacccggtaaacgggtaaccttaaacggtttaggtttaaacgttttaaccgttaagggttcggtaaccggtaaagttaaacggggaaaacggttaaccgggaaaggggtaacggggttaaaggtttacgggggtttaacgggtaacggggttaggggtaacccggg

SEQ ID NO: 6284 - DNA, 756 bp, Homo sapiens
  misc_feature: GYAE6OF02JYIRE.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcaggctggtggagtcgtgggggagcgtgggtccaggccgtggggacggtccctggacgtacgttcgtccttggtcgaccgaggtcgttcgtgggaaccaactattccttaacaaacttaccgtagtcggcctagttcgacgtaccggttcggggccccgacccgagggcccttcccggaacggggacggaagggggtccttgggggacgggttgggggtacgtcggttaaggtttttacggtttgggtttaggaggttacgggtaaaactttagtaacggtaaactttacggtaactagggtaccgtaaggtacccggttacccggggtaggaaaccggggtccttaagttaccgaccgtactaccgtacgagaacgtactaacgtacgtaaggtacgttaattcgttacttcgtacgtagtaacgtacgaacgtacggtacctaggtacggtacggtacggaacgggtaaccgcgttaagtaagtattacgttcgtaggtagtacggtaagtaacgtaaggacgtaagggtacggtaacggttagggtaccggttagggtacgggtacg

SEQ ID NO: 6285 - DNA, 685 bp, Homo sapiens
  misc_feature: GYAE6OF02H9EFA.24.76.G10.1.454.CMB.1.raw
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
tcagactactatgtcacgaccggtgctcgattttagtcactcatacgagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtgggacggtccctgagactgtcctgtgcagcgtctggacacatcttacaatacctatggcatgcacgtgggtccccacgaggcctccgaggcgaaggggctgggaggtgggngactaggtttagttggttnagtggtaacttanagtaatacgtagtgcgtagcggttaccggtaggaacgggtcccgtaattaccgaacctacttcctaccgaaggaacgtacgtaaacgttacccgaagggttaacgttaaacgtttttgttaactttccgttaacgtaagtactaacggaacgtacggtacccgttagaaggttacggtaccgggtaaacggtaaccgtacggtacttacgttacggttaacgtttaccggttaggtacggtacgtaaggtaacgggtaaaacgaccggtaaggggaacggttacggttaggggttacgggtagggtagggtaccgg

SEQ ID NO: 6286 - DNA, 559 bp, Homo sapiens
  misc_feature: GYAE6OF02IW6PB.24.76.G10.1.454.CMB.1.raw
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
  modified_base (473)..(473): a, c, t, g, unknown or other
  misc_feature (473)..(473): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtggggggaggcgtggtccagccgtgggaggtccctgagactgtcctgtgcagcgtctggacacatcttcaatacctatggcatgcacgtgggtcccgccaggcctccgaggcgaaggggctgggagtgggtggctagtttagtttggtttgagtaggtaaactagtagaattactatgctaagacgtccgtaggacgggcctagttcaccatccncaganactaattccgaggtataatttgattctanagtatcgaacngacctggaacgnggtacgaggaccacggattagtgtacttagtcggtagagtaataggaaacggtcgagggagtagttgggtacggagggtgggtacg

SEQ ID NO: 6287 - DNA, 752 bp, Homo sapiens
  misc_feature: GYAE6OF02GH5Z0.24.76.G10.1.454.CMB.1.raw
  modified_base (316)..(316): a, c, t, g, unknown or other
  misc_feature (316)..(316): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtggggaggcgtggtccagccgtggggacgtccctgagtctgtcctgtgcagcgtctggacacattcttacaaattacctagtcggacagtcgacctacggttcggggtccccnccgtaaggccctaccggaagggaccggtaacgggggccgttaggggacgggttcgggggtacggtacgttaaggttttacggtttttggggttacgaacgttagggtaaaccttaagtacggtaaaatttaccgtagtacgtaacaggtaccggttaccggaggaacgggtaccctattccaaccgtactccgaccgtaagtaacgaacctaacgttccgaagggtaactttaagtttttacgtacctttacctaagaacgtacgtaacgtaaaccgcgtaccggttagaacggtacggtacggaaacggtacccgtaaccgggttaactagggtttaacttacgttacggtacggttacggaacggtagttaaaccggaacggtacgtacggggtaagttacggttacggggtacggtagggtaccggtaccggg

SEQ ID NO: 6288 - DNA, 611 bp, Homo sapiens
  misc_feature: GYAE6OF02HO5T3.24.76.G10.1.454.CMB.1.raw
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (583)..(583): a, c, t, g, unknown or other
  misc_feature (583)..(583): n is a, c, g, or t
  modified_base (600)..(600): a, c, t, g, unknown or other
  misc_feature (600)..(600): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagcctgggaggtcccctgagactgtcctgtgcagcgtctggacacatcttacaatacctatgcatgcacgtggtcccncgaggctccgaggcgaaggggtctgggagtgggtgctagtttagttggttnagttagaaacttaatagaattactagtcgacagtaacggtccgaaggaaggggtcccgtaattaccgacctatccgtacgaaggagtaaactaacgttaccgaagggttaaacttaagttttacggtaatccgtttacgaagtacgtaacgaacaaccgtccgtaggagtacggacgggtaacgacgacgtactagtcgttattacgtgacggacagtaaggaagcgtaagggnggtagttgggttaacgngggtaggtacg

SEQ ID NO: 6289 - DNA, 619 bp, Homo sapiens
  misc_feature: GYAE6OF02GRVND.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctggggagcgtggtccagcctgggagtccctgagactgtcctgtgcagcgtctggacacatcttcaatacctatcggcatgcacgtgggtcccgcaggctccgaggcaaggggctgggagtgggtgcgtaggttagtttggttgataggaaacttaatgaaacttactagtcgacagtacgtccggtaggaacgggccgtaattccaacctatcctaccgaagacgaactaattccgaaggtaacgttaatttttcggaacttccgttacgagtactacggaacaacggtcccttaggagtacggttacggaagggaaccgacggtacttaagtggttaactttacggtaggttcgaacgtacgtaaggaaacgtggtaacgggtaggtacgttagggtttacgtagggtgggtaacgg

SEQ ID NO: 6290 - DNA, 712 bp, Homo sapiens
  misc_feature: GYAE6OF02HGVH0.24.76.G10.1.454.CMB.1.raw
  modified_base (255)..(255): a, c, t, g, unknown or other
  misc_feature (255)..(255): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccagcctgggacgtccctgagctgtcctgtcgcagcgtcnggacacgattcttcaaacgttacctagtacggctatcggtaccacgttcggggtcccgccgaggcccgtaccgagggtccgaaacgggggtccgtgggtacggtggggtcggacgttagttttacgtttggttgaacttagggaactaagtgaagttactagtcgactaggacgttccggtaggaacggggtcccgtatttcccgaacctacgttaccgtaccggaagtaacgtaaccgtaaacgttccgaaagggtaactttaaacggttttacggttacttaaccgttttacgaacggttaacttaacgggaacttaccggtaacccgttggaacggtaacggtcgggaacgtaacccgacggtacttaacgtggttactttacgtacgggtgaccggtaagttaacggaacgtacggaggttaggacgtttcgggtacggtagggtccggtagg

SEQ ID NO: 6291 - DNA, 699 bp, Homo sapiens
  misc_feature: GYAE6OF02HINID.24.76.G10.1.454.CMB.1.raw
  modified_base (170)..(170): a, c, t, g, unknown or other
  misc_feature (170)..(170): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
tcagactactatgtcacgaccggtgctcgatttagtcactcatacagggggggagaggagcccagcactagaagtcggcggtgttccattcggtgatcagcactgaacacagaggactcaccatggagtttggcctgaactgggttttcctcgttgcttcttttaaaggnggtctacgtaggtcgtcgtaggtcgacgcgtcgtgggtaggtacgtcgggtaggggggacgtcggtcggtccgacggtccggtgggtccggtacccgtaggacgtacgtcgttcgtgtcgacgtcgtcggtcgtagacacgtcttacgtactaacgttacctgtccgatacgtcgactcggtccggacccgcgaccgtccacgaggacggaggtggtagggnggtgggacgtacgttagtttcggtttaggtntaacggtagtaatagattaagtactgtcgaacgtcgtaccggtagtaagggtaccggtaccttacgtaccaccgtactcccgaacgagaacgtaaccgtacgtaacggtaacgttaagtttacttagtacttaccgttagagtacaagaccgtacgtaccggtagacgaggtaccggacgtacgtacgtatagttaacttacgtagtcggtgtaacgtaagtaacgtaagacgggtaggttacggacggttacggtacgggtacggtagggttacg

SEQ ID NO: 6292 - DNA, 689 bp, Homo sapiens
  misc_feature: GYAE6OF02JHJVK.24.76.G10.1.454.CMB.1.raw
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
  modified_base (620)..(620): a, c, t, g, unknown or other
  misc_feature (620)..(620): n is a, c, g, or t
tcagactactatgtcacgaccggtgctcgatttagtcactcatacagggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagccgttgggacggttcccctgacgacgtggtcctgtcgcaggccgttctggaccacgatccttcgaatacctagtcggactatgccacgttcgggtccnccgaggcctccgaaggccgaaggggcctggagtgggngcgtaggtttagttggttcgagttaggaacttaatcggaaatcgtaagtcgacgagtacgtccgtaggaacgggccgtattccgaacccattccgtacccgaaggtacgtaacctaaacgttacccgaaggtaacgttaaagtttttggtaaacttaccgttacgtaagtaactacggtaaaacctgggtaaccccttgggaaacggttaaggtacccggtaagggtaacccgtaccggtaacttaagttccggttaatttacggngttaacgacgtaacgtaaggaaacgtcgtaaggggagttaacggtggttaacggtagggtagggtaccg

SEQ ID NO: 6293 - DNA, 627 bp, Homo sapiens
  misc_feature: GYAE6OF02JLQU2.24.76.G10.1.454.CMB.1.raw
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (543)..(543): a, c, t, g, unknown or other
  misc_feature (543)..(543): n is a, c, g, or t
  modified_base (587)..(587): a, c, t, g, unknown or other
  misc_feature (587)..(587): n is a, c, g, or t
tcagactactatgtcacgaccggtgctcgatttagtcactcatacagggggggagaggagcccagcactagaagtcggcggtgcttccattcggtgatcagcactgaacacagaggactcaccatggagtttggcctgaactgggttttcctcgttgcttctttaagaggtgtccagtgtcaggtgcagctggtggagtcgtgggggagcgtggtccagccgtgggaggtccctgagactgtcctgtgcagcgtctggacacatccttanaacttacctagtggcagtgctacgtcgggtccncaggcctaccgaggcgaaggggctagggacggtgggtcggacgtaaggtttacgtttgggttagagtacgggtaactagtgtaaactacgtagtgactagtacgttacgtagggaacggtcgtactaccaacgctcgtacgagtaacgaactaacttaccgagtaacgttaacgttttgacgttcgttacagtaacgtacgtaactacgacgtagagtacggtaccgaaggactaacggntaacgttgtaagttacgtggtacgacggtaagtacggtaaacgnggtaacggtaggtaagttacgggttacgtagggttacggg

SEQ ID NO: 6294 - DNA, 870 bp, Homo sapiens
  misc_feature: GYAE6OF02IEV4M.24.76.G10.1.454.CMB.1.raw
  modified_base (238)..(238): a, c, t, g, unknown or other
  misc_feature (238)..(238): n is a, c, g, or t
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
tcagactactatgtcacgaccggtgctcgatttagtcactcatacgaggggggggagaggagcccagcactagaagtcggcggtgtttccattcggtgatcagcactgaacacgagaggacctcaccatggtagttttcggccttgaacttgggttttcctcgttgctcttttaagaggtgtccagttgtacaggtgccagtccgttggtggtagtcgtgggggacgtcgtcggtacnggccgtgggtacgtcccgtaggacgtcctttcggtaccgttggtcgcctacggtccgtcgtaggaaccacgtattccttaccaacgttaccttagttcggacgngttaccgcgtaccgtccggggtccncccgaggtccctaccggaggtaccggtagggggcgtacggggttagggtcgggtagggtttacgtaaccggttttggttttacgggtttacggactttaaccgggggtaaaacgttaacgttaacgggtaaacttttaccccgggttaaaagttaccgggtacgtttaaaccggggtcggtttaacccgggtaggggtaaacccggggtaaccttacccggttacccttacgtaaccgtttacccgtaacccggtaacgttaaaccgtaacccggttaacggttacccggtaaagggttaacctttacggtttttacgaaccgtttcgttacggtacgtacgttacggaaacttcggtacttaggacgttccggtaaggaccgtaacccgtagttacgttaattccgggttactttaaccggtggttaacggaccgtttaggaacgtaacggtcggtaggtaacgggttagttacgggtttacggtaaccggtggttaaccgg

SEQ ID NO: 6295 - DNA, 785 bp, Homo sapiens
  misc_feature: GYAE6OF02GXK73.24.76.G10.1.454.CMB.1.raw
  modified_base (186)..(186): a, c, t, g, unknown or other
  misc_feature (186)..(186): n is a, c, g, or t
  modified_base (318)..(318): a, c, t, g, unknown or other
  misc_feature (318)..(318): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtncagctgggtggagtcgtgggggaggtcggtggtccaggccgtgggacggtccctggagtactgtcctgtgcagcgtgtcggactacattctcaaactacctagtcggcaagtcgactacgttcggggtcccnccgacggcctaccgacggccgaagggggctaggggtaggtggggtcgacgttaggtttaagttttaggttgaacgttagggaaactttaaggtagtaaaactttacttaagtacggtactaaacggggtacgttacccgggaaggggtaaaccgggtacccttaacgttacccgtaacccgtaaccttaccgtaacccgtaacggtaaacgtaaaccttaaaccgttaccgtaagggttaacgttaaagtttttacggttaacgtttacttaacgacgtaacgtaacgaaccggtacgtaccggtagtaaacggacggtaacggaacggtaacgtacgggtaactacggttacgttagtttaccggttacggtacggtaaccggttaaagtaacgggtaaaccggtacggtaacgggtaacggttaacgggttaggggttaacggttacggggtacgggttaacggg

SEQ ID NO: 6296 - DNA, 810 bp, Homo sapiens
  misc_feature: GYAE6OF02JO8DI.24.76.G10.1.454.CMB.1.raw
  modified_base (167)..(167): a, c, t, g, unknown or other
  misc_feature (167)..(167): n is a, c, g, or t
tcagactactatgtcacgaccggtgctcgatttagtcactcatacagggggggagaggagcccagcactagaagtcggcggtgttccattcggtgatcagcactgaacacagaggactcaccatggagtttggcctgaactgggttttcctcgttgctcttttaagnggtgtacctagtgtcaggtgcagctggtggtagtcgtgggggagcggttaggtcccgaggtccgtggggacggttccccgtaggacgacgttcggtcccttggtcggactaagggtccgttcgtacggggacaacctcgttacgttttaccgaaactttaccctaggttcggactaacgttcggactaaccggttcggggtcccgaccgaacgggtcccttccgaacgggaccgtaaacggggggccttaagggggacggttcgggggtaacggcgttaaggtttcggtttagggttttacggactttacggggaactttaaagcggtaaattacgttacgagtacccaagggtacgttaccggagggaacgggacccgtagttacgaacccgttatccccgttaacgaggtaacgtaaacgtaacttaccggaacggttaagttaacggttttagttaacgtttacttacgaacgttagtcgtaaacgttaccgacgttacggaggtaaacgggtccgaagggttaaccaggttaaccgttaggtaccgttaacgtttcggacggtttacggacggttaacgacggaaacggttcggaacgggtagggactttaggggttacctagggggtaaggtccgggg

SEQ ID NO: 6297 - DNA, 681 bp, Homo sapiens
  misc_feature: GYAE6OF02HGHIZ.24.76.G10.1.454.CMB.1.raw
  modified_base (299)..(299): a, c, t, g, unknown or other
  misc_feature (299)..(299): n is a, c, g, or t
  modified_base (560)..(560): a, c, t, g, unknown or other
  misc_feature (560)..(560): n is a, c, g, or t
tcagactactatgtcacgaccggtgctcgatttagtcactcatacagggggagaggagcccgagcactagaagtcggcggtgttccattcggtgatcagcactgaacacagagactcaccatggagtttgcctgacttggtttcctcgttgcttctttaagaggtgtcctagtgtcaggtgcagtcgtggtggagtcgtgggggaggtcggtgggtccgaggccgtggggacggtcccctggaggacctgtccgtggtcgcgagtccgtcgtggacacgtatcttacaaagttacctancggactaacttcggacacggtcgggtcccgccgtacgggccctccgaacggccgaaagggggtccgttagggacggttggggtacggacgtaggtttaagtttcgggtttagagttcgggtaaactagtagtaagtacgtagtcgagtaaggtacgttccggtagaaaccgggtcgacttaccacgtactccgtaccgagacgaactaacgttccgaagggtattaagttttcgattacttacgaagtatacggaaacgtnaccgttaggacgtaagttcgaaggtaacccgtagtacttaaagtcggtttaatcggttagtcgagttacggaagtaaacgacggtagggtagtagttcggggtttacgagggtagggtaac

SEQ ID NO: 6298 - DNA, 633 bp, Homo sapiens
  misc_feature: GYAE6OF02IPICA.24.76.G10.1.454.CMB.1.raw
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (325)..(325): a, c, t, g, unknown or other
  misc_feature (325)..(325): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctgggtggagtcgtgggggagcggtggtccagccgtgggcgtcctgacgactgtcctgtgcagcgtcgnggacatatcttacaactacctnggcatgcacgtggtcccncgagctccgaggcgaaggggctggngtgggtcgctagtttagtttggttgagtggaaacttatgtaaatctagtcgactagacgtacggaggtaacggggcctattccgacctactccgtacgaacgtaagactaacgttaccgaggtattaacgttttgtacttccttacgaagtacgtacgtaaccgtgtacccggtggaacgtacggtaggaacggaacgtaccggtatagttacgttaagttacgtacggtggttaacgtagtaaacggaacggtaggtaacgggaagggttacggttaggggttacgggtagggttaccgggtaacgg

SEQ ID NO: 6299 - DNA, 694 bp, Homo sapiens
  misc_feature: GYAE6OF02HY7V4.24.76.G10.1.454.CMB.1.raw
tcagactactatgtcacgaccggtgctcgatttagtcactcatacagggggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagcctggggaggtccctgagactgtcctgtgcagcgtctggacacatctcaattacctatggcatgcacgtggtcccgcaggcctccgaggacgaggggctgggaggtgggtggactaggtttagtttggttgaagtgggtaaacttagtaggaattaacgtagtgacagtacgtccggtaggaacgggtcctacgtttccaacctacttacctacccgaaggtacgtaacgtaacgttaccgaaaggggttaacttaaagttttttacggttaactttacctttacgtaaacggtactaacggtaaacctaacggtccgttaagggaacggttaacggtaccgggaacggtacccggtaacggtaccgttaagttacgttacgtttacggtacgggttacggtacggtaagtaacggaaacggtggtaacggggtaggtacggttaggggttacggtaggggtagggtacgg

SEQ ID NO: 6300 - DNA, 606 bp, Homo sapiens
  misc_feature: GYAE6OF02FQS6F.24.76.G10.1.454.CMB.1.raw
  modified_base (400)..(400): a, c, t, g, unknown or other
  misc_feature (400)..(400): n is a, c, g, or t
  modified_base (470)..(470): a, c, t, g, unknown or other
  misc_feature (470)..(470): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagccgtggggaggtccctgagactgtcctgtgcagcgtctggacacactcttccaattacctatggctagtcgcctacgttcggggtacccgccgaaggcctacccggaggccggaagggggtctggggaggtggggtggcgtaggtttagttttggttgagtaggaactaagtgaatactntgacagtcgtcgtgaacgggctactcgactatcctacgagacgtacacttaccgaggtacgttagttttnacttcgtagtacgtatacgtacacgtaccgtagtacgtacggtagtaacggacgaacggtcttaagttcgtagtttaccgtggtaacggacgtataggaacgcggaaggaggtagtggtacggtagggtcgggtag

SEQ ID NO: 6301 - DNA, 770 bp, Homo sapiens
  misc_feature: GYAE6OF02I1X06.24.76.G10.1.454.CMB.1.raw
  modified_base (152)..(152): a, c, t, g, unknown or other
  misc_feature (152)..(152): n is a, c, g, or t
  modified_base (372)..(372): a, c, t, g, unknown or other
  misc_feature (372)..(372): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttccncgttgctcttttaagaggtgtccagtgtcaggtgcagctggtggagtcgtgggggaggtcgtggtccaggccgtggggaggtccccgtggagtactcgtccctgtgcaggcgtcgtggacacattccttacaatacctagtcggctatcgccacggttgggtcccgccgaggcctaccggagggaccgaagggggccttaggggagggtcgggggtcggngttaacggttttagttttgggtttgaacgttagggtaaacgttaaacgttagtaaaagttaacgttagttacggacgtaacggtacgggttttacccggagggttaaaccgggggacccgtttagttaccctaaacccgtactttacccgtacccgtaaggaaacgttaacgtaaaccggtttaccgtaacgggtaaaggtttaacgtttttaaggtaccttttacccgtttaacggaagttaccgttaaccgggtaaacgtacggtacccgttaagggaaagttaccggtacgggaacgggtaaccgtacggtacttaagttcgttacgttacggtgtgtaccgtaagtaacggtaacggacgagggacgtaggttggtacgggtgggtacggtacg

SEQ ID NO: 6302 - DNA, 590 bp, Homo sapiens
  misc_feature: GYAE6OF02JI51D.24.76.G10.1.454.CMB.1.raw
  modified_base (262)..(262): a, c, t, g, unknown or other
  misc_feature (262)..(262): n is a, c, g, or t
  modified_base (377)..(377): a, c, t, g, unknown or other
  misc_feature (377)..(377): n is a, c, g, or t
  modified_base (528)..(528): a, c, t, g, unknown or other
  misc_feature (528)..(528): n is a, c, g, or t
tcagactactatgtcacgaccggtgctcgatttagtcactcatacaggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggagcgtggtccagcctgggaggtccctgagactgtcctgtgcctagcgtctggacacnttcgttcaaataccctatcggcatgcactgggtcccgcgagcctccaggcaaggggctgggacgtgggtggactaggtttagtttggttgattgggaaacttaatgaaatacgtntacgacgtaggaagtccgtggaaacgggtccaagttcaaccctagtcctccgaagagaacaattccgaaggtagttaacgtttgtaacttcgttacaagactagtacgtaacgcttaggatacggtcgaacgtacggtaccggattaagtnttaacgttgtacgtgaaccgttatacgaaggactagggagtacgtggttacggaggtaggag

SEQ ID NO: 6303 - DNA, 716 bp, Homo sapiens
  misc_feature: GYAE6OF02IFUVX.24.76.G10.1.454.CMB.1.raw
  modified_base (639)..(639): a, c, t, g, unknown or other
  misc_feature (639)..(639): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctctttaagaggtgtccagtgtcaggtgcagcgtgggtggagtcgtggggggaggtcgtgggtccaggccgtggggacggtccctggagtactcggtcctggtcgcagtcgtctggacacattctacaattacctagtcggctattcgacctcggtacggggttccccgacctaagggtcccttacccggagggtacccgggaaagggggtccttagggggtaacggggttcgggggtacggtccgttaagggggtttttaagttttcgggtttaaggaacggttacgggtaaaatttaacgttacgtaaacgttacgttaatcggacgtaggtacggtccgggtaaggacgggtcctaattccgacctagtaccacgagtaacgacttaacgtacgaaggtacgttaagttttcgaattcctagtacgagtacgaacgtcgtacgttagacgggtagtaccggtagacccggttaaggtnttaagttcgtacgttattcggtagaccgtaagtaggtaagcggtaaggtcgaaggttcggttacggaggtggtaccg

SEQ ID NO: 6304 - DNA, 823 bp, Homo sapiens
  misc_feature: GYAE6OF02IVZ10.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaaatgggttttcctcgttgcttcttttaagaggtgtccagtgtcaggtgcagctggtggagtcgtgggggaggcggtggtccaggccgtgggacggtccctggacgactgtcctgtgcagcgtcgtggacacatcttacaactacctatggacatcgcacgtcgggtcccgccgaggcctaccgagggcgaaggggtctgggacggtggggtacggtcgtaggtttagttttcggggtttagtaagttacggggtaaaactttaaaggtaacggtaaacgtttaacgttaacgttagtaccgtaagggttaaccgggttacccgggtagggtaaacccgggggtcgttaaccgttaccgaacccgtaacgtcccgtaacccgaacggtaaaccgtaaccgttaaaccgttaacccgggtaagggttaaacggtttaaagttttttacgttaaacgttttccggtttaacgaacgggttaacgtaaccggtaaaaccgtcggttaaccccgtaagggtaaaccggtaacgggttaccgggaaaccggttaaacgggtacccggtaaacgttagttaacggttactttaaccggttggtaaccggtacggttaaagttaacgggaaaggcggttaaacgggtagggttaacggttacggttacgggtacggggttacgggtaacgg

SEQ ID NO: 6305 - DNA, 720 bp, Homo sapiens
  misc_feature: GYAE6OF02H7X4J.24.76.G10.1.454.CMB.1.raw
tcagactactatgtcacgaccggtgctcgatttagtcactcatacagggggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctggtggagtcgtgggggaggcgtggtccagccgtgggacgtccctgagactgtcctgtcgcagcgtctggacacattcttacaattacctatcggactatcgctaccgttgggtcccgccaggcctaccgaggcgaaggggctgggaggtgggtgactagtttatttggttagagttggaaactaatgaaattacgtatcgacaagtacggttccggtaggaaacggggtcccgtaatttacccgaacctacgttacccgtacgaacggtaacgtaaaccttaaacgttacccggtaagggtaaactttaagtttttacgtattaccttacgtaagtaattacgaaacgtacgtacccgtaggaacggtaggttaccggaaagggaaccgtaacggtacgtttaagttacggtttaagtttaccgtggttaacggaaccggttaaaggttaacgggtaaaacgaccgggtaaggggaaacgggttacgggtttacggggttaacggtaggggttcggggtaacccgg

SEQ ID NO: 6306 - DNA, 654 bp, Homo sapiens
  misc_feature: GYAE6OF02IXY5I.24.76.G10.1.454.CMB.1.raw
  modified_base (607)..(607): a, c, t, g, unknown or other
  misc_feature (607)..(607): n is a, c, g, or t
  modified_base (614)..(614): a, c, t, g, unknown or other
  misc_feature (614)..(614): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagctggtggagtcgtggggggaggcggtggtccagccgtggggacggtccctggacgtactcgtcctggtgcagcgtctggacacattccttacaaattacctatcggactatcgactacggtcgggtcccgaccgacggtcctccggaggccgaagggggctgggaggtggggtcgtcgtaggttttagtttggttgaagttacggtaaacttaagtagtaaattacgtagtcgacgaagtacgtcgtaggaacgggcctataccgactatcaccgagactaactaacgttccgaaggttaacttaagttttacgtacttcgttacgaagtactaagaacgtacgtacgtaggaacgttaggacggaacgacgacggtataacggttacttagttacgtggtacgtacgtaggtaanaacgggngtaaggacgggtagttacgggttaggagggttacggtacg

SEQ ID NO: 6307 - DNA, 693 bp, Homo sapiens
  misc_feature: GYAE6OF02JZ06G.24.76.G10.1.454.CMB.1.raw
  modified_base (588)..(588): a, c, t, g, unknown or other
  misc_feature (588)..(588): n is a, c, g, or t
  modified_base (683)..(683): a, c, t, g, unknown or other
  misc_feature (683)..(683): n is a, c, g, or t
tcagactactatgtcacgaccggtgctcgatttagtcactcatacaggggggagaggagcccagcactagaagtcggcggtgtttccagttcggtgatcagcactgaacacagaggactcaccatggagtttggcctggaactggggttttcctacgttgcctcgttttaagaggttgtaccagtgtcaggtgcagctaggtcggtagtcgtaggggagcgtggtaccagtccgtgggacgtccctgagtactggtcctgtcgacaggtccgtcgtggacctacgtactcgttacaagtacccgtatcggtacctagttcgacttacgaacgggttcccgacgacgtcgtaccgagggccgtaacggggtctacgggtcggtacggggtgaccgttaggttagtttcggttgaacgttaggtaaactaacgttacggaacttacgtagtacgacgtaacggagttccgggtaaggaacgggtccgtaacttccggaacctacgttaccgtaccgaaggtacgtacctaaacgttccggaaggttaacgtaaacttttcgtaacttacgttacagtacctagtaacccnggtacgtacgaaggtcgtaccgtaagaccgtaggcttacgtagtattccggtagtaagccgtaatagtaaaccgcgtagacggcgttaggtacgnggtagtaccg

SEQ ID NO: 6308 - DNA, 755 bp, Homo sapiens
  misc_feature: GYAE6OF02HZKI6.24.76.G10.1.454.CMB.1.raw
  modified_base (151)..(151): a, c, t, g, unknown or other
  misc_feature (151)..(151): n is a, c, g, or t
  modified_base (165)..(165): a, c, t, g, unknown or other
  misc_feature (165)..(165): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagttggcctgactgggttttccncgttgctctttagnggtgtccagtgtcaggtgcagctggtggagtcgtggggggaggtcgtgggtcccaggtcccgtaggggtaggttccccctaggacgtaaccttcggttccccgttgggtacggcctacggtcccggttcgttcggggaaccttaaaccgtagttacccttaccgaaaccttttaaccccgtaagttcggaccgtaacttcggtacccaaaccggttccgggggtcccgacccgtaacggggtcccttaccggaacggggaccgaaacggggggccttaggggtaacgggtgggggtggccgttaggtttactttttgggttgtaacgtacggtaaacttaagtggaaatacgttagaggtacgaacggtagttccggtaggaacggggccgtaacgtttaccacccgtatacccgtacacggtaagacctaacgtaccgtaaggtaacgttaatttacgtacttcgttacgtagtacgtagtaacacgtaccgtacgaggtacggagtaccgacgtacgagttagtacttagttacgtgtgacgtagtacgaagcggacggtagtacggttaggtacggtaggtagtcgg

SEQ ID NO: 6309 - DNA, 677 bp, Homo sapiens
  misc_feature: GYAE6OF02HGF63.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccagcctgggacggtccctgagactgtcctgtgcagcgtcgtggacacattcttacaaattacctagtcggacagtcgacacgtcggggtcccgccgaggcctccgagggcgaagggggctgggaggtggggtggcgtaggtttagttttggttgagttagggaaactaagtgtaaatttactagtcgacaagtacggtccggtaggtaacgggcgtaacttaccgaacctactccgttaccgaagtaacggtaacctaaacttacccggaaggttaagttaaacgttttagttacgtttacctttacgaagtagttacgaacgtacgtaccttaggaagtacggttcggaacggtaacgacggtacgttagttacgttacgtttacgttggtacgtacggtaagtaaggaacggacggtaaggtaacggggtagttagggtacgggtaggtcgggtaacgg

SEQ ID NO: 6310 - DNA, 698 bp, Homo sapiens
  misc_feature: GYAE6OF02JF2N4.24.76.G10.1.454.CMB.1.raw
  modified_base (295)..(295): a, c, t, g, unknown or other
  misc_feature (295)..(295): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccagcctgggagtccctgagactgtcctgtgcagcgtctggacacatcttacaatacctatggcatcgcacgtgggcccnccgaggcctccgagggccgaaggggggcctaggggaggtggggtggactaggttttagtttgggtttagagtagggtaaactaagtagaaacttactagtgactaaggtacggttcccggtagggaaacgggtcccgtatttacccgaacccgtacgttccctacccgaaggtaacgtaaacctaaacgttacccggaaagggttaacgttaaagtttttacggtaactttccgttaaccgagtaacgtaggaaaccctacggtccctaaggtaacggacggtacgggaacggtaaccggtacggtacttagttacgttacgtttaacggtggtacgtacgtaacgtaggaaacgacggtaagggtaggtacggttcgggttacggtagggtcgggttaacgg

SEQ ID NO: 6311 - DNA, 702 bp, Homo sapiens
  misc_feature: GYAE6OF02I9P5K.24.76.G10.1.454.CMB.1.raw
  modified_base (577)..(577): a, c, t, g, unknown or other
  misc_feature (577)..(577): n is a, c, g, or t
tcagactactatgtcacgaccggtgctcgatttagtcactcatacaggggggagaggagcccagcactagaagtcggcggtgtttccattcggtgatcagcactgaacacagaggactcaccatggagtttgcctgaactgggtttcctcgttgcttcttttaagaggtgtcctagtgtcaggtgcagcgtggtggagtcgtgggggaggcgttgggtccaggtccgtggggacgtcccgtggacgactggtacctgtcgctaggcgtctacggacacgtaattcctacgaatacccgtagtcggactagtgtcccgacgtgggtccccacgtacggcctaccggagggactacggggcttgggacgggttgggtaggacgttacgggttagttttggggttaagacggttaagggaacttaaagtacgtaaatacgtcgtaggtacctaaggtacggttccggtaagggaaccgggtcgttaacgttacccaaccgtactccgtacgtaaacggtctaaaacgtacgttaccgaaggttacttaagtttagtacttacgtcaagtactagacgtanaccttaggagtaccgtaaggcgtaacgccgttaagtagttactacgttacgtgttacggacgtttagaacgggaacttacgggaaggttcggttaaacgtggggttacgtacgggacggttaagg

SEQ ID NO: 6312 - DNA, 724 bp, Homo sapiens
  misc_feature: GYAE6OF02F8G0R.24.76.G10.1.454.CMB.1.raw
  modified_base (302)..(302): a, c, t, g, unknown or other
  misc_feature (302)..(302): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcgtggtccagccgtgggaggtccctggagactgtcctggtgcagcgtctggacacatcttcaatacctatggcatgccacgttcgggtccnccaggcctccgagggcaaggggctaggggagtggggtggctaggtttagtttgggtttagagttacgggaaactttaagtgtaaattactagttcggactagtacggttccggtaggaacggggtccctaagtttaccaaccgtacttaccgtaccgaaggtaacgtaaccgtaaacttacccggaaagggttaacgttaaagtttttacggtaactttccgtttacgaacgttacgttaacggtaaaccgtacggtaccgtacgggtaaaggtacggtacccgggaaagggtaaccgaccgggtacttaaggttacgttacgtttaacgttggttacggtaaccggtaagttacgggaaaacgtccggaaaggggtacgggttaagggtttaggggttacgggttacgggtggggtaacgg

SEQ ID NO: 6313 - DNA, 813 bp, Homo sapiens
  misc_feature: GYAE6OF02FK3WR.24.76.G10.1.454.CMB.1.raw
tcagactactatgtcacgaccggtgctcgatttagtcactcatacagggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagcgtggtggagtcgtgggggaggcgtggtccaggccgtggggacggtccctgagactgtcctgtgcagcgtctggacacactcttacaatacctagtcggctatgctacgtcggggtcccgccgaggcctaccgaggaccggaagggggctaggggaggtggggtggtacgtaggttttagttttgggtttagagttagggtaaacttaagttaggtaaattacgtaagtagactaagggtacgttacccgggtaaggaaaccgggggtcctaacgttaccgaaccctacgtttacccgtaaccgtaacggtacgtaaacgtaaaccgtttaaccgggtaaacgggtaaacgtttaaagttttttaacggtaactttaccgtttacgaaacggttaacgtaaccggtaaaccgtaacggttacccgttaggtaaacggttaacgggtaccggtaaacggggaaacccgttaacgggtaacgtttaacgttacggtttaacgtttaaccggtagggttaccggtaacggttaaacggtaaggggtaaaaccggtacggaaacggggtaaggggttaacgggtttacggggtttacggggttaagggggttagggggttaaccgg

SEQ ID NO: 6314 - DNA, 642 bp, Homo sapiens
  misc_feature: GYAE6OF02IKY1Q.24.76.G10.1.454.CMB.1.raw
  modified_base (300)..(300): a, c, t, g, unknown or other
  misc_feature (300)..(300): n is a, c, g, or t
tcagactactatgtcacgaccggtgctcgatttagtcactcatacagggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccagccgtgggaggtccctgagactgtcctgtgcagcgtctggacacatcttacaatacctatggcatgccacgtgggtcccnccaggcctccgaggcaaggggctgggagtggggtgtacgtaggtttagtttgggttagagtagggaaacttaagtgaattactagtgactaagacgttccgtaggaacgggccctaattccgacctacgttccgtaccgaagtacgtaacctaacgttaccgaagggtaagttaagttttcgtacttcgttacgtaagtacgtacgaaccacggtacctaggacgtacggtacggaacggtacgaacggtcttaagttacgttacttacgtggtacggacgtaagtaaggtaacgacggtagggacggttaggttacgggttacggtagggtagggtaccgg

SEQ ID NO: 6315 - DNA, 753 bp, Homo sapiens
  misc_feature: GYAE6OF02JYLAF.24.76.G10.1.454.CMB.1.raw
tcagactactatgtcacgaccggtgctcgatttagtcactcatacaggggggagaggagcccagcactagaagtcggcggtgtttccattcggtgatcagcactgaacacagaggactcaccatggagtttggcctgaactgggttttcctcgttgctcttttagaggtgtccagtgtcaggtgcagctggtggagtcgtgggggaggcgtggtccagccgtgggacggtccctggagactggtcctgtgcgagcgtctggacactatcttcaattacctatcggctatgctacgtcgggtcccgccaggtctcccgaggcgaacgggggtctgggaggttcggggtacggtatacggtttaggtttgggtttaggaagttgggtaaacttaagtagtaacttactaggtcgacgaggttacggtaccgtaggtaaacggggccttaacgttaccgtacctaacgttccgtaaccgacggtaacgtaaccgtaaattaccggtaacgggttaagttaaacgtttttacggttaaactttcccgtttaagaaaccgttagttaacggaaaacgttaccggtaaccggtttaggtaacggttacggtacccggtaaagtacccgggtaaacggtaccgttaagttacccggtttaattacccgggtttaggtcggtaacggttaaagttaacggtaaacggtcggtaaagggtccggtaaaggtttacgggtacggttagggtacgggggttaac

SEQ ID NO: 6316 - DNA, 786 bp, Homo sapiens
  misc_feature: GYAE6OF02I2UHJ.24.76.G10.1.454.CMB.1.raw
  modified_base (266)..(266): a, c, t, g, unknown or other
  misc_feature (266)..(266): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctctttaagaggtgtccagtgtcaggtgcagctggtggagtcgtgggggagcgtggtccagccgtgggacgtccctggagactgtcctgtcgcagcgtctaggaccanacttcgtacaactaccttagtcggctatcgacctacgtcggggtacccgccggaacggtcctaccgaacggggaccgaaacgggggggcttaggggagggttcgggggtacggacgttaaggttttaaggtttttgggttaacggtacggttaagggtaaaaccgttaagttaggtaaaactttacgtaagtaccggtagtaaacggggtacggttacccgggttaaggggaacggggtacccgttaagtttacccgaacccgtacgtacccgttaccgtaagggtaacgtaaaccttaaaccggttaccgaaacgggtaagtttaaacgttttttacgttaacggttttactacgtaaagttacgtaaccggtaaacgtaaccgtaccgtaggtacgttacggtaccggaacggtaaccggacggttacgtaagttcgttaacttacggtacgtggtaacgtagtaacggaacgtaggacgggtaagttaggttacggtacggtacgggtgggtaacgg

SEQ ID NO: 6317 - DNA, 647 bp, Homo sapiens
  misc_feature: GYAE6OF02F3D48.24.76.G10.1.454.CMB.1.raw
  modified_base (153)..(153): a, c, t, g, unknown or other
  misc_feature (153)..(153): n is a, c, g, or t
  modified_base (187)..(187): a, c, t, g, unknown or other
  misc_feature (187)..(187): n is a, c, g, or t
  modified_base (297)..(297): a, c, t, g, unknown or other
  misc_feature (297)..(297): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttccncgttgctcttttaagaggtgtccagtgtcaggtncagctgggtggagtctgggggagcgtggtccagcctgggagtccctgagactgtcctgtgcagtcgtctggacacatcttacaatacctatggcatgcacgtgggtcccncaggtcctccggaggccgaaggggtctgggacggtgggtggactaggtttatttgggttgagttggaaacttaatgaaattctagtcgacgtagacggtccgtaggaacgggtcctattaccacctataccgtcgaacgtacgaactaacgtacccgaagggtaagtttaacgttttacgtactttcgttaacagtaacgtacgaacgtacggaccgttaggaacgtacggtacggtaaacggtaccggtaaggtccttaagttcggttacttacggtggtaacggtacgtaagtaacggtaaggacgagggttacggtagttacgggtacggttagggtgggtaaccgg

SEQ ID NO: 6318 - DNA, 930 bp, Homo sapiens
  misc_feature: GYAE6OF02JCZ2O.24.76.G10.1.454.CMB.1.raw
  modified_base (235)..(235): a, c, t, g, unknown or other
  misc_feature (235)..(235): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggagcgtggtccaggccgtgggagtcccnggagactgtcctgtcgcgagcgtcgtggaccactagtcttacaaacttaccctaagtcgggacctaattcggacctaacggttcggggggtaccccgtacccgaacggggtcccgttacccgaacgggggtcccggaaaaagggggggggttcccttaggggggggtaacggggtttcggggggggttaaccgggtccgtttaaaggggttttttacggttttttagggggtttttacgtaaaggtttaacgggggtaaaaaccttttaaaaggttagggtaaaaaccgtttaaccgtttaaggttacggaaccggttaaggggtacccggttttaccggggtaacggggaaaaccgggggtcccgttaaacgttttacccggtaaacccctacgtttaaccccgtaccccggtaaagggtaacccgtaaaacgttaaaccgtttacccggaaaggggttaaacgttttaaagttttttaccgggttaatttacccgtttaacggtaaggttaaccttaacgggaaaccgtacggtaacccgtagggtaaacgtaacgggtacggtaaacgggaccgtaaccggtacgttaagttacgttacgttaacccgtggttacggaacggtaacgtaaggaaacgtacggtaagggacgggttaaggttaggggttaaccgggagggtacgggttacggg

SEQ ID NO: 6319 - DNA, 790 bp, Homo sapiens
  misc_feature: GYAE6OF02GXAQ8.24.76.G10.1.454.CMB.1.raw
  modified_base (321)..(321): a, c, t, g, unknown or other
  misc_feature (321)..(321): n is a, c, g, or t
tcagactactatgtcacgaccggtgctcgatttagtcactcatacagggggggggagaggagcccagcactagaagtcggcggtgtttccattcggtgatcagcactgaacacagaggactcaccatggagtttggcctgaactgggttttcctcgttgcttcttttaagaggttgtccagtgtcaggtgcagctgggtggagtcgtggggggaggcgtggtccagccgtggggacggtcctgagactgtcctgtgcagcgtctggacacattccttacaaacttacctatcgggacagtgaccgtacgtcggggtccccnccgacgggtcctaccggaggccggtaacgggggctaggggtagggtcggggtggacgttaggtttaggttttcgggtttagagttacgggtaaacgttaagtacgtaaatttacgtagtaggacgtaaggtacggttaccggtagggtaaccgggcgtactttaccgaaccctagttaccgtacccgaaaggaaccgtaaaccgttaacggttaacccggtaaagggtaacgttttaaacggtttttatttaccgtttacgtttacgtaacggtaacgttacggaaaccgttaccgtaccggtaggtaaccggtacgggtaaccggaacgggtaaccggtaccgggtacttaacgttaggtttacgtttacgtacggttacgggaaccgttaaggttaaacggaacggttacgggaacgggttagggttaacggtttagggggttacgggtaggggtacggggtaccgg

SEQ ID NO: 6320 - DNA, 804 bp, Homo sapiens
  misc_feature: GYAE6OF02I1U7V.24.76.G10.1.454.CMB.1.raw
  modified_base (152)..(152): a, c, t, g, unknown or other
  misc_feature (152)..(152): n is a, c, g, or t
  modified_base (188)..(188): a, c, t, g, unknown or other
  misc_feature (188)..(188): n is a, c, g, or t
  modified_base (368)..(368): a, c, t, g, unknown or other
  misc_feature (368)..(368): n is a, c, g, or t
  modified_base (647)..(647): a, c, t, g, unknown or other
  misc_feature (647)..(647): n is a, c, g, or t
tcagactactatgtcacgaccggtgctcgatttagtcactcatacaggggggggagaggagcccagcactagaagtcggcggtgtttccattcggtgatcagcactgacacagaggactcaccatggagtttggcctgaactgggttttccncgttgcttactttaagaggttgtccagtgtcaggtncagcgtggtggagtcgtgggggagcggttggtccaggccgtggggacgtcccgtaggagtaccgtggttcctaggtcgcgtaagccggttacgtacggaacctactactttccttacgaaacctttacccgttaagtcgggtactaacgttcggaccgttaccgttacgggggtaccccnccggtaacggtccgttaaccccggaaggggaccggtaaagggggtcctttaggggaagggtttcggggtacgggtacctttaacggggttttaaggtttttccgggtttaacgaaggtttaacgggaaaaccgttttaagtacgggttaaactacgtaagttacggaactaggtacgtaccggtacggaaacggttccgtaacgttaccgaactacgttaccgtacgtacggtaacaacgttaacgttaccgtaagtaacgttaagttttagtacgttnttaccgtaaggtactacgaactacgtacgtacgaacgacggtacgggacgaccgtacggtaccttaagttacgtttacgtacggtacggtcgaacggtagtaacgaacgtagtaacgggtacgttaacggttcggttacggtacggtaggggtaccg

SEQ ID NO: 6321 - DNA, 749 bp, Homo sapiens
  misc_feature: GYAE6OF02GWTVW.24.76.G10.1.454.CMB.1.raw
  modified_base (281)..(281): a, c, t, g, unknown or other
  misc_feature (281)..(281): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctggtggagtcgtgggggaggcggtggtccaggccgtggggaggtcccgtgagactgtcctgtgcaggcgtctggacacatctcaatcctangcatgctacgtcgggtcccgccgacggcctaccgaggtccgaacgggggctaggggaggttgggggtcggtacgtaggttttagttttgggtttgagttaacgggtaacttaaagtgtaaacttacgttagtcgacgtaggtacgttcccgggtaggaaccgggtacccgtaatttacccaacccgtctttacccgtacgaaggtaacgtaaaccttaacgttacccggaaaggttaacgttttaaacgttttttacgtaaccttttaccgtttaccggaaagttaacgtaaccggtaaaccgacgttcccggttaaggaaccgggtaaggttacccgggaaggaacccgttacggtaaccgtttagttcgtttagtttaccgtagggttcgtaacggttaacgtaagggaaacgtcgaagggggtacggttacgttacgggggttagtaacgggggtgggtaaccgg

SEQ ID NO: 6322 - DNA, 733 bp, Homo sapiens
  misc_feature: GYAE6OF02IJ78F.24.76.G10.1.454.CMB.1.raw
  modified_base (152)..(152): a, c, t, g, unknown or other
  misc_feature (152)..(152): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttgcctgaactgggttttccncgttgcttcttttaaggaggtgtccagtgtcaggtgcagctggtggagttcgtgggggagcgtggtccaggcctgggacggtccctgagactgtccgtgtgcaggcgtctggactacatcttacaactacctatcggcagtggctacgtgggtcccgaccgaggcctaccgaggcgaacgggggctgggaggtgggtgcgtagtttgtttggtttagacgttagggtaaaacttaagtcgtaaacgtttaataagtcggtacgaaacggttacgggtccgggttaagggtaaacgggggtaccctaacgtttacccgaaccccttaacgtacccctaaccgaaggtaaacccgtaactaaaaccgttaccggaaggttaaagtttaagttttacgttacttaccgttaacgtattaaacgtacgtaaacgtaccgttaccgtgggtaagaaccgggttacggaaacggggtaacccacggttaacgtaagttacggtttaacctttacggtgtaacgtcggtaaatcgggaaagaacggtagggaaggttaacgttgggttaccggtgggtaggttaacgg

SEQ ID NO: 6323 - DNA, 706 bp, Homo sapiens
  misc_feature: GYAE6OF02JYBLP.24.76.G10.1.454.CMB.1.raw
  modified_base (168)..(168): a, c, t, g, unknown or other
  misc_feature (168)..(168): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (325)..(325): a, c, t, g, unknown or other
  misc_feature (325)..(325): n is a, c, g, or t
tcagactactatgtcacgaccggtgctcgatttagtcactcatacagggggggagaggagcccagcactagaagtcggcggtgtttccattcggtgatcagcactgaacacagaggactcaccatggtagtttggcctgaacttggtttcctcgttgctcttttaagnggtgtccagtgtcaggtgcagctggtgagtcgtgggggagcgtgtccagccgtgggacgtccctgagctgtcctagtncgagcgtntgacanatctaacaatacctagtgacagtcgcctacgtcgggtcccacgcggcctccgaggcgaacggggntcgggaggttggggcggtacttagggtttagtttgggttcgaacgttgggtaaaacttaggtacgtaaacgttacgtagtcggtactaaggtcggtaccggtaagggaaccgggtcgtaattcccgaactcgttaccgacgtaagacgaaccgttaaacttccggaaaggttacttaacgttttcggtaacttaccttaaggaagtacgtaaccgggtaaacctggtaccgttaaggtaaccgggtaccgttaacggaacgggttaacccgacggttctaacgtttacgttacgttaacgttggacggttacgtaaggtaacggagggtacgtaaacggggtcttaacgggttaccggtagggttaccgggaaggttaccc

SEQ ID NO: 6324 - DNA, 835 bp, Homo sapiens
  misc_feature: GYAE6OF02G469X.24.76.G10.1.454.CMB.1.raw
  modified_base (153)..(153): a, c, t, g, unknown or other
  misc_feature (153)..(153): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttccncgttgcttcttttaagaggtgtccagtgtcaggtgcagctggtggagtcgtgggggagcgtggtccagcctggggacgtccctgacgactgtcctgtcgcaggcgtcgtaggacactatccttacaaacttacccttagtcggacctagttcgaccgtaacggttccggggtacccgaccgacgggtccctaccccggaaggggaccggaaaggggggtccgtagggggtacgggtgggggttacggtacgttaaggggtttttagtttttagggtttgaacggtttaacgggtaaacttaaagtacgggtaaaactttaacggttagtacggtacggtaaacgggtcggttaccggggtaagggaaaccggggtcccttacgttacccgaaccgtacttccgtaacccgaagggacttaaaccgtaacgttccggaaagggttacctttaagtttttcgaacgtttacccgttagtaaggtaactacggtaaacccgtaaggtacccttaggggaaaagttcgggtaaccgggtaaagttccccggaaagggttacctttaggttacgtttaacggtttaaccggtcgggtaaggtacccggttaaagaaccggaagggttaccgggaaggggttaacggtttacgggttcgggggtttaacgtaggggtacgggtaacgg

SEQ ID NO: 6325 - DNA, 707 bp, Homo sapiens
  misc_feature: GYAE6OF02IRSW6.24.76.G10.1.454.CMB.1.raw
  modified_base (190)..(190): a, c, t, g, unknown or other
  misc_feature (190)..(190): n is a, c, g, or t
tcagactactatgtcacgaccggtgctcgatttagtcactcatacgaggggggggagaggacgcccagcactagaagtcggcggtgtttccagttcggtgatcagcactgaacacagaggactcaccatggagttggcctgacgtggtttcctcgttgcttacttttaagaggtgtccagtgtacaggtncaggcgtgggtggaggtcggtggggggagcggtgggtccaggccgtaggggacggtccctggagtactggtcctggtgacagtccgtgtacggaacacattccttataaaacttcctagttcggactagttggcctaacggttcggggacccaccgaaggtcccgtaccgaaccgggtagaaacggggggtcttaggggtaacgggtggggtacggtcttaaggggttttacgtttgggttagagttagggtaaactaagtagaaccttacgtagtgacgtagtaccggtcggtagaacggggtcctaagtacgtacctatccgtacgacgtacgaactaacgtacgaggtaattaacgtttagtacgttactagtagtagtacgaagtacgtaccgttagacgtacgtacgaacgaaccggtacgtacgtaattacgttagttacgttcggtaggacgtaaggtaacggaagtacgggaaggtaggtacggttagggtcggtaggtacggggtaac

SEQ ID NO: 6326 - DNA, 954 bp, Homo sapiens
  misc_feature: GYAE6OF02JSPDL.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtcgtcctagtgtcaggtgcagctggtgagtcgtggggagtcgtggtccagccgtgggaggttccctaggagtactcgtccgtgtcgccgtagtcgttctggaacctactacttccgttaacaacttacccttagtcggccagttcgacctaccgggttccgggaccccgtccgtacgggcccttaaccggacggggtaccggaacgggggttcccgtaggggtaacgggtttcgggggacgttaccggttaaggttttttacggttttacggggttttaaccgaaaggttttaccggtaaaaaccttttaagggtaacgttaaaacgttttacccgtaaaggttcggaaccgttaacggttaacccggggtttaacccgtaagggtaaaccgggggtttcccttaacgtttaccccgtaaacccgtacgtttaccgtaaccccggtaaaggtaaccgttaaaccgttaacgttaacccggggtaaacggttaagtttttaaaacgggttttaccttaaaccgtttcccggttaaactaagggttaaccctaaccgggttaacctaaccggttacccgttaaggtaaaccggttaaacccggggttacggaaacgtttaacccggaaacggtttaccgtttaaacgttttacggttaaccggttttaccggttccggtaaacggttaccgttaacgggtttaaacgggacccggttaaaaggttaccggggttaaaggttccgggtttaaacggtaccggggttagggtaccgggtttacccgg

SEQ ID NO: 6327 - DNA, 723 bp, Homo sapiens
  misc_feature: GYAE6OF02G2VST.24.76.G10.1.454.CMB.1.raw
  modified_base (274)..(274): a, c, t, g, unknown or other
  misc_feature (274)..(274): n is a, c, g, or t
tcagactactatgtcacgaccggtgctcgatttagtcactcatacaggggggggagaggagcccagcactagaagtcggcggtgtttccattcggtgatcagcactgaacacagaggacctcaccatggagttcggcctgaacgttcgggttttcctcgttgcttacttttaaggaggtgtccagtgtcgaggtgcagtcgtggtggagtcggtagggggacggtcgtcggtaccgaggtccgtggggacggtccctgagtacgtcggtcccgngccaggccgttcgtacgaacgtactattcctaccgtaatacctagcgactgtcgacgacgttcggtcccgaccgtacggacctccggacggacggaacggggtctagggtagggtcgggtcggtacgttaacggttttaggttttgggtaagtagtaaccggtaaataaggtttaacgaagttaaccgttagtcgtaacgtacgtacgtaccggagggtaacggacctacgttacgactactcgtaaccgaggtaactacgaacttcggaagttagttacgtttagtacgtttactagtacgtatacgtaaacgcgtaccgagtaacggtcgtagggaaccggtcgaacggtcttaaacgtaggttaacttacggtagtaccggtaaggacgttaaggtaacggacggtaggtacggtaggtaggtacggtaggtacgggtcttacggg

SEQ ID NO: 6328 - DNA, 694 bp, Homo sapiens
  misc_feature: GYAE6OF02IKL33.24.76.G10.1.454.CMB.1.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (374)..(374): a, c, t, g, unknown or other
  misc_feature (374)..(374): n is a, c, g, or t
tcagactactatgtcacgaccggtgctcgatttagtcactcatacaggggggagaggagcccagcactagagtcggcggtgtttccattcggtgatcagcactgaacacagaggactcaccatggagtttggcctgaacttgggttttcctcgttgtcttcttttaagaggtgtccagtgtcaggtgcagcgtggtggagtcgtgggggagcgtggtccagccgtgggcggtccctggagctgtcctgtgcngcgtcgnggacncatcttcaatacctntggcagtgctacgtcggtcccnccgtaggcctcgaggcgagggctgggngtgggtcgactaggtttagtttgggtagacgtaggtaaacttaagngtaaacttacgtacgtgtacgtaagtaccggtcggtacggaacgggtccgtaattccgacctaatccgtaccgaagtacgtaaccgtaattaccggaagttaacgttaaagttttcgtttaacttccgtttaaccgagtaacgtacgtaaacgcggttaccgtagtaacgaacgggttaccggaacggtaacgtaccgggtaaccttagggtttaaccgttagtttacccggtaggttccggaaccggtaagttaacggaaacccgttaggaacgggtaaggttcgggttacgggttacggttacgggtagggttaccgg

SEQ ID NO: 6329 - DNA, 834 bp, Homo sapiens
  misc_feature: GYAE6OF02IKDVL.24.76.G10.1.454.CMB.1.raw
tcagactactatgtcacgaccggtgctcgatttagtcactcatacaggggggggagaggagcccagcactagaagtcggcgtgtttccattcggtgatcagcactgaacacagaggactcaccatggagtttggcctgaacttgggtttttcctcgttgcttcgtttttaagaggttgtccagttgttcaggtgcagctgggtggagttcgtgggggaggtcgtggtccaggtccgttggggacggtcccgtggacgtaccgttcgttcccttggtcgacgtacgccgttcgtaggacctactagttcttacgaattaccttagcggtacagttcgaccacggttccggggtcccgcccgaaggcccttacccggaagggtaccgggaagggggtccttaaggggtagggttcgggggtacggtaccgttaaggtttttacggtttttgggttagaaggtttaacggtaaactttaagtacgtaaattacgttagtcgtaacgaggtacggttcggtacggaacgggtccctagtttacccaacgtaccttacgtaacccgaaggtaacgtaacccgttaacgttacggtaacggttaaggttttaaagtttttcggtaactttaacccgtttagaaacggttacgtttaacggaaaccctacggttaacccgttagggtaaccgtaacgggtacggaaaccggtaccggtaacgttaccttaagtttacggttaaccgtttagccggttaagtaaccgtaaggttaaaccgtaaacggacgggttaaggaagggttacggttttacggggtagtaccggggttaggttaccgg

SEQ ID NO: 6330 - DNA, 657 bp, Homo sapiens
  misc_feature: GYAE6OF02FNT07.24.76.G10.1.454.CMB.1.raw
  modified_base (152)..(152): a, c, t, g, unknown or other
  misc_feature (152)..(152): n is a, c, g, or t
  modified_base (168)..(168): a, c, t, g, unknown or other
  misc_feature (168)..(168): n is a, c, g, or t
  modified_base (296)..(296): a, c, t, g, unknown or other
  misc_feature (296)..(296): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttccncgttgctgttttaagnggtgtccaggtgtcaggtgctagctgggtggagtcgagggggagtcgtggtccagccgtgggacgtccctgacgtactggtcctgtcgcaggtcgtcaggcactatccttacaaactacctagtcggnagtcgacctcgtcgggcccgccgaggcctccgaggtccggaagggcgtggaggtgggcgtgttaaggtttgtttggtagagtacggaaatagtacgaattacgtatcgacgtagtcgtccggtaggacggctacgtacacactctacgagtagacctacgtacgaggtaattactttagtactagttacgagtaacgtacgtaaccgacgtacgtaggacgtaccggtacgaacgggaaccgtacggtcttaggttagtttactacggttaggtacggtacgttaaggtaaggtaaaccgggtaacgtacggggttagggtaaggttacggggtttacgggtaaggggtttcgggtaccgg

SEQ ID NO: 6331 - DNA, 655 bp, Homo sapiens
  misc_feature: GYAE6OF02HISXP.24.76.G10.1.454.CMB.1.raw
  modified_base (273)..(273): a, c, t, g, unknown or other
  misc_feature (273)..(273): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaacgttgggttttcctcgttgcttcttttaagaggtgtccagtgtcaggtgcagctgggtggagtcgtggggggaggcgtggtccagcccgtggggacggtccctgagtactgtcctgtgcagcgtctggacanattcttacaacttacctagtcggactagtcgacacggttcgggtcccgccgacggcctaccgagggaccgaaggggcgtgggaggtggggtggacgtagtttagtttggttgagttaggtaaactaagtagtaaatactagtacgacagtacggtaccggtaggaacggggtcctaagttacccacctattccgtaccgaagaccgtaactaacttaccgaaggtaagttaagttttgtacttactttacgaagtactagaactagccgtaggaacgtacgtaccgggaagaccgtacgtacttaagtgtacgtttcgtgtacggaccgtagtaacggtaacgcggtaagggaggtacgttagggtacggagggtcggtacg

SEQ ID NO: 6332 - DNA, 968 bp, Homo sapiens
  misc_feature: GYAE6OF02FJH4K.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcgaccatggagtttggcctgaactgggttttcctcgttgcttcttttaaggaggtgtccagttgcaggtgcagctggtgaggtcgtgggggaggcgtggtccgaggccgtaggggtacggtccctggacgacgttcggtcctgggtcaccggtaggccgttcgtacgggtaccaaccgtacttccgttaccgaaaattaccccgtttaagttccgggactaacgttcggacccgtaaccgggttcggggtaccccggaaccccgtaaggttcccgaacccggtaacgggaccggtaaacggggggtacctgggggtaacgggttcgggggttcgaaccggttaagggttttttacggttttagggttagttaacggttaagggttaaacttaaacgggttacgtaaacgtttaacgttaggtaaccggttaccgaaacgggtaccgggtttaccggtaacgggggtaaacgggtaccccgggttaacttaaccgtacccggtaactttccgtaaccgaaacggggtaactaaaacccgttaacgtttaacccgggaaagggttaaacgtttaaacggttttttcgtaaacctttcggtttaaccgaagttaaacggtttaacaaacggaccggtttaccggtaagggtaccggggtaaaggttaccgggaaaacgggtccccgttaacgggttccgttaacggttagttttaacccgggtttaaccgtcgggtttaaggaacccggttaaggtaaaagggttacccgggtaaaccgggagggggttaaaacgtttcccgggtttaaaggggggggttccgtaacggggggtttacgggttaaaccggg

SEQ ID NO: 6333 - DNA, 746 bp, Homo sapiens
  misc_feature: GYAE6OF02H3VTQ.24.76.G10.1.454.CMB.1.raw
  modified_base (150)..(150): a, c, t, g, unknown or other
  misc_feature (150)..(150): n is a, c, g, or t
  modified_base (164)..(164): a, c, t, g, unknown or other
  misc_feature (164)..(164): n is a, c, g, or t
  modified_base (173)..(173): a, c, t, g, unknown or other
  misc_feature (173)..(173): n is a, c, g, or t
  modified_base (181)..(181): a, c, t, g, unknown or other
  misc_feature (181)..(181): n is a, c, g, or t
  modified_base (242)..(242): a, c, t, g, unknown or other
  misc_feature (242)..(242): n is a, c, g, or t
  modified_base (530)..(530): a, c, t, g, unknown or other
  misc_feature (530)..(530): n is a, c, g, or t
  modified_base (704)..(704): a, c, t, g, unknown or other
  misc_feature (704)..(704): n is a, c, g, or t
tcagactactatgtcacgaccggtgctcgatttagtcactcatacgagggggggagaggagcccagcactagagtcggcggtgtttccattcggtgatcagcactgaacacagaggactcaccatggagtttggcctgactggttttccngttgctctttaagngtgtcagtntcgaggtncagtctgggtaggagtcggtagggggacgtcgtgggtccaggtccgtaggggacgttcccnggaacgtcttcggtcctgtcgactaggccgttacaggaacctactacttccttaaccgaacttaacctagtaccggataattcggcctaacgggtttcgggccccacgtaacgggtcctacggacgggaccggaagggtcgtcggggtagggttcgggtcgggtattaggttttacggtttacgggtagtaacgttacgaaaacggtttagtaactaacgtttacgtaagtcgaactaaacgggtcttaacccgggtagggaaaccgtttacccgattaccctaaccncggtttacccaccgaagtaacggtaactaacccgttagaaacggttaagtttatttagttacgttactagtaacgtactaagggataccggtagacggtaagttaccggaggttacgccggtaagtacccgttaagttgaacctttgggcttaaggaccgttagaaggttaacncgggttaaggtaggtaaccgttgggaccgtggtaacggtcgg

SEQ ID NO: 6334 - DNA, 775 bp, Homo sapiens
  misc_feature: GYAE6OF02FYWGL.24.76.G10.1.454.CMB.1.raw
  modified_base (174)..(174): a, c, t, g, unknown or other
  misc_feature (174)..(174): n is a, c, g, or t
  modified_base (206)..(206): a, c, t, g, unknown or other
  misc_feature (206)..(206): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttgcctgaacctgggttttcctcgttgcttacttttaagaggtntccagtgtcgaggtgcagcttggtggagtcgnggggggagcgtggtccagccgtgggacgtccctgacgtactgtccgtgtgcgagtcgtctggacacattccttacaacttaccgtatcggactagtcgtacctacgggtcgggtacccgccggacggtccttacccggagggccgtaaggggtccgtagggtacgggtggggtacgtacgttaaggtttgtttttgggtacgtaaggttaacgggaactttaaagaggttaaaacgtttaccgtaaggttacggaccgtaaggggtacccggttaccggttaaggggaaacccgggtcttaccgttaaccgaaccgtaccgtacctaccgaacggtaacgtaaaccgtaacgttaccgaaaggtagtttaagttttacggttacttaccgtttaacgacgttaaactaccggtaaaccgtaccggtacgtacgggtaacgttaacgggaacggtacggtaaccgtaccgggttacttggttaacgtttagttaccggtagtcggtaacgttaaggtaacgaagtaccgggtagggtacgttaggtagggtaccggtagggtaggtaccg

SEQ ID NO: 6335 - DNA, 769 bp, Homo sapiens
  misc_feature: GYAE6OF02IVWFE.24.76.G10.1.454.CMB.1.raw
  modified_base (186)..(186): a, c, t, g, unknown or other
  misc_feature (186)..(186): n is a, c, g, or t
  modified_base (409)..(409): a, c, t, g, unknown or other
  misc_feature (409)..(409): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctgttgcttcttttaagagtgtccagtgtcaggtncagctgggtgagtcgtgggggagtcgtggtaccagcctgggacgtccctgacgtacctgtccttgtgcctaggccgtctcggaccactattccgtttacaaacttaccctagtcggacctagttcggacctacggttcgggtacccgccgacgggtcctaccggagggtcccggaagggggtctggggtagtcgggggtgtcgtaggtttagttttgggttanacgttacgggaaactttaagcggtaaaatttcgaattggaccgtaagtccggttacggtaaggaaccgggtccttagttaccgaacctacgtacctacgacggtaacgtaacttaacgttccgaaggttacgttaattttgaacgtttctacgtaacgtattaacgaaccgtgtacccggtagtaacggtcggttaacggacggtaacgtaccggtaacgtttacgttaacggttaacgtttccggtacggttcggttaaccggtaaacgggttaaggaaaccggttacggggtaaacggggttaacgggttccgggttacgggggttttaacggggtaccgggttaagggggttaaccg

SEQ ID NO: 6336 - DNA, 847 bp, Homo sapiens
  misc_feature: GYAE6OF02HETK2.24.76.G10.1.454.CMB.1.raw
  modified_base (800)..(800): a, c, t, g, unknown or other
  misc_feature (800)..(800): n is a, c, g, or t
tcagactactatgtcacgaccggtgctcgatttagtcactcatacgagggggggagaggagcccagcactagaagtcggcggtgtttccattcggtgatcagcactgaacacagaggactcaccagtggagtttgcctgaacgttgggttttcctcgttgcttcttttaaggaggttcgtccgagtgtcgaggtgcagcgtgggtaggagtcggtgggggagtcgtggtccaggtccgtggggaccggtccccgtaggacgtactcggtccgtggtcggccgtagccgtacgtcgggaacctactagttccttaaccaaagttaccccgtaagtcggtaccaagtttcggacctaaccggggttcgggtaccccgccgtaacgggtcccttacccgggaaggggaccgtaaaggggggtccgtttacgggggaggtttcggggggtacgtaccgtttaagggtttttaaggtttggggttttacggaaggttaacgggttaaaactaggttagtaaaacgttttaactaaggttcggtaacgtaaggtacgttacccgggtagggtaaacggggccgtttaactaccgtactacgttacccggttaaccgaacgtaaacgtaccgtaaacgttaccgtaaaggggttaattttaaaccggtttcgtaacctttccgttaagaacggttattaaccggaacgtacgttccgaaggtacgggtcgtaacggaacggtacccgtaaggtacttaacgttgggttaagttccgtacgggtacgtaggtaactaaggtaaccggnggtttaacgggagtttcggtaggggtaacggtcgggtttagggaccg

SEQ ID NO: 6337 - DNA, 725 bp, Homo sapiens
  misc_feature: GYAE6OF02HU0FG.24.76.G10.1.454.CMB.1.raw
  modified_base (581)..(581): a, c, t, g, unknown or other
  misc_feature (581)..(581): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaacttgggttttccctcgttgcttcttttaaggaggtgtccaggtgtcaggtgcagtcgtgggtggagttcggtggggggagtcggtggtccaggtccgtggggtacgttcccctaggacgacgttcgtccgtgtggccgaggtccgttcgtacggactacgtacttccttacaaacttaccgtagtcggcctagtcggaccgtacggttcgggcccgaccagggtccctaccggagggaccgtaagggggtcttagggggaggttgggggtacggccgttaaggttttagttttgggtttgaacgttagggtaaacttaagtagtaatttacgagtcggacaaggtcgtcggtaagggaaccgggtccgtaattccgacctctaccgtacaggactaacgtacgttaccgaaggtacttagttttacgtacttaccgttanacggttaataccgggaactcggtaccgtagggagtacgggtacgaacgggttaaccgacgtacttagttacgttacttcggtaggtagaccggtagtaggaacggtcgtaagggtacgtgttacgggtacgtagggcgttacgg

SEQ ID NO: 6338 - DNA, 794 bp, Homo sapiens
  misc_feature: GYAE6OF02JDPH1.24.76.G10.1.454.CMB.1.raw
  modified_base (170)..(170): a, c, t, g, unknown or other
  misc_feature (170)..(170): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaactgggttttcctcgttgcttcttttaagnggttcgtccagttgtcaggtgcagctgggtggagtcgtggggggagtcgtcggtccaggcccgtggggaccgttccccgtaggacgtaccgttcggttcccgtggttacgacgtacggcgttcgtacgggaaccacctattccctttaacaaccgttaaccgtagttcggacctagtacgaccgtacgttcggggccccgacgtaccggtaccgtacggacggacggaagggggtccgtaggggtacgggtaggggtcggtaaccgtaggttttagttttgggttacgagttaacgggtaaattaacggttcgtaaaagtttcgtagcgggtaaccgacggtaccggttacccgggaaggtaaccgggtcctaagttcccgaactcgttaccgtaccgaaggacgtaacctacgtaacgtacgggtaagtttaagttttacgtactttaccgtacgtaagttacctagggaacttccggtacgtacggaaagtacgtacgggaacgtaccgtaccgttaagttaccgtttagtacggtttacgacggttatcgggtaaataacgggtaaccgagggttaagggacttacgggttaccggttaggtaacccgggtggttaaccgg

SEQ ID NO: 6339 - DNA, 651 bp, Homo sapiens
  misc_feature: GYAE6OF02JGJG1.24.76.G10.1.454.CMB.1.raw
  modified_base (274)..(274): a, c, t, g, unknown or other
  misc_feature (274)..(274): n is a, c, g, or t
  modified_base (313)..(313): a, c, t, g, unknown or other
  misc_feature (313)..(313): n is a, c, g, or t
  modified_base (390)..(390): a, c, t, g, unknown or other
  misc_feature (390)..(390): n is a, c, g, or t
  modified_base (560)..(560): a, c, t, g, unknown or other
  misc_feature (560)..(560): n is a, c, g, or t
tcagactactatgtcacgaccggtgctcgatttagtcactcatacgagggggggagaggagcccagcactagaagtcggcggtgtttccattcggtgatcagcactgaacacagaggactcaccatggagtttggcctgaactgggttttcctcgttgcttctttaagaggtgtccagtgtcgaggtgcagtctggtggagtcgtgggggacggcgtgtccagccgtgggacggtccctgacgtactcgtcctgtgcgagcgtctggactactnttacttcaactacctatcggccatcgcacgtgggtaccncgagtcctcgaggcaggggtcagggtagtcggggtgtcgtaggttttagttcggttacgagtacggtaacttaacgngtaaaatctagtcgtacgacggtacgttcggtaggacgggcttaacgttccaacttcgtactacgaacgtacgaacttaccgtacgtaggtaagtttacgtttgactttactgaacgtataaccggaactcggtactaggaacgtacgggtcgaaacgtcggtaaccgtnttaagtacgtttagtccgttaggcgtacgtaaaggtaaccgtaggtacggaggttacggtaccggttgggtacggtaggtcgggttaaccg

SEQ ID NO: 6340 - DNA, 741 bp, Homo sapiens
  misc_feature: GYAE6OF02GHHMK.24.76.G10.1.454.CMB.1.raw
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctgggtggagtcgtgggggagcgtggtccagccgtgggacggtccctggacgtacctgtccgtagtcgcaggccgtactggactacgattcgttacaataccttanggacagtcgctacgtcgggtacccncgacggtctaccggaggaccggaaggggtctggagggttacggtggacgttagtttagttttggttagagtaggtaaactaagtagaattactaagtcggaatacggtactccgggtaaggtaaccgggacgtaacgttaccgaaacctacgtaccgtaccgtaaggaacgtaaactaacgttaaccgaaggttaacttaaggttttacttaacgtttactaacggtaacgttataacggtaacgaacgttaccgtaaggtaacgtacggtaacgtaacgggaaccgtaccgggtttaactaacgttacgtttacgtttaacgttacggtacggtaacgttaaggtaaacggaaaggtaccgggaagggttaaccggttagggttaacgggttttaccgggaaggggttagggtaaccgg

SEQ ID NO: 6341 - DNA, 794 bp, Homo sapiens
  misc_feature: GYAE6OF02J2CH4.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagcgtggtggacgtcgtgggggaggcgtggtccagcctggggagtccctgagaccgtgtcctgtgcagccgtcgtggacacatcttacaataccgtatcggctatgctacgtcgggtcccgaccgacggtcctccgagggaccgtaaggggcttgggaggtgggggtacgtcgtaggttttagttgggtttgaagttagggtaaaccttaagttcgtaaattacgttagacgtacgtaaggtacggttacgggtacgggtaaccggggttaccgtacgttttaccccaacccgtacgtttaccgttaaccccgaaaggtaaccgtaaaccgtaaacgtttacccggaaaggtaacggtttaactttttacggtaccttacgttacgaaagttaacgtagtaaaccgacggtttaccctaacgggtaacggttaacgaaccgggtaaacggtaaacccggtacggtaaacccgtttaagttaccgttaaacgggtttcgttacgggttaaccgaggtttaaacggttaaccggaaaggttacccgggaaagggtttaggggtaaacgtttaccgggggtaaaggtaccgggggtttaggggtaacccg

SEQ ID NO: 6342 - DNA, 743 bp, Homo sapiens
  misc_feature: GYAE6OF02J0IG5.24.76.G10.1.454.CMB.1.raw
  modified_base (391)..(391): a, c, t, g, unknown or other
  misc_feature (391)..(391): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctgggtggagtcgtgggggaggcgtggtccagccgtgggacggtcccctggagtactgtcccgtggtgcaggcggttctcgggaacactatcgttacaattacctagtcggcatcgcacgttcgggcccgcgacggtcctccgaaggccggaaggggtccgtagggacggtggggacggcgttaggtttagtttgggtttanaacggttggaaacttagttaggaaactttacgtaacgtgactaaggtacgtacggtaaggaaccgggtcgtaacgtaccgtacctacgtacctacgaggtaaactaacgtaacttaccgaaggaaacgtttagtttacgtacgtttacgttaagacgtaaggtacgtaaacgtacgtacgttaaggtacggttacgggtaacgaacgggtaaaccgtcggttaaccgttaagtttacggtaaccttttacggtacggttacggtaaccttaaggtaacggtaaaaccgggttggaaacggggttacggtaaaggtttcgggttaaacgggtaccgggttaaggggtaaccgg

SEQ ID NO: 6343 - DNA, 804 bp, Homo sapiens
  misc_feature: GYAE6OF02I2KCY.24.76.G10.1.454.CMB.1.raw
  modified_base (183)..(183): a, c, t, g, unknown or other
  misc_feature (183)..(183): n is a, c, g, or t
  modified_base (194)..(194): a, c, t, g, unknown or other
  misc_feature (194)..(194): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
tcagactactatgtcacgaccggtgctcgatttagtcactcatacagggggggagaggagcccagcactagaagtcggcggtgtttccattcgtgatcagcactgaacacagagactcaccatgagtttgcctgaactgggttttcctcgttgcttcttttaagaggtgtccagtgtcaggtncagctggtagngtcgtgggggacgcgtggtaccgagaccgtgggacggtccctggacgactcgtacctgtcgcagccgtntacggactacattctacaacttaccttagnggtcacgttcgacgtacgtcgggtccccgccgaggtcccaccggtaagggacgaacgggggcgtaggggtacggtcggggtaggtcctaggttttaagttttcgggtttaggaggttaacgtaaacgttaagttacggtaaaatttacgaaggttctaaccgtaagggttacggtaccgggtttaaacggggaccgggtacccgtttaacgttacccgaaccgtacgtacccggttacccaacggtaacgtaaactaaaccggttaccggaacgggttaacgtttaaagtttttaacggtttaacttaccgtttaacgtaacgttacggttaacgtaaacgttaccggtaccgttacggaagggttaaccgtacggaacggaaccggtaacgtaccgttaagtacggtttacgttacggttaggtaggttaaccgtaaggtaaccggtaaggacggtaaacgggtacggttagggttacgggtttaacggtagggttacggggttaccggg

SEQ ID NO: 6344 - DNA, 880 bp, Homo sapiens
  misc_feature: GYAE6OF02GHHR5.24.76.G10.1.454.CMB.1.raw
tcagactactatgtcacgaccggtgctcgatttagtcactcatacgagggggggagaggagcccagcactagaagtcggcggtgtttccattcggtgatcagcactgaacacagagactcaccatggtagtttcggcctgaacttgggttttcctcgttgcttacttttaaggaggtgtccagtgtcgaggtgcagtcgtggtcggtagtcggtgggggaggcgtggtccagtccgtgggtacgtccgtaggacgtacgtcgtcctgtgcgagtctcgtgaccacgtacttaccttacgaaacttacctagtcggactagtcgaccgtacggtccggggtacccgaccggtacggccctaccggaagggaccgggtaaaggggtccgtggggtacggtcgggggttcgtacgtttaggttttacggttttgggtttagaacgtttaacgggtaaactttaacgtacgtaaaaactttacgttaagtcggtaaacggtaacgttccgggttacccgggtaaagggggtaacccgggttaccctaaccggttaaccgtaaaccccgttaacgttacccggttaaccgtaaacggggtaaaccttaaccggttaaaccggttaccggtaaaacggggttaacttttaaacggttttactttaaccggttaactttacggtaaacgttacgtaaacggtaaccgtacggttaaccggtaggtaacgggtaacggttaccgggaaaccggttacgaccggttaacgttacgtttacggtttacgttacggttaacggtacgtaaccggtaaggtaacggtaacggtacgggtaacgggtagggttaacgggtttaccgggtaagggttaccggagggttaaccgg

SEQ ID NO: 6345 - DNA, 878 bp, Homo sapiens
  misc_feature: GYAE6OF02HKXBO.24.76.G10.1.454.CMB.1.raw
tcagactactatgtcacgaccggtgctcgatttagtcactcatacgaggggggggagaggagcccagcactagaagtcggcggtgtttccattcggtgatcagcactgaacacagaggactcaccatggagtttggcctgaacgttgggttttcctcgttgcttcgttttaagaggtgtccagtgtcgaggtgcagctgggtggagtcggtggggggagcgtggtccaggccgtggggacggtccctaggagtctgtcctggtgcgagtccgtcgaggacacgtattccgttacaaacttacctagtggactagtcggacgtacgttcggggtcccgaccgtacgggcctaccggaggggaccggaacggggggtccttagggggacgggttgggggtacggtacgtttaaggttttacggttttggggttacgaaggttacgggtaaaactttaaggtacgtaaatttacgtaagtcggaaccgtaagggttacccggttcgggaaacgggtaaccggggttacccttaagttacccgaccgtacgttaccccgttaccggaaacggtaacgtaaaccgtaaacggtttacccggaaagggttaaccgttttaaagtttttacgtttacccgttaccgttttaacgaaaggtttaacgttaaaccgggtaactaccggttaaccggttagggtaaaccggtttaacgggaccgggtaaacgggaaacccggtaggttaccggtttaacgttaaggttaccgttttacgggttacgggttacgaacggttaaacgggttaaaggaaacccggtagggtaacgggttaacggggtacggttttacgggggtaacgggtagggggttagggttaacccgg

SEQ ID NO: 6346 - DNA, 801 bp, Homo sapiens
  misc_feature: GYAE6OF02IGX58.24.76.G10.1.454.CMB.1.raw
  modified_base (209)..(209): a, c, t, g, unknown or other
  misc_feature (209)..(209): n is a, c, g, or t
  modified_base (301)..(301): a, c, t, g, unknown or other
  misc_feature (301)..(301): n is a, c, g, or t
  modified_base (673)..(673): a, c, t, g, unknown or other
  misc_feature (673)..(673): n is a, c, g, or t
  modified_base (679)..(679): a, c, t, g, unknown or other
  misc_feature (679)..(679): n is a, c, g, or t
  modified_base (715)..(715): a, c, t, g, unknown or other
  misc_feature (715)..(715): n is a, c, g, or t
tcagactactatgtcacgaccggtgctcgatttagtcactcatacagggggggagaggagcccagcactagaagtcggcgtgttcacttggtgatcagcactgaacacagaggactcaccagtggtagtttggcctgtaacttcgggttttcctcggttgtcttacgttttaaggaggtcgtccgaagttgtcgaggtgacagtctggnggtagtcggtgggggaggcgttacggtccacggccggtaggggtacgtccccgttaggacggtctcggttccctggtgcctagtcgttacgnggacctactattacgttactaaactactagtcggacagttacggactccggttacggcccggtaaccctacgggtcccttaccgggaacggggtacgggtaaacgggggtccggttaacggggtagggggttaacgggttccgggtaccgtttaacgggtttttaggtttttaccggtttacggtaaacggttaaacgggtaaaccgtttaaaggtaaacggttacgttaaacttacggttaccgtacgtaacgtaaccgggttccgggtaacggaaaccgggtttacctacttaaccgtaccgtaacttcccgtaacgagtaacgtacctaacgtccgtaagtacgttattaacgttactctacgtagtanacgtanacggtactacggagtccgtacggactacggtacgtnttaacgtcgtagttactcggtaataacggtactaacgaacgtcgggacgaggttccggttaaggtaccggtaggttaccggtacgg

SEQ ID NO: 6347 - DNA, 839 bp, Homo sapiens
  misc_feature: GYAE6OF02FJBWI.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctgttgcttcttttaagaggtgtccagtgtcaggtgcagctggtggagtcggtagggggaggcggttcggtccaggtccgtggggacggtcccgtggacgtactcggtacctggtgacgacggcgttcgacggaccaactattaccttactaaaacgttacccttagtacggactaacttcgaccgtaccggtccgggggtacccacgaacggtccctaccggagggaccggaaacgggggtctggggaacgggttacgggggtcgtaaccggttaggttttacgtttgggtttaggaacggttacgggtaaaactttaaagggtacggttaaaactttaccgtaaggtacggacgaaacgggtttaccggttaccggggtaaggtaaacggggtccccgttaagttacccaacgttcgttaacccgtaccgaaggtaacgtaaaccgttaacgttaaccgaagggtaactttaacggttttacgtaagtttaccgtttacgtaaggtactacggtaaaccgtggtaccgttaggtacgggtaacggttaccggaaacggtaccgtaacggttaacgttacgttaaggtttacgttccggtaagtttaccggacggttaacgacggaaaccggtaggtaacggggtacgttaacggttacggggtacggtagggtttacgggtaacgg

SEQ ID NO: 6348 - DNA, 762 bp, Homo sapiens
  misc_feature: GYAE6OF02GKNGT.24.76.G10.1.454.CMB.1.raw
tcagactactatgtcacgaccggtgctcgatttagtcactcatacaggggggggagaggagcccagcactagaagtcggcggtgttccattcggtgatcagcactgaacacagaggactcaccatggagtttggcctgaactgggtttcctcgttgctcttttaagaggtgtccagtgtcaggtgcagctgggtagagtcgtggggggagcggtcggtccaggccgtggggacggtcccctggaacggactcggttcctggtgcacggtcgtcgtaggacacgtattccttacaaattaccctaagtccggtactaagtcggtaccacggttacggggtccccgtacccgaagggtccctaacccggaacgggtaaccgaaaggggggtcctaggggtaagggtcgggggtcgtaggttaaggtttagtttgggttacgaaacgttacgggtaaacttaaagtacggaaatttaaccgattagaccgtaaaggtacgtacccgggaagggtaaaccgggcccgttaatcccaaaccgtactaccgtaccaaagggtaaccgaacctaacgttaccgaaacggtagtttaacgttttagtaaccgtacttaacgagtaacgtacggtaaactacgggtaccgtaaggtagacggtaacgggaacgggtaacgaccggtaacgttaactaggtttacgttagacggtaaggaccgtaaggtaagaaagtcgaagggtacgacgttggtaacggagtacgggtcc

SEQ ID NO: 6349 - DNA, 694 bp, Homo sapiens
  misc_feature: GYAE6OF02FRNYR.24.76.G10.1.454.CMB.1.raw
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (368)..(368): a, c, t, g, unknown or other
  misc_feature (368)..(368): n is a, c, g, or t
  modified_base (571)..(571): a, c, t, g, unknown or other
  misc_feature (571)..(571): n is a, c, g, or t
  modified_base (641)..(641): a, c, t, g, unknown or other
  misc_feature (641)..(641): n is a, c, g, or t
tcagactactatgtcacgaccggtgctcgatttagtcactcatacagggggggagaggagcccagcactagaagtcggcggtgttccattcggtgatcagcactgaacacagaggactcaccatggagtttggcctagaacttgggttttcctcgttgccttcgttttaaggaggttntccagttgtcaggtncagcgtggtggacgtcgtgggggagcgtggtccagcgtgggacgtccngacgctcgtctgtcgacnggacgttctacggactacgactcttacaactacctaatcggactaagtcgcgtaacgtccggggtaccctccggaacggtccttcccggaagggtccgaacggggggtntccggggtaagggttcggggtacggtccttaaggggtttacgttttgggtttacggaagttcggggaaacttacggtggtaacttacggtagtacgcgtaagtggttaccggtgggaaacggcctaagtttccaaccgtactccgtacgaacgagtactaacttaccggaagacgttaattttaggacttactacgagttagngtaaccgacgtacgtacgtaagtccggaacggacggacctacggacttagtacgttagtacgtcggtaanaggtacgtaagacgaacggtaggtagtggttaggtacggtaggttcggtaacg

SEQ ID NO: 6350 - DNA, 779 bp, Homo sapiens
  misc_feature: GYAE6OF02F76Z4.24.76.G10.1.454.CMB.1.raw
  modified_base (153)..(153): a, c, t, g, unknown or other
  misc_feature (153)..(153): n is a, c, g, or t
  modified_base (190)..(190): a, c, t, g, unknown or other
  misc_feature (190)..(190): n is a, c, g, or t
tcagactactatgtcacgaccggtgctcgatttagtcactcatacaggggggggagaggagcccagcactagaagtcggcggtgtttccattcggtgatcagcactgaacacagaggactcaccatcggagtttggctgaactgggttttccncgttgcttcttttaagaggttgtccagtgtcagggtncagcgtaggtggagtcgaggggggacgcggtggtaccaggccgtggggacgtccctggacgtacttggccgttgtacgcgtagtccgtcgtaggacactacttcttacaacttacccttagtcggactaagttcggaaccgtcgttaccgggggttcccaccggtaggtcccgtccggaaggggaccgtaacggggggtcttacggggtagggttcggggtcggtacgttaggttttggttttacgggttaggtaacgttagggtaaactttaaggtactaaaagtttactaggttacaacggtaacgttcggttaccgggtaacggggtaaacgggtcccttaacggtttaccaacccgttacgtacccgtaacccggaagaaaccgtaactaaaccgttacggaaacggttaacgttaatttttacgtatttacctaacgtagtacgtaacaacgtacgtacgtagtagttacggaacgtacggaacgtacgtacttaacgttacgttacgtacgtacgggtcgaacttaaggtaacggaagtaacggaggtacggtaggttcggtacggagggttacgggtaacgg

SEQ ID NO: 6351 - DNA, 912 bp, Homo sapiens
  misc_feature: GYAE6OF02FI12H.24.76.G10.1.454.CMB.1.raw
  modified_base (153)..(153): a, c, t, g, unknown or other
  misc_feature (153)..(153): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttccncgttgctcttttaagaggtgtccagtgtcaggtgcagctggtggagtcgtgggggagcgttggtccagccgtggggacgtccctggacgtactcgtctaggtcgcaggtcgtcgtggaaccactattccttaccaaagttaccgtatacggctacgtgacctaacgttccgggggtccgcccgagggtccctacgacgggtaccgaagggggccttggggaacgggttgggggtacgtacgttaaggggtttttaacggtttggggttttacaaaggttccgggtaaaactttaggtaccggttaaaatttacgtaagtcggttccgaaaggggttacccgtttaccgggaacgggaaacggggttacccgacgtttacccgaaacccgtaccgtttacccgtaaccgtaaacggtaactaaacccggtttaaaccgtttaccgggaaacgggttaacgttttaaacggtttttaacggttaaacgttttcccgtttaaccggaaaacgtttacgtaaccggtaaaaaccgtacggttaccgggttaaacggtaggggttaaacccgggtaaccgggtaaaccgggaacccgggtttaaccggaaccggtttagtttaaccggggtttaactttaacccggggttggtaacgggtaaccgtttaaaggggtaaacggtaaacgggtaccggggaaagggtttaccggtaaacggggtttagggggtttaccgggtaaaggggtttacccggtaacgggg

SEQ ID NO: 6352 - DNA, 866 bp, Homo sapiens
  misc_feature: GYAE6OF02JRSWP.24.76.G10.1.454.CMB.1.raw
tcagactactatgtcacgaccggtgctcgatttagtcactcatacagggggggagagggagcccagcactagaagtcggcggtgttccgattcggtgaactcagcactgaacacagacggactcaccagtggagtttcggcctgaacttcgggttttcctcgttgtcttacgtttaaggaggtcgtcctaggtcgtctacggtgctacgtccgtgggtagggtagtcggtcggggggacggtcggttcggtccgagggtccgtaggggtacgtcccgtggacgtacgtcggtccctggtcgactacggcgttcgtaggacctaactctcctacgaacttaccgtagtcggactcgtcgtccgtacggtcgggtcccgaccggacgtacccgtaccggacgggtaccgggtaacggggtccgtacgggtacgggtccggggtacggttacggtttaacggttttaggtttcggggttacgaaggtttacgggtaactttaacggtaacggttaaacgttaccgttagtaccggtacgtaacggtacccgggttaccggtaagggaaccggtccgtaaccttaacggccctaacgttccggacgtaaacggtaccttaaacggtaccttcgggtaaggttaaacgtttagttttaacctaagttccgttaaacgaagttacgtaaccgtaacgtcgttaccgtagtaacgggtcgtaaccggtacggtaaaccggtggtaaaccgttacgtaacgggtttaactcggggttaacgaccgggtttacggacgttaaacgggaaaggttcgggtaaaccggggtttgtaaccggggtttggttaacggggttaccggttcggggtaacgg

SEQ ID NO: 6353 - DNA, 807 bp, Homo sapiens
  misc_feature: GYAE6OF02JO22X.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttgcctgaactggttttcctcgttgcttcttttaagaggtgtccagtgtcaggtgcagcgtgggtggagttcggtggggggagtcggtggtccaggcccgtggggacggtcccgtggagtcgttggtccttggtacgcaggtcgtcgtggactactattccttacaaacttacctagtcggactagtgccgacgttcgggtccccgaccgaggtcctaccggaacggtccgggaacggggtcgttacgggtagggttcgggggtacggtacgtttaaggtttttacggttttttggggtaatacggttacgggtaaaatttagttaaacgttaaactttacgtaagttacggaccgttaaggtaccggtacggtaacggtaaccggggtaccttacgtaccgtaacccgtacgtaccctaaccggtaacgtaacgtaaaccgtaaccgttaccggtaaacggttaacgtttaaagttttacgttacgtttaacgttaacgtaagttaacgtaaccgtaacgtaacggtaaccgttacggtaaggtaacgggttaacggaacggttaacggaaccgttacgttaagttacggttactttacgtacggttacggtaacgttagtaaggtaacgtaggaacgggttacggttaggtagggttacggttaggtagggtacg

SEQ ID NO: 6354 - DNA, 811 bp, Homo sapiens
  misc_feature: GYAE6OF02HEEB4.24.76.G10.1.454.CMB.1.raw
  modified_base (682)..(682): a, c, t, g, unknown or other
  misc_feature (682)..(682): n is a, c, g, or t
tcagactactatgtcacgaccggtgctcgatttagtcactcatacaggggggggagaggagcccagcactagaagtcggcggtgtttccattcggtgatcgagcactgaacacagaggacctcaccatggagtttggcctgaacttgggttttcctcgttgcttcttttaagaggtgtccagtgtcgaggtgcgtagcgtggtggatcggtagggggacggtcgtggtccaggcccgtaggggacggttcccctggaagtaccgttgtccgttaggtagtccgagggtccgttccgtaggaacccctacgtaagtttccctttacaaaaacggttcctaacggttcggacgtattacggaccgtaccggttcggggccccgaaccctaacggggtccctacccggtaacggggaccgggtaaacggggtctaaggggtaggttaccgggggtaggtaacctttaacgggttttagggttttgtttaccggaaagttacgggtaaaacttaaagtcgttaaaacgtcgtaagttcgaacggtaacggttacggtaccggtaacggggaagtccgttactacccaaccgtatccgtaccgtaagaacgtaactaacggttacgaacgggtaagttaacgtttacggttataccggtataacggtattacgaaacgtcggtaacncggtaagtacgtacggaacgaacggtcgtaaccgtaaggtttacgtacctttaaggtcggtaacgcggttaagagtaaaccggacggtaaggtaaccgttggtaaggttacggggtagtacggtaacgg

SEQ ID NO: 6355 - DNA, 832 bp, Homo sapiens
  misc_feature: GYAE6OF02I2G6R.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctagaactgggttttcctcgttagcttctttaaggaggtgtccagtgtcaggtgcagcgtggtaggagtcgtgggggaggtcgttcggccgagtccgtacggggtacgtcccgttggacgtactcgtaccgtgtcgactacggtcggtactacggaaccgtaacgtacttccgttaactaacgttaacccgtagtcggacctacgttggaccgtacgtcggggtacccgacccggtacggtcctaccggacgggacggtacggggtccgtagggtacgggtgggtaccggtgtaggttttacggtttggttacgtagtacgggtaaacttaacgtagtaacgtacgtagtcggtacgtacgtaccggtaggtaaccgggaacgggttaccgtactttaaccgaacccgttacgtacccgttacgtaacggaaacttttaacgaaccgttaaccgaaacgggttaagtttaggtttaacgttacgtttacgttacggtaaacgttaggtaaccgtaacgtaaccggttcgtaccggtaagtaccggtagggtaaccgaccggtaccgttaacggtaagtttacggttacttaaccggtcggttacgggtaaccctaggggttaacgtaacgggtaacggaaacggttaacgggttaccggttaggggtttaaccgggacggggttacgggttaaccgg

SEQ ID NO: 6356 - DNA, 763 bp, Homo sapiens
  misc_feature: GYAE6OF02HOL73.24.76.G10.1.454.CMB.1.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (327)..(327): a, c, t, g, unknown or other
  misc_feature (327)..(327): n is a, c, g, or t
  modified_base (664)..(664): a, c, t, g, unknown or other
  misc_feature (664)..(664): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtncagctggtggagtcgtgggggagnggtcggtcccaggccgtgggacggttccccgtggacgtacgtcgtcctgcgcagcgtctggacacgtcttctacgtaacttacctaatcggacagtagccgtacgtcgggtacccnccgaggcctaccggaggtaccggaaggggtcctaggggacggttgggcgtaccgttaagttttagtttcggttagagttacgggaaacttaaagtgtaaactttacgttaggtacgaacgtaggtacggttaccggtagggaaacgggtccctagttccccgaaacccgtacttcccgtaacccgaaaggaccgttaaacccgtaaacgtttcccggaaaggtttaacggtttaacgttttttaacgtaacgtttaccggtttacgaaattaacgttacggaaaccgttccggtaacctagggttaacgacggttacgggaaccggtacggtaaccnggtttaacaggtttaacgttcgtaggtccggtaagttaggtaaggtaaaccggaggtaagggaacgggtttacgtgggttacggtagggtcgggttacg

SEQ ID NO: 6357 - DNA, 820 bp, Homo sapiens
  misc_feature: GYAE6OF02JJX9W.24.76.G10.1.454.CMB.1.raw
  modified_base (161)..(161): a, c, t, g, unknown or other
  misc_feature (161)..(161): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgctnttttaagaggtgtccagtgtcaggtgcagctggtggtagtcgtgggggagtcgtggtccagccgtggggacggtccctaggacgtacgtcgtcctggtcggacaggtccgttctaggaccacgtacttcttacgaaacttacctagtggactagtcgtaccgacgttcggggtaccccgccgtacggtcctacccgaaggggaccggtaaacggggggtccgttagggggtacgggttcggggggtacggtaccgttaaggttttttaacgggtttttggggtttacggtaagtttaacggggtaaaaaccttttaaggttaacgtaaaaagtttaacgttaagtcgggtaacctaaaggggttaccggttcccgggtaaggggaacccggggtcccttaagtttacccaaacccgttacgttaccccgtaccggaacggtaaacgtaaacttaacggttaccggaaggttaacgttaattttacggtacttacgttaccgaagtatacggaacgcggtacttagggaagtacggtaacggtaggaccctaacgggtactttaagttgttacgttaccgtaggtacggttaccaaggttaacggaacggacggttacggggaagttcgggtttacggttacgggtagggttcgggtaac

SEQ ID NO: 6358 - DNA, 749 bp, Homo sapiens
  misc_feature: GYAE6OF02IZLLZ.24.76.G10.1.454.CMB.1.raw
tcagactactatgtcacgaccggtgctcgatttagtcactcatacagggggggagaggagcccagcactagaagtcggcgtgtttccgattcggtgatcagcactgaacacagaggactcaccatggagtttggcctgaactgggttttcctcgttgcttctttaagaggttgtaccagtgtcaggtgcagctggtggagtcgtgggggagcgtcggtccagccgtgggacggtccctgagaccttgtccgtgtcgcgaggtccgtcgtaggacactacgttacttaccaacgttaccctaaggtcggtacctaacgttcgacccgttaacgggttccggttacccggcccgtaacgggtcccgttaccggaaccgggtacggtaaccgggggtccttagggggtaacggtcggggttaccggaacgtttaggttttaccgttttaggggttacgacgtttaaccgggaaactttaagtacccgttaaagttacgttaaggtcgaacgtaacgttcggacggtacgggtaacgtccgtatcccgtaacacgttcacggaacgtacgtactaacgtaccgtaagtatttacgtttacgttcgtacttacgaactcgtaagaaccgtctacgtagaacgtacggtacgacggtaacgacggttatacgtcgttactcggtcggtaacgtagtaaccgtaaggtaagcggttaagggtagtttaccggaaggtacggttggtaccggtacgg

SEQ ID NO: 6359 - DNA, 725 bp, Homo sapiens
  misc_feature: GYAE6OF02GK6KE.24.76.G10.1.454.CMB.1.raw
  modified_base (83)..(83): a, c, t, g, unknown or other
  misc_feature (83)..(83): n is a, c, g, or t
  modified_base (166)..(166): a, c, t, g, unknown or other
  misc_feature (166)..(166): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
tcagactactatgtcacgaccggtgctcgatttagtcactcatacagggggggagaggagcccagcactagaagtcggcggtntttccattcggtgatcagcactgaacacagaggactcaccatggagtttggcctgaactgggtttcctcgttgctctttaagnggtgtccagtgtcaggtgcagctgggtggagtcgtgggggggagtcgtcggaccgaggtccggtgggaccgttccgtaggacgtacgttcgtccgtggcgcgacggtcgtcgaggaccatacttcttaactaactacctaggcgacctagtcgcgtaccggtcgggtcccncggtacggtccctaccggngggtaaccggacgggtcgtaggggtgggtggggcgttagttaaggttttggtttgggtagagtaacggtaaacttaggtagtaaccttaggtagacgtacgtaagtcggtacggtacgggaccgtctacgtacccgaactcgtacctacggaagtaacgtaacttaccgtcggaaagttaagttttatttacgatttaccgagaagttacgtaagaacgtccgtagtacggtacgtaggtaccggaacgtcgaccggtttatacgttaggttaacccttcggtaggtaacccggaccgtaagggtaaaccggaacgttcggggtaaagggttacgttcgggttaacgggtaggttccgggaacgttccg

SEQ ID NO: 6360 - DNA, 727 bp, Homo sapiens
  misc_feature: GYAE6OF02HN1FD.24.76.G10.1.454.CMB.1.raw
  modified_base (183)..(183): a, c, t, g, unknown or other
  misc_feature (183)..(183): n is a, c, g, or t
  modified_base (209)..(209): a, c, t, g, unknown or other
  misc_feature (209)..(209): n is a, c, g, or t
  modified_base (659)..(659): a, c, t, g, unknown or other
  misc_feature (659)..(659): n is a, c, g, or t
  modified_base (669)..(669): a, c, t, g, unknown or other
  misc_feature (669)..(669): n is a, c, g, or t
  modified_base (716)..(716): a, c, t, g, unknown or other
  misc_feature (716)..(716): n is a, c, g, or t
  modified_base (721)..(721): a, c, t, g, unknown or other
  misc_feature (721)..(721): n is a, c, g, or t
tcagactactatgtcacgaccggtgctcgattttagtcactcatacaggggggggagaggagcccagcactagaagtcggcggtgtttccattcggtgatcagcactgaacacagaggactcaccatggagtttggcctgtaacgttcgggtttttccctcggtttgcttacgtttttaaggngggttcgtccagttgtacgagggtcnctagctgggtcggtagtcggtggggggacgtcgtcggtccaggtccgtgggacggttcctgacgtactcggtcgtggtcgacgacggtccgtcggtacggtacctaacgtctttaccgttacaaacgttaccttaggtcggaactacgtcgtacgacccgggttgggtaccccgagtaaccggtcgccgaaacggtgtaaccggggcttagggggtaacggttcgggggtacgtacgttaacggtttttaaggtttgggttacaaacggttacgggaaaactttacgagtaacgttcgttaaagcgtacggtaagtaggtaccggtaggtaacgggcttacgcccttaaacgctaacgtcgaacgactactaacgtggaacgttatttattcggtacttgaagtgagtacgaatccgtagttagagcgttacgacttacggactagtttnagtttaccgnttacgggattaaggagtaacgaagccggtaggtacgtgttcgggtangggtntaccgg

SEQ ID NO: 6361 - DNA, 693 bp, Homo sapiens
  misc_feature: GYAE6OF02FQBXP.24.76.G10.1.454.CMB.1.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (524)..(524): a, c, t, g, unknown or other
  misc_feature (524)..(524): n is a, c, g, or t
  modified_base (581)..(581): a, c, t, g, unknown or other
  misc_feature (581)..(581): n is a, c, g, or t
tcagactactatgtcacgaccggtgctcgatttagtcactcatacaggggggggagaggagcccagcactagaagtcggcggtgtttccattcggtgatcagcactgaacacagaggactcaccatggagtttggcctgaactgggttttcctcgttgctcttttaagaggtgtccagtgtcaggtgcagctgggtggagtcgtggggggagcgtggtccaggcctggggacgtccctgagactgtcctgtgcagcgtcnggaccantcttacaatacctatggacatgccacgtcgggtcccgccgaggcctaccgaggccgaaggggtctagggaggtgggtggctaggttttgtttggttgagtagggtaaactaagtagtaaacttacgtatggactaaggtacggttacccggtagggaaccgggtaccttaattacccgaactacgtccctaccgaaggacggtaaactaacgttcccgaagggttaacttaagtttttcgactttccgttagaagtnttaacggaactacgggtaccgttagaacggtaccgggttaccggaacgggtaacccncgggttaaccttaagttacggtttacttaacgtgggttacggacgtaagttaacggaaacgcggtaaggggtaaggttacggtcgggtttaacgggtgggtacggggtacgg

SEQ ID NO: 6362 - DNA, 716 bp, Homo sapiens
  misc_feature: GYAE6OF02HB4WR.24.76.G10.1.454.CMB.1.raw
  modified_base (273)..(273): a, c, t, g, unknown or other
  misc_feature (273)..(273): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgcttcttttaagaggtgtccagtgtcaggtgcagctggtgagtcgtgggggagcgtcggtccagtccgtgggacgtccctgacgtactgtcctgtcgcgagtcgtcgtggacactntcttacaattacctagtcgactacgtcgcctacggttcgggcccgccgacgggtccctaccggaggaccggacggggcgtagggtagggtggggtcggcgttaaggtttcgttttacggttggaacgttacgggaaacttagtagtaattacgtagtacgtacgtaacgtacgggtaccgtaggaaccggggtactacgttaccgaaccgtctaccgtaccgaacggtacaacgttaacgtacgtaacgggttaatttaagttttacgttacttacgttacgtaacgtacgtagtacgtagtccgaggtaacgtacggtaccgaacgggtacgtaccggtattagtagttacgtaacggtcggttaacggtacgttaaggtaacggtaaacgcggtaagggtacggttaacggtttgggtaacgggtacggtaggggtaccgg

SEQ ID NO: 6363 - DNA, 813 bp, Homo sapiens
  misc_feature: GYAE6OF02FGEQ5.24.76.G10.1.454.CMB.1.raw
  modified_base (152)..(152): a, c, t, g, unknown or other
  misc_feature (152)..(152): n is a, c, g, or t
  modified_base (209)..(209): a, c, t, g, unknown or other
  misc_feature (209)..(209): n is a, c, g, or t
  modified_base (358)..(358): a, c, t, g, unknown or other
  misc_feature (358)..(358): n is a, c, g, or t
tcagactactatgtcacgaccggtgctcgatttagtcactcatacagggggggagaggagcccagcactagaagtcggcggtgtttccattcggtgatcagcactgaacacagagactcaccatggagtttgcctagaactgggtttttccncgttgcttacttttaaggaggttcgtccaggttgtcagggtgcagtcgtgggtaggnggtcgtggggggaggcgtggtccaggtccgtggggtacgtccctggacgtacgtcgtccgtagtcgcgacggtccgtcgtggaacctctacttcttacctaaactaccgttagcggacctatcgtacccttacggtcccggggttaccnccgtacggaccctcggaacggccggaaagggggtcgtacgggtgggtagggggttcgctttacggtttaagtttgggtagtacgtacggtaataagtacgtaacttaagtcgtggtaaccgaggtccgttaagggtaccggaacgttcccgtaaacttacccgtaacgtacctacgtaccgtaacggtaaccgtaaccgttaacggttaaccgtaaggttaacgttttacgtttaacggttaccgtttacttaacgttaacgggacgttaaaccgtaaacgtcccggtaacggttaacggtacggtaaccggtaccgggtaaacgaaccggtacggtaccttaagtttaacggttacttacggttacgtacggtaacggtacggtaacggtaacggtacgggaacgggttaacggtacggtaacgggtttacgggttacggtaccggggttaacg

SEQ ID NO: 6364 - DNA, 741 bp, Homo sapiens
  misc_feature: GYAE6OF02F1U71.24.76.G10.1.454.CMB.1.raw
  modified_base (151)..(151): a, c, t, g, unknown or other
  misc_feature (151)..(151): n is a, c, g, or t
  modified_base (262)..(262): a, c, t, g, unknown or other
  misc_feature (262)..(262): n is a, c, g, or t
tcagactactatgtcacgaccggtgctcgatttagtcactcatacgagggggggagaggagccagcactagaagtcggcggtgtttccattcggtgatcagcactgaacacagaggactcaccatggagtttggcctgactgggttttccncgttgctcttttaagaggtgtccagtgtcaggtgcagctggtggagtcgtgggggagcgtggtccaggcctggggacgtcctgatctgtcctgtgcagcgtctggacacgnttgtacaattacctatcggacatggaccacggttcgggtacccaccgtagggccctaccggaagggccgaaacggggtctagggacgggttggggtacgtcgtaaggtttttagttcgggtttagaacttaggggtaaacctaagtaggtaaaactacgtagtcgggtaactaaggtacggttacccggtaggaaccggggtacccttaaagtccgaaaccggtactcccgtacctaaagggtaactacccgtaacgttaccgaaggttaagttaaggtttttccaagtttaccttacggaaagttacgtaaccggaaacgtcgggtacctaaaggaccgtaggttaccgggaacgttaaccgaccggtaattaccgggttattaggttacttcgggtaagaccggttacggtaaagtaaccggtaggtagggtaaacccggttggttaaccgggtaccgttaagggggtcgtaaccgg

SEQ ID NO: 6365 - DNA, 727 bp, Homo sapiens
  misc_feature: GYAE6OF02IR0F1.24.76.G10.1.454.CMB.1.raw
tcagactactatgtcacgaccggtgctcgatttagtcactcatacgagggggggagaggagcccagcactagaagtcggcggtgtttccattcggtgatcagcactgaacacagaggactcaccatggagtttggcctgaactgggttttcctgttgcttcttttaagaggtgtccagtgtcaggtgcagctggtggagtcgtgggggaggcgtggtccagccgtgggagtccctgagactgtcctgtgcaggcgtctggactactatccgttacaaacttacctagtacggactataccgcctacggttccggggtaccccgcccgacgggtcctaccggacgggaccggaacggggtcgaggggtagggttcgggggtacggtacgttaaggttttagttttagggtttacagttagggtaaacttaaagttaggtaaaatttaacgttagcggtacctaaggtaccgttaccggtagggaacgggttcccgtaacgtttaccgaaccctagttcccgtaaccgacggtaagtaacttaacgttaccgaaggtaacgttaagttttacgtaacgtttcttaactagtaactacgtaacgtagtaccgttaggacgtacgtaacggacggtaccgtaacgtacgttagttacgttacttacgtaggtcgtagaagttaacggaaagcgtaagggtaggtgtttacgggtagggtagggtggtacgg

SEQ ID NO: 6366 - DNA, 727 bp, Homo sapiens
  misc_feature: GYAE6OF02FOXWW.24.76.G10.1.454.CMB.1.raw
  modified_base (156)..(156): a, c, t, g, unknown or other
  misc_feature (156)..(156): n is a, c, g, or t
  modified_base (179)..(179): a, c, t, g, unknown or other
  misc_feature (179)..(179): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
tcagactactatgtcacgaccggtgctcgatttagtcactcatacagggggggggagaggagcccagcactagaagtcggcggtgtttccattcggtgatcagcactggaacacagaggactcaccatggagtttggcctgaacttgggttttccncgttgccttacttttaagaggtntccagttgtcaggtgcgagtcgtggtgagtcgtgggggagcgtggtccagtccgtgggacgtccctagacgtactcgtccgtgtgctagcgtctcggacanctcttacgaatcctagtcggactagtnctacgtcggtccncgagcctcggagcgacggctggaggtggngactagtttgttggtnagtacgtactagtacgtactacgtgtcgtacgagtaccggtacgaggtaaccgggcttactcccgtaaatcttccgacgtaagggtcctaaaccgtacggttacccgtaagggttatttaaccttttaggccgttttacgtaaccgaaggttactaaaccgggttaagaccgggtaccttaggtaaccggggtaagtaccccgggaaagacccccgggtattaacggttttacgtaacgggtttaaccgttcggtaaccgggtttggaaccggtttaaaccgtaaagggtaacccgggttaaccggaggggtttaaccgtacggggtttacccggggttagtacggggttggttaaacccgg

SEQ ID NO: 6367 - DNA, 711 bp, Homo sapiens
  misc_feature: GYAE6OF02IPJRS.24.76.G10.1.454.CMB.1.raw
  modified_base (292)..(292): a, c, t, g, unknown or other
  misc_feature (292)..(292): n is a, c, g, or t
tcagactactatgtcacgaccggtgctcgatttagtcactcatacgagggggggggagaggagcccagcactagaagtcggcggtgtttccattcggtgatcagcactgaacacagaggactcaccatggagtttggcctgaactgggttttcctcgtgctctttaagaggtgtccagtgtcaggtgcagctggtggagtcgtaggggaggcgtggtccagccgtgggagtccctgagactgtcctgtcgcagcgtctaggacacgtatccttacaaacgtacctagtcggntaacgtggacaacgttccgggggtcccacccgtaggggtacctaccgaagggtaccgaaaggggggtccttagggggaggttcggggtgggtaaccttaggttttaagttttgggttagacgttaggtaaacttagtagtaaactactagtgacaagtaccgtacggtagggaacgggtaccgtacttaccaaccgtactccgttaaccaaggtacgaaccgtaacgttaccgaagggtaacttaagttttaggtaactttaccgttagtaacgtaagtacggtaaacgtacgtaccgtagtaacggtacgtacggaagtccggtaacggtacctagttacgtatttaccgtggtacgtacgtagttaacgaacgtacgtagggttaactgtaacggtttcggtacgtaagggtacggg

SEQ ID NO: 6368 - DNA, 825 bp, Homo sapiens
  misc_feature: GYAE6OF02JQ93M.24.76.G10.1.454.CMB.1.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttcctcgttgtcttacttttaaggaggtgtcctagtgtcgaggtgcagtcgtggtggagttcggtagggggngtcggtcggtccacggtcgtacggggtacgtcccgngacgtcgtgtccgtagcgtcgacgtccggtcgtacggactacgtacttccgtactaaaccttaccgttagtcggtactagttaccggacgtaccggtccggggtcccgtaccggacggttccccgtaccggaagggaccgggaacggggttccggaaggggttcgggtggggtcgggtacgtttaagggttttacggttttgggttaacggacggttaacggttaaacgtaacggttagtaactttacgtagttacgaacggtaggttaccggttacggaacgggtaccggaccgttaacgtcccgattaccgtacgtacccggaaagtaccgtaactaaggtacccgaaggttacgtttaacgttacgttagttaccgtaccgttaagtaccgtaccgaacgtagtaccgtacgggtacgggacgtttaaccggggacgtacccggtaacggtttacgtaacggtttcgttaacgttcgtaggttaaccgaaggtttacgaaaccggtttaggacgggttaacggttcggtttaggaacccgggtttggggttaggccggtttaaccg

SEQ ID NO: 6369 - DNA, 771 bp, Homo sapiens
  misc_feature: GYAE6OF02F6B15.24.76.G10.1.454.CMB.1.raw
  modified_base (497)..(497): a, c, t, g, unknown or other
  misc_feature (497)..(497): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgaacttgggttttccctcgttgcttctttaagaggtcgtccagtgtctaggtgcagcgtgggttggtaggtcggttaggggggagggtccggtcgggttacccgacggcccgttcgggggtacggtcccgtcggtaacggtacgtcgtcccttggtcgacgacggccgtacgtggaaccactactcctttaccgtaaacgttaacccttaggtcggcctagtcgtccggtaacgttccgggtcccgtaccgtacgggccgtaaccggacgggacggaaggggccggtagggtagggtggggtcggagttagtttacggttttggtatggtaaggtaactaagttacgtaagttagtactnacggtagttaccggacggtaggaaccggggtactacttccgacctatcgtaaccgtacgactaacgtaacttacgtaaggtaagttagtttactacgttacgttaccgataacgtacgtacgtacgacggtcgtaacggacggtacggtacgtaacgtaacggttacgttacgttagtttattacggtttagggtacggtacggttaagtacggtaacggtaacggtaagggttacggtaaggttacgggtttacgggtaggttacgggtacgg

SEQ ID NO: 6370 - DNA, 720 bp, Homo sapiens
  misc_feature: GYAE6OF02GHJ2M.24.76.G10.1.454.CMB.1.raw
tcagactactatgtcacgaccggtgctcgatttagtcactcatacagggggggagaggagcccagcactagaagtcggcggtgtttccattcggtgatcagcactgaacacagaggactcaccatggagtttggcctgaactgggttttcctcgttgcttcttttaagaggtgtccagtgtcaggtgcagctgggtggagtcgtgggggaggcgtggtccagccgtggggaggtccctgagactgtcctgtgcagcgtctggacacatcttcaatacctatggcatgcacgttcgggccgccaggcctccgaggcgaaggggtctgggaggtgggtggctagtttagtttggttacgagttagggtaaacttaagtagaaattactagtcgacgtaaggtacgttacccgggtaggaaccggggtcccgtaacgtttccaacccgtaattcccgtacccgaaggtaacgtaaacctaaacgttacccggaaagggtaagttaaagtttttcgtaacgtttaccgtttacgaagtaacgttacgaaaccgtaggtacccgttaggtaacggtaacggttacgggaaacgggtaaccgtaaccgggtacttaagtttacgtttaacgtttacgttacggttggtaaccggttaagttaaggaaaacggtcggtaaaggggacggttaaggttcggggttacggtaggggttaggggtaacgg

SEQ ID NO: 6371 - DNA, 786 bp, Homo sapiens
  misc_feature: GYAE6OF02GK2LG.24.76.G10.1.454.CMB.1.raw
tcagactactatgtcacgaccggtgctcgatttagtcactcatacaggggggggagaggagcccagcactagaagtcggcggtgtttccattcggtgatcagcactgaacacagaggactcaccatggaggttttggcctgaacttgggtttttcctcgttgcttacgttttaagaggttcgtcctagtggttcaggtgcgagctgggtggtagttccggtgggggggaacggtcggttcgggtcccacggtccgttggggggtaaccgttcccgttgggaacgtacgttcggttacctggtacggcacggcgttcgtacggactaactacttacttactaaacgttaccttaacgtcggtacgtacgtacgtaccgtacgttaccgggcccggtacccgacggtccgtacccgaacggacgggagggggtaccgtaggggtacggtaggggtcggtcgtaaggtttagtttttcgggttagtaggttaggtaaacgttaaagtagtaactttaagttagtacgtagtaacgtacggtaccgggtagggaaccgggtccgacttacgaccacttaccgtactagaacgtaacgtaacgtacgtaacggtaagttaacgttttagtacgttacttacgaagtactaacgaacgacgtacgtacggtaagtacgaggtagaaccggacgtacgtacgttaagttaccggttatacggttgtaaccggttaggtaagtaacggacggtaacggtaggtaacgggttagtaccgggtagtacgggtacgg

SEQ ID NO: 6372 - DNA, 764 bp, Homo sapiens
  misc_feature: GYAE6OF02IJSK1.24.76.G10.1.454.CMB.1.raw
  modified_base (149)..(149): a, c, t, g, unknown or other
  misc_feature (149)..(149): n is a, c, g, or t
  modified_base (169)..(169): a, c, t, g, unknown or other
  misc_feature (169)..(169): n is a, c, g, or t
  modified_base (247)..(247): a, c, t, g, unknown or other
  misc_feature (247)..(247): n is a, c, g, or t
tcagactactatgtcacgaccggtgctcgatttagtcactcatacagggggggggagaggagcccagcactagaagtcggcggtgtttccattcggtgatcagcactgaacacagaggactcacatgagtttgctgactgggttttccncgttgctcttttaagaggtntccagtgtcaggtgcagctgggtgagtcgtgggggagcgtggtccaggcctggggaggtccctgagacttgtccttgngcaggcgtgtggacacattcttacaactacctagtcggcatgaccacggttgggtcccgaccgaggcctccgaagggcgaaagggggctagggacggtgggggcgtacgtagtttagttttgggttgatagggtaaactaagtgtaaactactagtcgactaagggtacgttccggtaggaaacggggtcccttaagttaccaaccgtactaccttaccgaaggaacgtaaactaagttacccgtaaggtaacggttaaatttttacggttaatttaccgtttactaacgttagtaacgtaaacgtaacggtacccgttaggaacggttaacggtaaccgggtaaaccgggtaaaccggtaacccgggttaacgtttaacgttaacggtttacggttttaaccggtcgggttaacggaccggttaaagtttaaacccgggaaaaggtacgggtaagggtaacggggttaaggtttaccgggggtttaacggggttacgggggtagggttaaccgggg

SEQ ID NO: 6373 - DNA, 758 bp, Homo sapiens
  misc_feature: GYAE6OF02JG2E6.24.76.G10.1.454.CMB.1.raw
  modified_base (353)..(353): a, c, t, g, unknown or other
  misc_feature (353)..(353): n is a, c, g, or t
  modified_base (509)..(509): a, c, t, g, unknown or other
  misc_feature (509)..(509): n is a, c, g, or t
  modified_base (581)..(581): a, c, t, g, unknown or other
  misc_feature (581)..(581): n is a, c, g, or t
tcagactactatgtcacgaccggtgctcgatttagtcactcatacagggggggagaggagcccagcactagaagtcggcggtgttccattcggtgatcagcactgaacacagaggacctcaccgatcggagtttcggcctgaacgtgggttttcctcggttgcttacttttagacggtctcctaggtgtcaggtcgctagcgtaggtcggagtccgtagggggacgtcggttcgtccgagccgtagggaccgtcccgtagtacgacttcggtctaggtcgctacggcgtcgtaggacactctcgttacaataccctagcgctatacgcacgttcggggtcccaccgcgttccncgacggtaggaacggggtcctagggtacggtcggggtacgtacggttaacgttttaggttttcggttacggagtacggtaaccgttaagtagtaacgttactagtacacggtagtaccggttacggtacgggaaggtcctaagttcccaacccgtntaccgtacccgtaagtacgtaacgtaaacctaccggtaagtacgtttaactttggtaaccgttaccggttanacgtaaccgtacgtaaacgtccggtacctaccggtaggttaacgtaccgggaacgttaccggtaaccggtaaccgtagttaacgttaccgttacggtaccggttaggtacggtaacgtcggtaaacgtacggtaaggtacgggtaacggttacggtaggtacggtaagggtacccgg

SEQ ID NO: 6374 - DNA, 824 bp, Homo sapiens
  misc_feature: GYAE6OF02FQBQT.24.76.G10.1.454.CMB.1.raw
  modified_base (372)..(372): a, c, t, g, unknown or other
  misc_feature (372)..(372): n is a, c, g, or t
  modified_base (714)..(714): a, c, t, g, unknown or other
  misc_feature (714)..(714): n is a, c, g, or t
  modified_base (744)..(744): a, c, t, g, unknown or other
  misc_feature (744)..(744): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttcggcctgaacgttgggtttttcctcggttagtccttacgtttttaagacgggttgtacccaggttcgtccgtaggtgaccgaggtcgttgggtggacgtcggtggggggagcggttcgggtccacggtccggtggggtacggtcccttgggaactaccggttcgtcccggttggcgaccggtacgtcggttaccgtccgggaacacctacttccgttacctaaacgttaacctttacggnggactacgttacggtcctaacgggtcccgggttcccgaccgtaacgggtccccgttccggaaacggaccgggtaagggggttaccgtggggttaacgggggtttcggggacggtaaccggttaacgtttttgggttaccgggtttaaggacggttaacgtaaaacgttattagggaaaactttcccggtaattacgaaccggaggtaaaccggttccgggtaagggtaaccgggacgttaactaccgaactaaccgttccgtacgaagtaacgtaactaaacgttccgaaggggtactttaaaggtttaccgtacgttttactacgtaatacgtagtaaccnggtaccgtagacgtagacgagactaacggnttagacgttagtcggtagtacgtcggaaactgtaaacggtacgaaggtcgttaacgggtaggttcggacgggttacgagg

SEQ ID NO: 6375 - DNA, 791 bp, Homo sapiens
  misc_feature: GYAE6OF02JKA0S.24.76.G10.1.454.CMB.1.raw
  modified_base (150)..(150): a, c, t, g, unknown or other
  misc_feature (150)..(150): n is a, c, g, or t
  modified_base (166)..(166): a, c, t, g, unknown or other
  misc_feature (166)..(166): n is a, c, g, or t
  modified_base (196)..(196): a, c, t, g, unknown or other
  misc_feature (196)..(196): n is a, c, g, or t
  modified_base (745)..(745): a, c, t, g, unknown or other
  misc_feature (745)..(745): n is a, c, g, or t
tcagactactatgtcacgaccggtgctcgatttagtcactcatacagggggggagaggagcccagcactagaagtcggcggtgtttccattcggtgatcagcactgaacacagaggactcaccatggagtttggcctgactggttttccngttgcttcttttaagnggtgtcctagtgttcaggtgcagcgtaggnggagtcgtgggggagtcggtaggtccaggccgtgggaccgttccctggacgtacgtcgtccgtgtacggcagcgttcgtaggacctactacgtcctttaacaacgttacctagtcggactacgtcgtcctaacggttccggggttacccacccggaggtccctaaccggaggggtaccggtaaacgggggtccttaggggacgggttttgggggtccggtacgttaaacgggtttttaaggttttcggggttttacaacgggttaaacggttaaacccgtttaaaggttaaccggttaaaattttaccggtaaagttccgggtaaaccgtaaccggggttacggttaaccccgggttagggaacccggggtttacctacgttacccgtaccgtaacgttaccgtacccgtaacggtaacgtaacgttaacgttaaccgtaacggttaacgttaacgtttacgttattaccgttagtaacagtacgtaacgtacgtacgtacgtacgtaggtacgacgacgtacgtacgtagtagtacttagtacggtanacgtagtacgaaggacgaggtagtagtaggttcggaggtggtacgg

SEQ ID NO: 6376 - DNA, 200 bp, Homo sapiens
  misc_feature: GYAE6OF01BU6JB.11.40.D07.1.454.CMB.1.raw
  modified_base (192)..(200): a, c, t, g, unknown or other
  misc_feature (192)..(200): n is a, c, g, or t
tcagcgagagataccacgaccggtgctcgatttagtgatagagcgtaacaacagagggtgtccttgggtttgggggaagaggaagactgaccggtcccccaggagttcaggtgctgggcacagcggccctgggctgcctggtcaaggactacttccgtatctctcgctgagcgggctggcaaggcgcatagnnnnnnnnn

SEQ ID NO: 6377 - DNA, 553 bp, Homo sapiens
  misc_feature: GYAE6OF01EXKXD.11.40.D07.1.454.CMB.1.raw
  modified_base (484)..(484): a, c, t, g, unknown or other
  misc_feature (484)..(484): n is a, c, g, or t
tcagcgagagataccacgaccggtgctcgatttagtgatagagcgtaacaacagaggggaggtctgggagaggagcccagcactagaagtcggcggtgtttccaatcggtgatcagcactgaacacagaggactcaccatggagtttgggctgaccttgggttttcctcgttgctcttttaagaggtgtccagtgtcaggtgcagctggtggagtcgtgggggaggcgtggtccagcctgggaggtccctgagactctcctgtgcagcctctggattcatcttcaattacctttggcatgctacgtcgggtcccgccaggcctccgaggcgaagggctgggagtggctatctatttatgtctatttgataggaaactatatatacttattcgtgggtaccgttaagggtctattcactatctacagacgactaacttccgaaggaacacgtctgtactctagactaacttacactacgacccanaactcgacgacacggtcttagtttatacgtgtacgcccaacgtagtaactataccgtgtaagtttacgg

SEQ ID NO: 6378 - DNA, 883 bp, Homo sapiens
  misc_feature: GYAE6OF01DCAQ7.11.40.D07.1.454.CMB.1.raw
  modified_base (222)..(222): a, c, t, g, unknown or other
  misc_feature (222)..(222): n is a, c, g, or t
tcagcgagagataccacgaccggtgctcgatttagtgatagagcgtaacaacaggaggggaggtctgggagaggagcccagcactagaagtcggcggtgtttccaatcggtgatcagcactgaacacagaggactcaccagtggtagtttgggctgtaccgttggttttcctcgttgtcttacttttaagaggtgtccgagtgtcgaggtgcgagcgtgggnggtaggtcgggtggggggacggtcggttcggtcccgaaggtcccggttggggaccggtccccttaggacgtacccttccttccgttggtcgccgacgtccgtcgttaggtactttcgtacttcctttactaacgttaccgtttggactagttcgaccgttaccggtccgggtacccgcccgtacggtaccgtaccgagggaacccggaaaggggtaccgtagggtacggttcggtaccttaacgttacgtttaagttttagcgtttactttagtttacggaagttaacggtaaaactttaaatttaacttaattaaacgtttagttaccggggtacggggttaaccggttttaaagggtccgttaactttaacccgtaacccgttaacgttacccgttaaccgaaagtaaccgtaaacccgttaaacgttaaccggaaaacccggtaaaacctcccgggtttattaaccgggttaactttcccggtaacttaacccgtaaaacttacccgaaaccgtaacccgggtaaccccaaacgtaaaccgtaccggtaaccggaaaccgttaccggttaaccgtttttaggtttaaaccgttaccgtacgttcgaaacccgttaacgagttaaacgtacggtaaaccgtaacgttaggtttaacggg

SEQ ID NO: 6379 - DNA, 655 bp, Homo sapiens
  misc_feature: GYAE6OF01CH7GV.11.40.D07.1.454.CMB.1.raw
  modified_base (244)..(244): a, c, t, g, unknown or other
  misc_feature (244)..(244): n is a, c, g, or t
  modified_base (288)..(288): a, c, t, g, unknown or other
  misc_feature (288)..(288): n is a, c, g, or t
tcagcgagagataccacgaccggtgctcgatttagtgatagagcgtaacacagagggctcaccatggagtttgggctgacctgggttttcctcgttgctcttttaagaggtgtccagtgtcaggtgcagctgggtggagtcgtgggggaggcgtggtccagccgtgggacggtccctgagactctcctgtgcagcctctggattcatcttacaattacctttggctatgctacgtcgggtcccnccgaggcctccgaggcgaaggggactggagtgctatctatttangtactatttgataggaacttaatattatacttagttcggtaggggtaccgtttaaggggtctacgtttccaacgtactcctaccgagacgaactaacgtccgaaggaacacgtcttagtatcgtagactaaacttacaacgtacgacccgaacaacgtacgaacgtaccgacggtctttagtttacttacgtggtacacacgtaatactaacgtacgacttaagttacgacggtaggggtaccgaactaacgtacgtacgtactaataccgttattaccgacccgtacggtccgggtaccgtaacgggtaccggttggacccttacggtcccgttccttaccacctccgaccctcccggaaacccgg

SEQ ID NO: 6380 - DNA, 853 bp, Homo sapiens
  misc_feature: GYAE6OF01DJKP6.11.40.D07.1.454.CMB.1.raw
  modified_base (283)..(283): a, c, t, g, unknown or other
  misc_feature (283)..(283): n is a, c, g, or t
  modified_base (333)..(333): a, c, t, g, unknown or other
  misc_feature (333)..(333): n is a, c, g, or t
tcagcgagagataccacgaccggtgctcgatttagtgatagagcgtaacaacaggaggggaggtctgggagaggagcccagcactagaagtcggcggtgtttccaatcggtgatcagcactgaacacagaggactcaccatggagtttgggctgaccgttgggttttcctcgttgcttcttttaaggaggttcgtccagtgtcaggtgcagctgggtggagtcgtgggggagcggtggtccagtccgtgggacggtcctgacgactcctcgtgtgccagcctntggattcatcgttcaacttccgttggctagtcgactacgtcgggtacccncgacggcctacccgaagggcccgaaaggggtcctggggaagtcggtactaagtctaagttttacgcgttacctaattttcggaatagggttaaaacctaaattaataacgtttacgttaacgtttcgggttacgggggaaccggtttttaaaggggcttaaccgtttaccctaacccgtaaacgttcgttaacccgaaaggtaacccggtaaaaccttaaacctttaccccgggaaaaggtaaaaccccgttacccgtacgggttaacgtttaacttacccgtcggttaaaaccctaaacgttttaaaccccaaaccccggtaacccgggaaccccccgtaacgtaaaaaccggtttcccggaaaaacccggcccgttaaccggggttaacccgttttgggttttttaaaccttaaaccggttaccgggttacccggaaacccctaaacccgggttaaagggttaaccctttaaagggttaaccccggtaaaagggtttttaaaccggtttaaccggggg

SEQ ID NO: 6381 - DNA, 560 bp, Homo sapiens
  misc_feature: GYAE6OF01A6K90.11.40.D07.1.454.CMB.1.raw
  modified_base (184)..(184): a, c, t, g, unknown or other
  misc_feature (184)..(184): n is a, c, g, or t
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
tcagcgagagataccacgaccggtgctcgatttagtgatagagcgtaacaacagaggggaggtctgggagaggagcccagcactagaagtcggcggtgtttccaatcggtgatcagcactgaacacagaggactcaccatggagtttgggctgacctgggttttcctcgttgcttcttttaagnggtgtccagtgtcaggtgcagctggtggagtcgtgggggaggcgtggtccagccgtgggaggtccctgacgactctcctgtgcagcctctggattcatcttcaattccttgcatgcacgtcgggtccgccaggcctaccgaggccgaaggggctgggagtggctatctatttangtctatttgatgaactatatatactnttcgtggggtcgttaagggtctattccactatcctacagacgactaacgtccaaggaacctcgctagtatccgagtacaattaccacacgacccgacacgtcgaccgactaccggtatttcggtttaattacgtgtacgacccaagaagtactaagtaccgagttaattaacgggg

SEQ ID NO: 6382 - DNA, 680 bp, Homo sapiens
  misc_feature: GYAE6OF01DIEH1.11.40.D07.1.454.CMB.1.raw
  modified_base (258)..(258): a, c, t, g, unknown or other
  misc_feature (258)..(258): n is a, c, g, or t
tcagcgagagataccacgaccggtgctcgatttagtgatagagcgtaacaacagaggggaggtctgggagaggagcccaagcactagaagtcggcggtgtttccaatcggtgatcagcactgaacacagaggactcaccatggagtttgggctgacctggttttctcgttgctcttttaagaggtgtccagtgtcaggtgcagctggtggagttcgtgggggagccgtggtccagcctgggagtccctgagctctcgngtgcagcctctggattcatcttcaattccgttgcctatcgacacgttcggtccgcctaggacctccgaggccgaaggggtcctgggagtagctatactatttagtcgttactagtttacacgttaggaacttaaagtattaatacgttattacggtcggggtaccgttaaggggtaccttagtacccgtacctacgttaccgttacccgaaggtaacgaacgtaaacgttaccgaacgggaaccttacgctttacgtaagttccaggtaacctaaccttacccgacgaaccggttaccccgacgtaaaccgtcggaaaccgacggttacccggtacgtttagttttaaccgttaccgttcggtacgtaccccgtaaactccggttaaagtaccttaaaccggtgttaaacggtttaaccggg

SEQ ID NO: 6383 - DNA, 740 bp, Homo sapiens
  misc_feature: GYAE6OF01CMOY0.11.40.D07.1.454.CMB.1.raw
tcagcgagagataccacgaccggtgctcgatttagtgatagagcgtaacaacagaggggaggtctgggagaggagcccagcactagaagtcggcggtgtttccaatcggtgatcagcactgaacacagaggactcaccatgggagtttgggctgaccttgggttttcctcgttgcttcgtttttaaggaggttgtccaggttgtcgagggtgcaggcgttgggtgggaggttcggtggggggaggcggttggtccaggcccgtggggacggtccctgacggactcttccgtgtcgacacgtccctcgtaggtactttctacgtttcttacctaaactttaccccgtttggactacgtcggtacccgtaccggttcggggtccccgaccgacgggtcctacccgggagggaccggtaaaaggggtcgtcggggtagtcggacttagtacttaatttacgtgtacttagtttcggagttaaggaaacttaattaattaacttacgttagtttcgggtacggggtaccggtttaagggtctacgtttaccgaaccttacgtaccgttaacgagtaacgtaaacctaacgttacccgaaggtaaccacgtacgttacgtcgttactacgtaaccttaaacgttaccaaccggtacccaccggtaacctaacgtccgaacgaccgtacgttacttagtttatacgtcgtacgactaacgataatacgtaacgtgtaagttacggg

SEQ ID NO: 6384 - DNA, 602 bp, Homo sapiens
  misc_feature: GYAE6OF01ARAV1.11.40.D07.1.454.CMB.1.raw
  modified_base (281)..(281): a, c, t, g, unknown or other
  misc_feature (281)..(281): n is a, c, g, or t
  modified_base (427)..(427): a, c, t, g, unknown or other
  misc_feature (427)..(427): n is a, c, g, or t
tcagcgagagataccacgaccggtgctcgatttagtgatagagcgtaacacagagggctcaccatggagtttgggctgacctgggttttcctcgttgctcttttaagaggtgtccagtgtcaggtgcagctggtggagtcgtgggggagcgtggtccagcctgggaggtccctgagactctcctgtgcagcctctggattcatcttcaattaccgtttggctatgcacgtgggtccgccgaggcctaccgaggcaaagggctggagtggctatctatttangtctatttgataggaactaatatatactattcgtggggtaccttaagggtcattccgacctatctccgagagaacctaattacccgaagtaaccacgtctgtactgtacactaaataccacacgacccgacaacgtcgaccgaacncggtcttagtttactacgtgcgaccagtagtacttacgacgtactaagtttcgacggaaggggtcgacgaacgtacacgtactattacctatttcgaccgtacggtcgggacccgaacgggtaccctggtcctaagttccctctaccctacgaccgtcccgtaccgaaacccggg

SEQ ID NO: 6385 - DNA, 868 bp, Homo sapiens
  misc_feature: GYAE6OF01BG0ZP.11.40.D07.1.454.CMB.1.raw
  modified_base (185)..(185): a, c, t, g, unknown or other
  misc_feature (185)..(185): n is a, c, g, or t
tcagcgagagataccacgaccggtgctcgatttagtgatagagcgtaacaacagaggggaggtctgggagaggagcccagcactagaagtcggcggtgtttccaatcggtgatcagcactgaacacagaggactcaccatggagtttgggctgaccttgggttttcctcgttgcttcttttaagnggtgtccagtgtcaggtgcagcgtgggtggagtcggtggggggaggtcgtcggtccaggccgtggggtacggtcccctggacgtacctccgtccgttggtcgccagtcccgttcgttacgggtaactttccgaatttccttaccgtaaacgtttacccgttttgggactaagtcggacctaccggttacgggggtccccgaccgaacgggtccctccggaacgggtaccgtaaagggggtccgtaggggtacggtcgggtacttaacgtacgttaagttttacgtggttaccttagttttacggaagttaacggggtaaaacctttaaagttaatttaacgtttaaacccgtttaaggtttaccggggttacggggggtttaaccccggttttaaaacgggggttccgttaaaccgttttaccccgaaacccgttaaccgttacccgttacccgtaaacggtaaccggtaaaacccgttaacccgtttaacccggaaacggtaaacccgaccggtacgtttagttaaccctacgttacgtaacctaaacgttaacccgaacgtaacccgaccccgtaataaccgtaccggaaccgtaaccgtaccggttacgtttacgtttaacttacggtcgtaccgtacccaacgtacgtaacttacgtaacggtacgttaagtaccgggg

SEQ ID NO: 6386 - DNA, 550 bp, Homo sapiens
  misc_feature: GYAE6OF02GX3DO.11.40.D07.1.454.CMB.1.raw
  modified_base (346)..(346): a, c, t, g, unknown or other
  misc_feature (346)..(346): n is a, c, g, or t
  modified_base (411)..(411): a, c, t, g, unknown or other
  misc_feature (411)..(411): n is a, c, g, or t
  modified_base (464)..(464): a, c, t, g, unknown or other
  misc_feature (464)..(464): n is a, c, g, or t
tcagcgagagataccacgaccggtgctcgatttagtgatagagcgtaacaacagaggggaggtctgggagaggagcccagcactagaagtcggcggtgtttccaatcggtgatcagcactgaacacagaggactcaccatggagtttgggctgacctgggttttcctcgttgctcttttaagaggtgtccagtgtcaggtgcagctggtggagtcgtgggggagcgtggtccagccttgggagtccctgagactctcctgtgcagcctctggattcatctcaataccttggcatgcactgggtccgccaggcctccgaggcaagggctggagtggctatcatttangtctatttgatggaactaatatatactattcgtgggtccgttaagggtcattcaccatctcaganactaatccgaagaccacgctagtactctagactaattaccactacgccccaanaaaccgtgaaccgacgtacggtctttaggtttaacttacgtcgtcgtaccaacgtagtacgttaataccggtacgtaatttacggg

SEQ ID NO: 6387 - DNA, 574 bp, Homo sapiens
  misc_feature: GYAE6OF02G9T9G.11.40.D07.1.454.CMB.1.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
  modified_base (501)..(501): a, c, t, g, unknown or other
  misc_feature (501)..(501): n is a, c, g, or t
tcagcgagagataccacgaccggtgctcgatttagtgatagagcgtaacaacagaggggaggtctgggagaggagcccagcactagaagtcggcggtgtttccaatcggtgatcagcactgaacacagaggactcaccatggagtttgggctgacctgggttttcctcgttgctcttttaagaggtgtccagtgtcaggtgcagctggtggagtcgtgggggaggcgtggtccagccnggggttttagccctgagactctcctgtgcagcctctggattcatcttacaattacctttggctatgcacgtgggtccncaggctcgaggcaagggctggagtggctatctatttangtactatttgatagtaactaatatatactattcgtaggggtaccgttagggtctattccgaactatcctaccgagacgtaaccaaatttccgaaggtaaccacgtctagtactctagactaattaccactacgacccgaataaccgngaccgtacgacgtacttaggtttaactcgtagtcgacctaagtacgtaagttactaacggacgttaattacgg

SEQ ID NO: 6388 - DNA, 640 bp, Homo sapiens
  misc_feature: GYAE6OF02FZDXL.11.40.D07.1.454.CMB.1.raw
  modified_base (237)..(237): a, c, t, g, unknown or other
  misc_feature (237)..(237): n is a, c, g, or t
tcagcgagagataccacgaccggtgctcgatttagtgatagagcgtaacacagagggctcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaattacctttggctatgctacgtgggtccnccaggcctccgaggcaagggactggagtggctatctatttatgttcattttgataggtaactaatatatactattcgtggggtccgttaagggtctattaccacctatcctaccgagacgaactaattcccgaaggaaccacgcttagtactctgactaaatttaccaactacgacccgaacaacgtcgaacgacgacggtcttagtttatacgtgtcgacctaagacgtataactacgtacgtaactttaggcgtaacggggtcggactagtaccgtagtacagttaacgtactttacgacccgaacggtccggggaaccgaaccgggtaccccgtcggttaccgtacgttcccggttacccttcccgtaccggtaccgtaccccttacccgaaaccccggg

SEQ ID NO: 6389 - DNA, 713 bp, Homo sapiens
  misc_feature: GYAE6OF02FP2PZ.11.40.D07.1.454.CMB.1.raw
  modified_base (240)..(240): a, c, t, g, unknown or other
  misc_feature (240)..(240): n is a, c, g, or t
tcagcgagagataccacgaccggtgctcgatttagtgatagagcgtaacacagagggctcaccatggagtttgggctgacctgggttttcctcgttgctcttttaagaggtgtccagtgtcaggtgcagctgggtggagtcgtgggggaggcgtggtccagccgtgggaggtccctgagactctcctgtgcagcctctggattcattcttcaattacctttggcatgcacgtgggtcccnccgaggcctccgaggcgaagggctggagtggctatctattttatgtctatttgataggaactaatatatactagttcgtaggggtccgttaaggtcattccacctatcctcagacacaatccgaaggacacgctgtatctgactaatacacacgacccaacaacgtacgaaccgacgtaccggtcttagttttacttacgtggtacacctaacgaagtaacgttaacgtaaccgtacgtttaaacgtttacgggaccgggtaagggggttccggaacccgtaagggttaacccgacggtttacctaaacgttaaaccgttacgttttaccggaacccggttaaaccgggtccggggggtaacccgtaaaccggggttaaacccccgttggggtaacccttaccggtttaccccggttaccgttcccccgttacccgaacccggttccccccttaaccccggaaacccccgggg

SEQ ID NO: 6390 - DNA, 606 bp, Homo sapiens
  misc_feature: GYAE6OF02HFYM1.11.40.D07.1.454.CMB.1.raw
  modified_base (234)..(234): a, c, t, g, unknown or other
  misc_feature (234)..(234): n is a, c, g, or t
  modified_base (276)..(276): a, c, t, g, unknown or other
  misc_feature (276)..(276): n is a, c, g, or t
tcagcgagagataccacgaccggtgctcgatttagtgatagagcgtaacacagagggctcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaattacctttggcatgcactgggtccnccaggcctccgaggcaagggactggagtggctatctatttangtctatttgataggaactaatatatactattcgtgggtaccgttaagggtctattcacctatctacagagaacaattccgaaggaacacgctgtatctagactaattacacacgacccgacaacgtacgacgaaccgacggtcttaggtttaacttacgtgttacacctaacaacgtaataacgtaacgtacgtaaagttttacggacggtaggggtcgaccgtaagtacgatacgtataactatttacgacctaacggtcgggacccaacgggtacccctaggtacctacgttccgtccctaccgtaccacgtccctacccgtaaccgg

SEQ ID NO: 6391 - DNA, 651 bp, Homo sapiens
  misc_feature: GYAE6OF02GVHIQ.11.40.D07.1.454.CMB.1.raw
  modified_base (238)..(238): a, c, t, g, unknown or other
  misc_feature (238)..(238): n is a, c, g, or t
tcagcgagagataccacgaccggtgctcgatttagtgatagagcgtaacacagagggctcaccatggagtttgggctgacctgggttttcctcgttgctcttttaagaggtgtccagtgtcaggtgcagctggtggagtctgggggagcgtggtccagcctgggaggtccctgagactctcctgtgcagcctctggattcattcttacaattacctttggcatgcacgtggggtcccncgaggcctccgaggcaagggctggagtggctatctatttatgtctatttgagttaggaaacttaatatattacttagttcggtagggggtaccgtttaaagggtctaatttccaacctatccgtaccgaaggtaacaactaacgttacccgaaagggaaccacgtcttagtaactcctagactaaacttacccacgaacgaccccgaactaacctcggaaccgacacggtcttaggtttaacttacgtcgtacgacctagtagtactacgtacgacgttaaagttggacggtaggggtcgaccgtaagttaccagtcctaattacctagtttcgacctacggtacgggaaccgtaacgggtaccctggtacctacgttccgtcctccgtactccggtaccctaccgaacccgg

SEQ ID NO: 6392 - DNA, 818 bp, Homo sapiens
  misc_feature: GYAE6OF02JIBKV.11.40.D07.1.454.CMB.1.raw
  modified_base (195)..(195): a, c, t, g, unknown or other
  misc_feature (195)..(195): n is a, c, g, or t
tcagcgagagataccacgaccggtgctcgatttagtgatagagcgtaacacagagggctcaccatggagtttgggctgacctgggttttcctcgttgctcttttaagaggtgtccagtgtcaggtgcagctgggtggagtcgtgggggagcgtggtccagcctgggaggtccctgagactctcctgtgcagcctntggattcatcttcaattccttggcatgcacgtcgggtccgccaggcctccgaggcaagggctaggagtggctatctatttatgtactatttgattaggtaacttaatagtacttacgttagttccggtaggggtacctttaaggggtctacgtttaccaaccgttattcccgtaccgaaggtaacgtaaccgtaaacgtttacccgaagggtaaaccaccgttacgttacgttaactacccgttcgtaaacctaaacgtttacccgaaccgtaaccggaccccgtaaccgtaaacctaccggaaccggtaaccccgtacgggttaccttacgttttaacgttacgtacggtaccgtacccgaacttaaggtaacctttacgtaaccggtacgttaaacgttttacgggaccggttaaacgggggttccgaaacccgttaacgggttaaccgttaacgttaaccgtaaccgtttaaaccgttacgttttaaccgacccggttaaaccggggttccgggggaaaccccggttaacgggttaaaccccggttcggtaccgttaaccgtttccggttacccgttacccggtacgtaccccggtacccgttacccccgtaaacccggg

SEQ ID NO: 6393 - DNA, 669 bp, Homo sapiens
  misc_feature: GYAE6OF02F5YFV.11.40.D07.1.454.CMB.1.raw
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (484)..(484): a, c, t, g, unknown or other
  misc_feature (484)..(484): n is a, c, g, or t
  modified_base (648)..(648): a, c, t, g, unknown or other
  misc_feature (648)..(648): n is a, c, g, or t
tcagcgagagataccacgaccggtgctcgatttagtgatagagcgtaacaacagaggggaggtctgggagaggagcccagcactagaagtcggcggtgtttccaatcggtgatcagcactgaacacagaggactcaccatggagttgggctgcctgggttttctcgttgtcttcttttaagaggtgtccagtgtcaggtgcagctggtggagtcgtgggggagcgttgtccgagccgtggacggtcctgagacctctcctgtcgcgacgtccgtgttggactttcgatttcttacgtaaacttaccgtttggctaagttcgacgtaccgttcggggtcccaccgtacgggctttacccggagggacgtaacggggtactgggaggtccgattacgtntaacgttttancgttatacttgagtagaacttatagtaattaccgtagttacggtacgggtacggtttaaggtcgtaacgtttaccnctaacttccgtacaacggtactaagttaaccgtacgtaacggaacctacgtacctgtacgttctactaacgtacttaaaccgacgtaccgtaccctacgtaaacgacgtaccgcgtaaccggtactttaggtttactcgtacgactaccctacggacgttaacntaccgttaacgttagtaacgg

SEQ ID NO: 6394 - DNA, 687 bp, Homo sapiens
  misc_feature: GYAE6OF02I05R8.11.40.D07.1.454.CMB.1.raw
tcagcgagagataccacgaccggtgctcgatttagtgatagagcgtaacacagagggctcaccatggagtttgggctgacctgggtttcctcgttgctcttttaagaggtgtccagtgtcaggtgcagctggtggagtcgtggggggaggcgtggtccagccgtgggacggtccctgagactctcctgtgcagcctctggacttcattcttacaacttaccgtttggctatcgccacgtcggggtcccgccgacggtcctaccgacggcgaacgggacttgggagtggactatactatttatgtctagtttgaataggtaacttaatattattacttagttcggtaggggtaccgttaaggggtcgtattccactactcctccaagacgactaactaccgaacgaaccacgctagtatacgtctactaactaaccacgaccgacccaacaaccgtacgaacgaccgacggtacgttactttaacttacgtcgtacgaccaacgtatacttaacgtaccggtactaaacggtttacggacggttagggggtacgtaccgtaacggttaacgcgttactaacttacgtacgttacgacccgtaacggtcgggacccggtaaccggtaccggttacggtaccctacgttcccgttacctcccgtacccgacgtcccctaccgtaacccgg

SEQ ID NO: 6395 - DNA, 917 bp, Homo sapiens
  misc_feature: GYAE6OF02JMOHK.11.40.D07.1.454.CMB.1.raw
tcagcgagagataccacgaccggtgctcgatttagtgatagagcgtaacaacagaggggaggtctgggagaggagcccagcactagaagtcggcggtgtttccaatcggtgatcagcactgaacacagaggactcaccatggagtttgggctgaccttgggttttcctgttgcttcttttaagaggtgtccagtgtcaggtgcagctggtggagtcgtgggggaggcgtggtccagccgtggggacggtccctgacgactctcctgtgcagcctcgtggtacttcatcttacaaattcccgtttggactagtgcctacggttccggggtcccgaccgagggtccctaccgaggggaaccgtaaaggggtaccgttgggggaaggttcgggtacctttaaacgttccgtaaagtttttttaagccgttacgtttaacgtttttagggaaacgtttaaccggggtaaaaacttttaaaacgttaaagtttaaaccgttttaaacccgttttaaaggttttaccgggggttttacccgggggggtttaaacccggggtttttaaacggggggtttaaccccgggtttaattttacccccggtaaaacccgttaccgtttaccccgttaacccggtaaaggggtaaccgttaaacccgttaaaaccgtttacccgggtaaaacgggtaaacccggttaaacccgttccgggtttaaagttaccgtttaccgttaccggtaaacttaaaccgttttaacccgaaacccgttaccggtaaaccccgttaaacgtaaaccgtaccgggaacctaccgggtaaccggttccttttaacggttttaaccgttacgtaccgtacccgtaccgtaaacggtacgttaaccgttaacggtaaccggttacggtttaaaccgttacgggg

SEQ ID NO: 6396 - DNA, 804 bp, Homo sapiens
  misc_feature: GYAE6OF02FY32L.11.40.D07.1.454.CMB.1.raw
  modified_base (170)..(170): a, c, t, g, unknown or other
  misc_feature (170)..(170): n is a, c, g, or t
  modified_base (210)..(210): a, c, t, g, unknown or other
  misc_feature (210)..(210): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (347)..(347): a, c, t, g, unknown or other
  misc_feature (347)..(347): n is a, c, g, or t
  modified_base (374)..(374): a, c, t, g, unknown or other
  misc_feature (374)..(374): n is a, c, g, or t
tcagcgagagataccacgaccggtgctcgatttagtgatagagcgtaacaacgagagggaggtctgggagaggagcccagcactagaagtcggcggtgtttccaatcggtgatcagcactgaacacagaggactcacctatggagtttggctagaccgtgggttttaccncgttagcttcttttaaggaggtgtccagtcgtcgtaggtnacgagtcgtgggtgacggttcggtgggggagtcgtcggtccaggtccgtgggacgtccctggataccgtnttccgtgtcgacncgtcctcgtgacttcactntacagttaccttggcatcgacgtacgtcggtaccncgaggtccacgtaggacgaagggtcgngacgtcgtacttagtcctaagttttcgacttacgttagtttccggtaagtaacggttaaacttacgtttaaagttaacgttaccgggtttaacttacccgggggtttacggggttaaaaccccggttttaagggggttacccttaacccggtttaaccgttaacccgtacggttaccccttaaacccgggtaaaggtaccgttaaacccgttaaacggtttaccgaaaccggggtaacctaccggttacggtaaacgttccctttaacggacgttaccgttaaaacgttccgaaaccggtacccgtaacccgaaaggttaaacaccgtacgtacccggttaacgtaccgggttttaattaacggtaacgttcccgaagtacccgaacgttaaggtacctaaggtttaccgaggtttaaacccggttcggg

SEQ ID NO: 6397 - DNA, 761 bp, Homo sapiens
  misc_feature: GYAE6OF01BHQME.12.52.E08.1.454.CMB.1.raw
  modified_base (201)..(201): a, c, t, g, unknown or other
  misc_feature (201)..(201): n is a, c, g, or t
tcagatacgacgtacacgaccggtgctcgatttagtcgagctctctcggcggggagagctgctcagttaggacccaggagggaaccagtggaaaccccagcgcagcttctcttcctctgctactctggctcccagagaccaccggagaaattgtgttgacgcagtctccaggcaccctgtctttatcctccgaggggaaancgcccaccctctcctgcagggccagtgagatgttaacacaggtatcgtggcctggtaccagcaggaaacctggccaggctcccaggcctctcatcgtacgttactccagcagggccacgtggcacgtcccagcaggttccacgtgggactaggtcgggtctagggaacaggtacctttcactccgtacaaccctattacccgaacccaggtacccgtagggaccgtacccgttaggaacgttagttttcgaccgtaaggttacgttaagtttaacgttcggttactaaggtccgtaagggttaagttcggggtaacgtaccggtacccgtaacccggttaacctttacccgggtttttaccggggacccggttaacggggggttacccctaaagggttacccggttaaggggaacgggttaaaccgtttaaacgggaaaaacccggttaaccgggtttacgggtacgggtacccgtttacgggaacccgtaacccgtaacggtttcccgtttaccggtttaccgtttaacccgtaccgttttccccgtttaccccccggg

SEQ ID NO: 6398 - DNA, 945 bp, Homo sapiens
  misc_feature: GYAE6OF01DDF2C.12.52.E08.1.454.CMB.1.raw
  modified_base (930)..(930): a, c, t, g, unknown or other
  misc_feature (930)..(930): n is a, c, g, or t
tcagatacgacgtacacgaccggtgctcgatttagtcgagctctctcggcgggggagagctgctcaggttaggacccaggagggaaccatacggaaaccccagcgcagcttctcttcctcctgtctactctgctaccagacgaccgacggaataattgtgtgacgctacgtccaccgaggaccctacccgttgttcctttgtacccgtaccgggaaagggggaaaacgtctaccccttaacccttcctccgtcggaccggtacggggaccaaggttccgaaggtacgttaccgttaaacgcccgtaacccttaagttaccgtacccggttaaccgggtaaacccaaaacggtaaaccgtaaacccggtacgggacccggaaccggtaccccggtaacccggtaccggtcccgtttaccctacttaacttaccgtaacgtggtaactaccggtacaaacccgttaaacccggtaaacgggaccctaaccggtcggaacccacccgttaccccggacgtaccggttacgggttaccgtaggttacggggacggttacggggttacggggtacggttaccggggggactaacccggttaccttaccggaacctttaccgtaaccaaccggttacaacggtacccgaacgtacccggtaacggtaaccggtaacgtaccgggttaatttacggttaacttttagggttaactttaaagttttaccgtacggttaacgttacgacggtaaccgtacgttaccggaaactaccgttaccgtcggttacccgtttaccggttacgtttaccgggtaccggacgggtacggtaaccgtagggaccttaagggaaccttacggtaaaacggtaccgtaggggttcctaagggtccctaagtacccggtaattaccctaaccgtttagttaccccgttanacccggtttaccccg

SEQ ID NO: 6399 - DNA, 192 bp, Homo sapiens
  misc_feature: GYAE6OF01A4YMI.29.33.C11.1.454.CMB.1.raw
  modified_base (191)..(192): a, c, t, g, unknown or other
  misc_feature (191)..(192): n is a, c, g, or t
tcagatagagtactcacgaccggtgctcgatttagagtgagctcgttgggttggtcagcctccaccaagggcccatcggtcttcccctggcaccctcctccaagagcacctctggggcacagcggccctgggctgcctggtcaaggactacttcccactactatgctgagcgggctggcaaggcgcatagnn

SEQ ID NO: 6400 - DNA, 195 bp, Homo sapiens
  misc_feature: GYAE6OF01BYYEU.29.33.C11.1.454.CMB.1.raw
  modified_base (193)..(195): a, c, t, g, unknown or other
  misc_feature (193)..(195): n is a, c, g, or t
tcagatagagtactcacgaccggtgctcgatttagagtgagctcgttgggtttgggtcagcctccaccaaggcccatcggtcttcccctggcaccctcctccaagagcacctctgggggcacagcggccctgggctgcctggtcaaggactacttccatagcgtactctgagcgggctggcaaggcgcatagnnn

SEQ ID NO: 6401 - DNA, 195 bp, Homo sapiens
  misc_feature: GYAE6OF01BS1Q4.29.33.C11.1.454.CMB.1.raw
  modified_base (194)..(195): a, c, t, g, unknown or other
  misc_feature (194)..(195): n is a, c, g, or t
tcagatagagtactcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccctcgtctctactgagcgggctggcaaggcgcatagnn

SEQ ID NO: 6402 - DNA, 194 bp, Homo sapiens
  misc_feature: GYAE6OF01DABIQ.29.33.C11.1.454.CMB.1.raw
  modified_base (194)..(194): a, c, t, g, unknown or other
  misc_feature (194)..(194): n is a, c, g, or t
tcagatagagtactcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccctcgtctctactgagcgggctggcaaggcgcatagn

SEQ ID NO: 6403 - DNA, 195 bp, Homo sapiens
  misc_feature: GYAE6OF01BW0R2.29.33.C11.1.454.CMB.1.raw
  modified_base (194)..(195): a, c, t, g, unknown or other
  misc_feature (194)..(195): n is a, c, g, or t
tcagatagagtactcacgaccggtgctcgatttagagtgagctcgttgggtttgggtcagcctccaccaagggcccatcggtcttcccctggcgccctgctccaggagcacctccgagagcacagcggccctgggctgcctggtcaaggactacttccctcgtctctactgagcgggctggcaaggcgcatagnn

SEQ ID NO: 6404 - DNA, 194 bp, Homo sapiens; identical to SEQ ID NO: 6402
  misc_feature: GYAE6OF01C71XB.29.33.C11.1.454.CMB.1.raw
  modified_base (194)..(194): a, c, t, g, unknown or other
  misc_feature (194)..(194): n is a, c, g, or t

SEQ ID NO: 6405 - DNA, 194 bp, Homo sapiens; identical to SEQ ID NO: 6402
  misc_feature: GYAE6OF01BZM5A.29.33.C11.1.454.CMB.1.raw
  modified_base (194)..(194): a, c, t, g, unknown or other
  misc_feature (194)..(194): n is a, c, g, or t

SEQ ID NO: 6406 - DNA, 191 bp, Homo sapiens
  misc_feature: GYAE6OF01BE30N.29.33.C11.1.454.CMB.1.raw
  modified_base (189)..(191): a, c, t, g, unknown or other
  misc_feature (189)..(191): n is a, c, g, or t
tcagatagagtactcacgaccggtgctcgatttagagtgagctcgttggttggtcagcctccaccaagggcccatcggtcttccctggcaccctcctccaagagcacctctggggcacagcggccctgggctgcctggtcaaggactacttccctcgtctctactgagcgggctggcaaggcgcatagnnn

SEQ ID NO: 6407 - DNA, 196 bp, Homo sapiens
  misc_feature: GYAE6OF01DA6QC.29.33.C11.1.454.CMB.1.raw
  modified_base (194)..(196): a, c, t, g, unknown or other
  misc_feature (194)..(196): n is a, c, g, or t
tcagatagagtactcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccatagcgtactctgagcgggctggcaaggcgcatagnnn

SEQ ID NO: 6408 - DNA, 243 bp, Homo sapiens
  misc_feature: GYAE6OF01B5RVT.29.33.C11.1.454.CMB.1.raw
  modified_base (196)..(199): a, c, t, g, unknown or other
  misc_feature (196)..(199): n is a, c, g, or t
  modified_base (201)..(243): a, c, t, g, unknown or other
  misc_feature (201)..(243): n is a, c, g, or t
tcagatagagtactcacgaccggtgctcgatttagagtgagctcgttggggtttgggtcagcctccaccaagggcccatcggtcttcccctggcacccctcctccaagagcaccctctgggggcacagcggccctgggctgcctggtcaaggactacttccctgtctctactgagcgggctggcaaggcgcatagnnnngnnnnnnnnnnnnnnnnnnnnnnnnnnnnnnnnnnnnnnnnnnn

SEQ ID NO: 6409 - DNA, 195 bp, Homo sapiens
  misc_feature: GYAE6OF01BJ7ME.29.33.C11.1.454.CMB.1.raw
  modified_base (193)..(195): a, c, t, g, unknown or other
  misc_feature (193)..(195): n is a, c, g, or t
tcagatagagtactcacgaccggtgctcgatttagagtgagctcgttgggtttgggtcagcctccaccaagggcccatcggtcttcccctggcaccctcctccaagagcacctctggggcacagcggccctgggctgcctggtcaaggactacttccatagcgtactctgagcgggctggcaaggcgcatagnnn

SEQ ID NO: 6410 - DNA, 197 bp, Homo sapiens
  misc_feature: GYAE6OF01ESP9K.29.33.C11.1.454.CMB.1.raw
  modified_base (194)..(197): a, c, t, g, unknown or other
  misc_feature (194)..(197): n is a, c, g, or t
tcagatagagtactcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccactgtacagtctgagcgggctggcaaggcgcatagnnnn

SEQ ID NO: 6411 - DNA, 195 bp, Homo sapiens
  misc_feature: GYAE6OF01BNAZX.29.33.C11.1.454.CMB.1.raw
  modified_base (194)..(195): a, c, t, g, unknown or other
  misc_feature (194)..(195): n is a, c, g, or t
tcagatagagtactcacgaccggtgctcgatttagagtgagctcgttgggtttgggtcagcctccaccaagggcccatcggtcttcccctggcgccctgctccaggagcacctccgagagcacagcggccctgggctgcctggtcaaggactacttcccgagcgacgactgagcgggctggcaaggcgcatagnn

SEQ ID NO: 6412 - DNA, 195 bp, Homo sapiens
  misc_feature: GYAE6OF01AQIAV.29.33.C11.1.454.CMB.1.raw
  modified_base (195)..(195): a, c, t, g, unknown or other
  misc_feature (195)..(195): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccctcgtctctactgagcgggctggcaaggcgcatagn

SEQ ID NO: 6413 - DNA, 194 bp, Homo sapiens; identical to SEQ ID NO: 6402
  misc_feature: GYAE6OF01DESYH.29.33.C11.1.454.CMB.1.raw
  modified_base (194)..(194): a, c, t, g, unknown or other
  misc_feature (194)..(194): n is a, c, g, or t

SEQ ID NO: 6414 - DNA, 194 bp, Homo sapiens
  misc_feature: GYAE6OF01DN1EE.29.33.C11.1.454.CMB.1.raw
  modified_base (192)..(194): a, c, t, g, unknown or other
  misc_feature (192)..(194): n is a, c, g, or t
tcagatagagtactcacgaccggtgctcgatttagagtgagctcgttgggtttgggtcagcctccaccaaggcccatcggtcttcccctggcaccctcctccaagagcacctctgggggcacagcggccctgggctgcctggtcaaggctacttccactagtgcgactgagcgggctggcaaggcgcatagnnn

SEQ ID NO: 6415 - DNA, 196 bp, Homo sapiens
  misc_feature: GYAE6OF01AXE6N.29.33.C11.1.454.CMB.1.raw
  modified_base (194)..(196): a, c, t, g, unknown or other
  misc_feature (194)..(196): n is a, c, g, or t
tcagatagagtactcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccctcgtctctactgagcgggctggcaaggcgcatagnnn

SEQ ID NO: 6416 - DNA, 196 bp, Homo sapiens
  misc_feature: GYAE6OF01DMA47.29.33.C11.1.454.CMB.1.raw
  modified_base (194)..(196): a, c, t, g, unknown or other
  misc_feature (194)..(196): n is a, c, g, or t
tcagatagagtactcacgaccggtgctcgatttagagtgagctcgttgggtttggtcagcctccaccaaggcccatcggtcttccccctggcaccctcctccaagaggcacctctgggggcacgagcggccctgggctgcctggtcaaggactacttcctcgtctctactgagcgggctggcaaggcgcatagnnn

SEQ ID NO: 6417 - DNA, 203 bp, Homo sapiens
  misc_feature: GYAE6OF01AKTB4.29.33.C11.1.454.CMB.1.raw
  modified_base (195)..(203): a, c, t, g, unknown or other
  misc_feature (195)..(203): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccctcgtctctactgagcgggctggcaaggcgcatagnnnnnnnnn

SEQ ID NO: 6418 - DNA, 197 bp, Homo sapiens
  misc_feature: GYAE6OF01B397T.29.33.C11.1.454.CMB.1.raw
  modified_base (195)..(197): a, c, t, g, unknown or other
  misc_feature (195)..(197): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccatagcgtactctgagcgggctggcaaggcgcatagnnn

SEQ ID NO: 6419 - DNA, 217 bp, Homo sapiens
  misc_feature: GYAE6OF01C9ISE.29.33.C11.1.454.CMB.1.raw
  modified_base (196)..(217): a, c, t, g, unknown or other
  misc_feature (196)..(217): n is a, c, g, or t
tcagatagagtactcacgaccggtgctcgatttagagtgagctcggttgggtttgggtcagcctccaccaagggcccatcggtcttccccctggcaccctcctccaagagcacctctgggggcacagcggccctgggctgcctggtcaaggactacttccctcgtctctactgagcgggctggcaaggcgcatagnnnnnnnnnnnnnnnnnnnnnn

SEQ ID NO: 6420 - DNA, 199 bp, Homo sapiens
  misc_feature: GYAE6OF01E4CG7.29.33.C11.1.454.CMB.1.raw
  modified_base (195)..(199): a, c, t, g, unknown or other
  misc_feature (195)..(199): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccctcgtctctactgagcgggctggcaaggcgcatagnnnnn

SEQ ID NO: 6421 - DNA, 219 bp, Homo sapiens
  misc_feature: GYAE6OF01D1YML.29.33.C11.1.454.CMB.1.raw
  modified_base (196)..(219): a, c, t, g, unknown or other
  misc_feature (196)..(219): n is a, c, g, or t
tcagatagagtactcacgaccggtgctcgatttagagtgagctcgttgggtttggggtcagcctccaccaagggcccatcggtcttcccctggcaccctcctccaagagcaccgtctggggcacagcggccctgggctgcctggtcaaggctacttcccgtcgtctctactgagccgggctggcaaggcgcatagnnnnnnnnnnnnnnnnnnnnnnnn

SEQ ID NO: 6422 - DNA, 195 bp, Homo sapiens
  misc_feature: GYAE6OF01E2YBU.29.33.C11.1.454.CMB.1.raw
  modified_base (195)..(195): a, c, t, g, unknown or other
  misc_feature (195)..(195): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccacatacgtcactgagcgggctggcaaggcgcatagn

SEQ ID NO: 6423 - DNA, 199 bp, Homo sapiens
  misc_feature: GYAE6OF01BX919.29.33.C11.1.454.CMB.1.raw
  modified_base (195)..(199): a, c, t, g, unknown or other
  misc_feature (195)..(199): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccactgtacagtctgagcgggctggcaaggcgcatagnnnnn

SEQ ID NO: 6424 - DNA, 195 bp, Homo sapiens
  misc_feature: GYAE6OF01CKRUJ.29.33.C11.1.454.CMB.1.raw
  modified_base (194)..(195): a, c, t, g, unknown or other
  misc_feature (194)..(195): n is a, c, g, or t
tcagatagagtactcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccatagcgtactctgagcgggctggcaaggcgcatagnn

SEQ ID NO: 6425 - DNA, 199 bp, Homo sapiens
  misc_feature: GYAE6OF01B9UUN.29.33.C11.1.454.CMB.1.raw
  modified_base (195)..(199): a, c, t, g, unknown or other
  misc_feature (195)..(199): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccacgtgatcgactgagcgggctggcaaggcgcatagnnnnn

SEQ ID NO: 6426 - DNA, 199 bp, Homo sapiens
  misc_feature: GYAE6OF01AXCKG.29.33.C11.1.454.CMB.1.raw
  modified_base (195)..(199): a, c, t, g, unknown or other
  misc_feature (195)..(199): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccacgcgtatgtctgagcgggctggcaaggcgcatagnnnnn

SEQ ID NO: 6427 - DNA, 210 bp, Homo sapiens
  misc_feature: GYAE6OF01DNN8V.29.33.C11.1.454.CMB.1.raw
  modified_base (194)..(194): a, c, t, g, unknown or other
  misc_feature (194)..(194): n is a, c, g, or t
  modified_base (196)..(210): a, c, t, g, unknown or other
  misc_feature (196)..(210): n is a, c, g, or t
tcagatagagtactcacgaccggtgctcgatttagagtgagctcgttggggtttgggtcagcctccaccaagggcccatcggtcttcccctggcgccctgctccaggagcacctccgagagcacagcggccctgggctgcctggtcaaggactacttcccgagcgacgactgagcgggctggcaaggcgcatgngnnnnnnnnnnnnnnn

SEQ ID NO: 6428 - DNA, 199 bp, Homo sapiens
  misc_feature: GYAE6OF01EXNCV.29.33.C11.1.454.CMB.1.raw
  modified_base (198)..(199): a, c, t, g, unknown or other
  misc_feature (198)..(199): n is a, c, g, or t
tcagatagagtactcacgaccggtgctcgatttagagtgagctcgttgggtttgggtcagcctccaccaagggcccatcggtcttccccctggcaccctcctccaagagcacctcgtgggggcacagcggccctgggctgcctggtcaaggactacttccattagcgtactctgagcgggctggcaagggcgcatagnn

SEQ ID NO: 6429 - DNA, 221 bp, Homo sapiens
  misc_feature: GYAE6OF01CH3F1.29.33.C11.1.454.CMB.1.raw
  modified_base (197)..(221): a, c, t, g, unknown or other
  misc_feature (197)..(221): n is a, c, g, or t
tcagatagagtactcacgaccggtgctcgatttagagtgagctcgttgggtttgggtcagcctccaccaaggcccatcggtcttccccctggccaccctcctccaagagcaccttcgtgggggcacagcggccctgggctgcctggtcaaggactaacttccactgtacagtctgagcggctggcaaggcgcatagnnnnnnnnnnnnnnnnnnnnnnnnn

SEQ ID NO: 6430 - DNA, 203 bp, Homo sapiens
  misc_feature: GYAE6OF01CHD29.29.33.C11.1.454.CMB.1.raw
  modified_base (187)..(187): a, c, t, g, unknown or other
  misc_feature (187)..(187): n is a, c, g, or t
  modified_base (192)..(203): a, c, t, g, unknown or other
  misc_feature (192)..(203): n is a, c, g, or t
tcagatagagtactcacgaccggtgctcgatttagagtgagctcgttgggttggtcagcctcaccaggccatcggtcttcccctggcaccctcctccaagagcacctcgtgggggcacagcggccctgggcctgcctggtcaaggactacttccctgtctacttactcgagcgggctggcaaggcgnatagnnnnnnnnnnnn

SEQ ID NO: 6431 - DNA, 203 bp, Homo sapiens
  misc_feature: GYAE6OF01B53Q1.29.33.C11.1.454.CMB.1.raw
  modified_base (193)..(203): a, c, t, g, unknown or other
  misc_feature (193)..(203): n is a, c, g, or t
tcagatagagtactcacgaccggtgctcgatttagagtgagctcgttgggtttgggtcagcctccaccaagggccatcggtcttcccctggcaccctcctccaagagcacctctgggggcacagcggccctgggctgcctggtcaaggactacttccctcgtctctactgagcgggctggcaaggcgcatagnnnnnnnnnnn

SEQ ID NO: 6432 - DNA, 221 bp, Homo sapiens
  misc_feature: GYAE6OF01D645T.29.33.C11.1.454.CMB.1.raw
  modified_base (201)..(221): a, c, t, g, unknown or other
  misc_feature (201)..(221): n is a, c, g, or t
tcagatagagtactcacgaccggtgctcgatttagagtgagctcggtttggggtttgggtcagcctccaccaagggcccatcggtcttccccctggcaccctcctccaagagcacctctgggggcacacgccggccctgggctgccgtggtcaaggactacttccctcgtctctactgagcgggctggcaaggcgcatagnnnnnnnnnnnnnnnnnnnnn

SEQ ID NO: 6433 - DNA, 217 bp, Homo sapiens
  misc_feature: GYAE6OF01B94EW.29.33.C11.1.454.CMB.1.raw
  modified_base (198)..(217): a, c, t, g, unknown or other
  misc_feature (198)..(217): n is a, c, g, or t
tcagatagagtactcacgaccggtgctcgatttagagtgagctcgttgggttgggtcgagcctccaccaagggcccagtcggtcttccccctggcaccctcctccaagagcacctcgtgggggcacagcggccctgggctgcctggtcaaggactacttccatagcgtactcgtgagcgggctggcaaggcgcatagnnnnnnnnnnnnnnnnnnnn

SEQ ID NO: 6434 - DNA, 203 bp, Homo sapiens
  misc_feature: GYAE6OF01ECT5K.29.33.C11.1.454.CMB.1.raw
  modified_base (197)..(203): a, c, t, g, unknown or other
  misc_feature (197)..(203): n is a, c, g, or t
tcagatagagtactcacgaccggtgctcgatttagagtgagctcgttgggtttgggtcagcctccaccaagggcccatcggtcttccccctggcaccctcctccaagagcacctcgtgggggcacagcggcccgtgggctgcctggtcaaggactacttccctcgtctctactgagcggctggcaaggcgacatagnnnnnnn

SEQ ID NO: 6435 - DNA, 215 bp, Homo sapiens
  misc_feature: GYAE6OF01BTKMM.29.33.C11.1.454.CMB.1.raw
  modified_base (195)..(215): a, c, t, g, unknown or other
  misc_feature (195)..(215): n is a, c, g, or t
tcagatagagtactcacgaccggtgctcgatttagagtgagctcgttgggtttgggtcagcctccaccaagggcccatcggtcttccccctggcaccctcctccaagagcaccctctgggggcacagccggccctgggctgcctggtcaggactacttccatagcgtactctgagcggctggcaaggcgcatagnnnnnnnnnnnnnnnnnnnnn

SEQ ID NO: 6436 - DNA, 240 bp, Homo sapiens
  misc_feature: GYAE6OF01BK2CG.29.33.C11.1.454.CMB.1.raw
  modified_base (200)..(201): a, c, t, g, unknown or other
  misc_feature (200)..(201): n is a, c, g, or t
  modified_base (203)..(240): a, c, t, g, unknown or other
  misc_feature (203)..(240): n is a, c, g, or t
tcagatagagtactcacgaccggtgctcgatttagagtgagctcgttggggtttgggggtcagcctccaccaagggcccatcggtcttccccctggcaccctcctccaagagccacctctgggggcaccacgcggccctgggctgcctggtcaaggactacttccattagcgtactctgagcggctggccaggcgcatgnngnnnnnnnnnnnnnnnnnnnnnnnnnnnnnnnnnnnnnn

SEQ ID NO: 6437 - DNA, 191 bp, Homo sapiens
  misc_feature: GYAE6OF02FEN6K.29.33.C11.1.454.CMB.1.raw
  modified_base (191)..(191): a, c, t, g, unknown or other
  misc_feature (191)..(191): n is a, c, g, or t
tcagatagagtactcacgaccggtgctcgatttagagtgagctcgttgggtttgggtcagcctccaccaaggcccatcggtcttcccctggcacctcctccaagagcacctctggggcacagcggccctgggctgcctggtcaaggactacttccctcgtctctactgagcgggctggcaaggcgcatagn

SEQ ID NO: 6438 - DNA, 195 bp, Homo sapiens
  misc_feature: GYAE6OF02GPT95.29.33.C11.1.454.CMB.1.raw
  modified_base (194)..(195): a, c, t, g, unknown or other
  misc_feature (194)..(195): n is a, c, g, or t
tcagatagagtactcacgaccggtgctcgatttagagtgagctcgttgggtttgggtcagcctccaccaagggcccatcggtcttcccctggcaccctcctccaagagcacctatgggggcacagcggccctgggctgcctggtcaaggactacttccacatacgtcactgagcgggctggcaaggcgcatagnn

SEQ ID NO: 6439 - DNA, 216 bp, Homo sapiens
  misc_feature: GYAE6OF02G97KL.29.33.C11.1.454.CMB.1.raw
  modified_base (196)..(216): a, c, t, g, unknown or other
  misc_feature (196)..(216): n is a, c, g, or t
tcagatagagtactcacgaccggtgctcgatttagagtgagctcgttgggtttgggtcagcctccaccaagggcccatcggtcttccccctggcaccctcctcccaagagcacctctgggggcacagcggccctgggctgcctggtcaaggactacttccctcgtctctactgagcgggctggcaaggcgcatagnnnnnnnnnnnnnnnnnnnnn

SEQ ID NO: 6440 - DNA, 196 bp, Homo sapiens
  misc_feature: GYAE6OF02G6MPO.29.33.C11.1.454.CMB.1.raw
  modified_base (195)..(196): a, c, t, g, unknown or other
  misc_feature (195)..(196): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccctcgtctctactgagcgggctggcaaggcgcatagnn

SEQ ID NO: 6441 - DNA, 195 bp, Homo sapiens
  misc_feature: GYAE6OF02H814Q.29.33.C11.1.454.CMB.1.raw
  modified_base (194)..(195): a, c, t, g, unknown or other
  misc_feature (194)..(195): n is a, c, g, or t
tcagatagagtactcacgaccggtgctcgatttagagtgagctcgttgggtttgggtcagcctccaccaagggcccatcggtcttcccctggcaccctcctccaagagcacctctgggggcacagcggacctgggctgcctggtcaaggactacttccagtactctatctgagcgggctggcaaggcgcatagnn

SEQ ID NO: 6442 - DNA, 195 bp, Homo sapiens; identical to SEQ ID NO: 6401
  misc_feature: GYAE6OF02HUTOA.29.33.C11.1.454.CMB.1.raw
  modified_base (194)..(195): a, c, t, g, unknown or other
  misc_feature (194)..(195): n is a, c, g, or t

SEQ ID NO: 6443 - DNA, 195 bp, Homo sapiens
  misc_feature: GYAE6OF02JE5T0.29.33.C11.1.454.CMB.1.raw
  modified_base (190)..(195): a, c, t, g, unknown or other
  misc_feature (190)..(195): n is a, c, g, or t
tcagatagagtactcacgaccggtgctcgatttagagtgagctcgttgggttgggtcagcctccaccaaggcccatcggtcttcccctggcaccctcctccaagagcacctctggggcacagcggccctgggctgcctggtcaaggactacttccctcgtctctactgagcggctggcaaggcgcatagnnnnnn

SEQ ID NO: 6444 - DNA, 195 bp, Homo sapiens
  misc_feature: GYAE6OF02ICIUM.29.33.C11.1.454.CMB.1.raw
  modified_base (194)..(195): a, c, t, g, unknown or other
  misc_feature (194)..(195): n is a, c, g, or t
tcagatagagtactcacgaccggtgctcgatttagagtgagctcgttgggtttggtcagcctccaccaagggcccatcggtcttcccctggcaccctcctccaagagcacctcgtgggggcacagcggccctgggctgcctggtcaaggactacttccatagcgtactctgagcgggctggcaaggcgcatagnn

SEQ ID NO: 6445 - DNA, 196 bp, Homo sapiens
  misc_feature: GYAE6OF02IPIEN.29.33.C11.1.454.CMB.1.raw
  modified_base (195)..(196): a, c, t, g, unknown or other
  misc_feature (195)..(196): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccatagcgtactctgagcgggctggcaaggcgcatagnn

SEQ ID NO: 6446 - DNA, 195 bp, Homo sapiens
  misc_feature: GYAE6OF02H69XW.29.33.C11.1.454.CMB.1.raw
  modified_base (194)..(195): a, c, t, g, unknown or other
  misc_feature (194)..(195): n is a, c, g, or t
tcagatagagtactcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttcccactactatgctgagcgggctggcaaggcgcatagnn

SEQ ID NO: 6447 - DNA, 193 bp, Homo sapiens
  misc_feature: GYAE6OF02H7YYW.29.33.C11.1.454.CMB.1.raw
  modified_base (189)..(193): a, c, t, g, unknown or other
  misc_feature (189)..(193): n is a, c, g, or t
tcagatagagtactcacgaccggtgctcgatttagagtgagctcgttgggtttgggtcagcctccaccaaggccatcggtcttcccctggcacctcctccaagagcacctctggggcacagcggcctgggctgcctggtcaaggactacttccctcgtctctactgagcgggctggcaaggcgcatagnnnnn

SEQ ID NO: 6448 - DNA, 198 bp, Homo sapiens
  misc_feature: GYAE6OF02F3YNC.29.33.C11.1.454.CMB.1.raw
  modified_base (195)..(198): a, c, t, g, unknown or other
  misc_feature (195)..(198): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccatagcgtactctgagcgggctggcaaggcgcatagnnnn

SEQ ID NO: 6449 - DNA, 198 bp, Homo sapiens
  misc_feature: GYAE6OF02GDGTE.29.33.C11.1.454.CMB.1.raw
  modified_base (195)..(198): a, c, t, g, unknown or other
  misc_feature (195)..(198): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccagtatagtctctgagcgggctggcaaggcgcatagnnnn

SEQ ID NO: 6450 - DNA, 196 bp, Homo sapiens; identical to SEQ ID NO: 6440
  misc_feature: GYAE6OF02GE74A.29.33.C11.1.454.CMB.1.raw
  modified_base (195)..(196): a, c, t, g, unknown or other
  misc_feature (195)..(196): n is a, c, g, or t

SEQ ID NO: 6451 - DNA, 197 bp, Homo sapiens; identical to SEQ ID NO: 6418
  misc_feature: GYAE6OF02H1303.29.33.C11.1.454.CMB.1.raw
  modified_base (195)..(197): a, c, t, g, unknown or other
  misc_feature (195)..(197): n is a, c, g, or t

SEQ ID NO: 6452 - DNA, 210 bp, Homo sapiens
  misc_feature: GYAE6OF02JT9DS.29.33.C11.1.454.CMB.1.raw
  modified_base (196)..(210): a, c, t, g, unknown or other
  misc_feature (196)..(210): n is a, c, g, or t
tcagatagagtactcacgaccggtgctcgatttagagtgagctcgttgggtttgggtcgagcctccaccaaggcccatcggtcttcccccgtggcaccctcctccaagagcacctctgggggcacagcggccctgggctgcctggtcaaggactacttcctacgtcgtatctgagcgggctggcaaggcgcatagnnnnnnnnnnnnnnn

SEQ ID NO: 6453 - DNA, 197 bp, Homo sapiens
  misc_feature: GYAE6OF02I9C25.29.33.C11.1.454.CMB.1.raw
  modified_base (191)..(197): a, c, t, g, unknown or other
  misc_feature (191)..(197): n is a, c, g, or t
tcagatagagtactcacgaccggtgctcgatttagagtgagctcgttgggtttgggtcagcctccaccaaggcccatcggtcttcccctggcaccctcctccaagagcacctctgggggcacagcggccctgggctgcctggtcaaggactacttcctcgtctctactgagcgggctggcaggcgcatagnnnnnnn

SEQ ID NO: 6454 - DNA, 197 bp, Homo sapiens
  misc_feature: GYAE6OF02GJI9R.29.33.C11.1.454.CMB.1.raw
  modified_base (195)..(197): a, c, t, g, unknown or other
  misc_feature (195)..(197): n is a, c, g, or t
tcagatagagtactcacgaccggtgctcgatttagagtgagctcgttgggtttgggtcagcctccaccaagggcccatcggtcttccccctggcgccctgctccaggagcacctccgagagcacagcggccctgggctgcctggtcaaggactacttcccgagcgacgactgagcgggctggcaaggcgcatagnnn

SEQ ID NO: 6455 - DNA, 196 bp, Homo sapiens; identical to SEQ ID NO: 6445
  misc_feature: GYAE6OF02GXSU9.29.33.C11.1.454.CMB.1.raw
  modified_base (195)..(196): a, c, t, g, unknown or other
  misc_feature (195)..(196): n is a, c, g, or t

SEQ ID NO: 6456 - DNA, 199 bp, Homo sapiens
  misc_feature: GYAE6OF02IG67V.29.33.C11.1.454.CMB.1.raw
  modified_base (194)..(199): a, c, t, g, unknown or other
  misc_feature (194)..(199): n is a, c, g, or t
tcagatagagtactcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnnnn

SEQ ID NO: 6457 - DNA, 204 bp, Homo sapiens
  misc_feature: GYAE6OF02FYYEF.29.33.C11.1.454.CMB.1.raw
  modified_base (195)..(204): a, c, t, g, unknown or other
  misc_feature (195)..(204): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccacgtgatcgactgagcgggctggcaaggcgcatagnnnnnnnnnn

SEQ ID NO: 6458 - DNA, 199 bp, Homo sapiens
  misc_feature: GYAE6OF02FQ7YG.29.33.C11.1.454.CMB.1.raw
  modified_base (195)..(199): a, c, t, g, unknown or other
  misc_feature (195)..(199): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttcccactactatgctgagcgggctggcaaggcgcatagnnnnn

SEQ ID NO: 6459 - DNA, 211 bp, Homo sapiens
  misc_feature: GYAE6OF02GVXGR.29.33.C11.1.454.CMB.1.raw
  modified_base (195)..(211): a, c, t, g, unknown or other
  misc_feature (195)..(211): n is a, c, g, or t
tcagatagagtactcacgaccggtgctcgatttagagtgagctcgttgggtttgggtcgagcctccaccaagggcccatcggtcttcccctggcaccctcctccaagagcacctctgggggcacagcggccctgggctgcctggtcaaggactacttccctcgtctctactgagcgggctggcaaggcgcatagnnnnnnnnnnnnnnnnn

SEQ ID NO: 6460 - DNA, 204 bp, Homo sapiens
  misc_feature: GYAE6OF02GPHQ6.29.33.C11.1.454.CMB.1.raw
  modified_base (195)..(204): a, c, t, g, unknown or other
  misc_feature (195)..(204): n is a, c, g, or t
tcagatagagtactcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccatagcgtactctgagcgggctggcaaggcgcatagnnnnnnnnnn

SEQ ID NO: 6461 - DNA, 202 bp, Homo sapiens
  misc_feature: GYAE6OF02GSYIX.29.33.C11.1.454.CMB.1.raw
  modified_base (194)..(202): a, c, t, g, unknown or other
  misc_feature (194)..(202): n is a, c, g, or t
tcagatagagtactcacgaccggtgctcgatttagagtgagctcgttgggtttgggtcagcctccaccaaggcccatcggtcttccccctggcaccctcctccaagagcacctctgggggcacagcggccctgggctgcctggtcaaggactacttccacgtgatcgactgagcgggctggcaaggcgcatagnnnnnnnnn

SEQ ID NO: 6462 - DNA, 220 bp, Homo sapiens
  misc_feature: GYAE6OF02IEG55.29.33.C11.1.454.CMB.1.raw
  modified_base (203)..(220): a, c, t, g, unknown or other
  misc_feature (203)..(220): n is a, c, g, or t
tcagatagagtactcacgaccggtgctcgatttagagtgagctcgttgggtttgggtcagccctaccaccaacgggcccatcggtcttccccctggcaccctcctccaagacgcaccctcgtggggggcacagcggccctgggcttgccgtggtcaaggactacttccctgtctctactgacgcgggctggcaggcacatagnnnnnnnnnnnnnnnnnn

SEQ ID NO: 6463 - DNA, 519 bp, Homo sapiens
  misc_feature: GYAE6OF01AL0E0.52.78.H01.1.454.CMB.1.raw
  modified_base (447)..(447): a, c, t, g, unknown or other
  misc_feature (447)..(447): n is a, c, g, or t
tcagcgcagtacgacacgaccggtgctcgatttagtgtgagtagtttgggtttgggggtgggtccaggaggcagaactctgggtgtctcaccatgggcctggatccctctacttctccccctcctcacctcgtctgcacaggctctggggcctcctatgaactgacacagcccaccctcggtgtcagtgtcctcaggacagacggccaggatcacctgctctggagatgcactgccaaagcaatatggttattggtaccagcagaggccaggccaggcccccttattggtgatatataaggaccagtgagaggccctcagggatccctgagcggattctctggctcctcctctagggacaacagtcacgttgatcatcagtgagtccgggcagaggacgaggctgactattactgtcaatcaacagacagtagtaggtactagtgtncagtcggcggaggacagctcgaccgtcgtaggtccacgcccaaggtcctagaccccctcggtccacttcccg

SEQ ID NO: 6464 - DNA, 566 bp, Homo sapiens
  misc_feature: GYAE6OF01B2K5Z.52.78.H01.1.454.CMB.1.raw
  modified_base (423)..(423): a, c, t, g, unknown or other
  misc_feature (423)..(423): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggattgttgtcgttgcaccagctcgcccctaccggctgctacttcgatctcgtcggggccgtggccacccgtggtcactcgtcttctcncgccctccaccaacgggcccacgtccggtccttcccccgtggccctacccctcctccaacgcgccacctcgtcggggcacgacggccggcccgtgggcctcggcccgtggtaccgaaggtaccttaccgttccctcgtctcgg

SEQ ID NO: 6465 - DNA, 524 bp, Homo sapiens
  misc_feature: GYAE6OF01A3J06.52.78.H01.1.454.CMB.1.raw
  modified_base (388)..(388): a, c, t, g, unknown or other
  misc_feature (388)..(388): n is a, c, g, or t
  modified_base (424)..(424): a, c, t, g, unknown or other
  misc_feature (424)..(424): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaaagcaatatggttattggtaccagcagaggccaggccaggcccccttattcggtgatatataaggaccatgagaggccctcagggatccctgagcgattctctggctcctcctcagggacaacagtcacgttgatcatcaggtggagtccgggnaggaggacgaggctggactattactgtacaatcaanagacagtagtagtacttatgtgctagttcggcggagggaccaggctcggaccgtcgtaggtcacgcccgaaggcctacgccccctcggtccacgttcccg

SEQ ID NO: 6466 - DNA, 532 bp, Homo sapiens
  misc_feature: GYAE6OF01BUQ74.52.78.H01.1.454.CMB.1.raw
  modified_base (388)..(388): a, c, t, g, unknown or other
  misc_feature (388)..(388): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccaggcccccttattcggtgatatataaggaccatgagaggccctcagggatccctgagcgattctctggctcctcctcagggacaacagtcacgttgatcatcagtggagtccggganaggaggacgaggctgactattactgtacaatcaacagacagtagtaggtacttagtgtgctaggttcggcggacgggaccagacgtgaccggttctagggtcacgacccgaaggtcctcgacccccgtcggtcctccgttcccg

SEQ ID NO: 6467 - DNA, 274 bp, Homo sapiens
  misc_feature: GYAE6OF01EG8B6.52.78.H01.1.454.CMB.1.raw
  modified_base (269)..(274): a, c, t, g, unknown or other
  misc_feature (269)..(274): n is a, c, g, or t
tcagcgcagtacgacacgaccggtgctcgatttagtgtgagtagtttgggtttggggtgtgagtagtttgggtttgggtgtggtggtctccactcccgccttgacgaggctgactattactgtcaatcaacagacagtagtggtacttatgtgcagttcggcggagggaccaagctgaccgtcctaggtcagcccaaggctgccccctggtcactctcgttcccaccctcctctatacgatcgctgagcgggctggcaaggcgcatagnnnnnn

SEQ ID NO: 6468 - DNA, 512 bp, Homo sapiens
  misc_feature: GYAE6OF01A7CDT.52.78.H01.1.454.CMB.1.raw
  modified_base (421)..(421): a, c, t, g, unknown or other
  misc_feature (421)..(421): n is a, c, g, or t
  modified_base (443)..(443): a, c, t, g, unknown or other
  misc_feature (443)..(443): n is a, c, g, or t
  modified_base (505)..(505): a, c, t, g, unknown or other
  misc_feature (505)..(505): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctctggagatgcactgaccaaagcaatatggttattggtaccagcagaggccaggccaggcccccttattggtgatatataaggaccatgagaggccctcagggatccctgagcgattctctggctcctctcagggacaacagtcacgttgatcatcagtggagtccgggcagaggacgaggctggactattactgtcaatcaacngacagtagtggtactagtgtgntagttcggcggaggacaagctgaccgtctaggtcacgtccaacggtcacgccccctcggtcncgttccg

SEQ ID NO: 6469 - DNA, 558 bp, Homo sapiens
  misc_feature: GYAE6OF01C5K2A.52.78.H01.1.454.CMB.1.raw
tcagcgcagtacgacacgaccggtgctcgatttagtgtgagtagtttgggtttgggggaggcttggtccagcctgggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctcaaaatgagcagcctgacatccgaggacacggcctgtattactgtgcgagagttcttgggatgttgtcgttgcaccagctgccctaccggctgctactcgatctctggggccgtggcaccctggtcactgtcttctcacgcctccacccaacgggcccaactccgggtcccttcccccgtcggcccacccctcctcccaagacgccaccctcgtcgggggcaccgacgccgggccctgggcctcgccctgggtccaacgggaccttacttccctagtaccgtacg

SEQ ID NO: 6470 - DNA, 544 bp, Homo sapiens
  misc_feature: GYAE6OF01DU1OG.52.78.H01.1.454.CMB.1.raw
  modified_base (367)..(367): a, c, t, g, unknown or other
  misc_feature (367)..(367): n is a, c, g, or t
  modified_base (530)..(530): a, c, t, g, unknown or other
  misc_feature (530)..(530): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaaccgttatgcttattggaccagcaagaagccaggccaggccctgtgttggtgatatataaggacactgagaggccctcgagggatccctgagcgattctctggctccacctcgagggacactagtcacgttnaccatcagtggagtccaggcaggaggacgaggctagacctacactgtacaatcaacagacagctaaggttgttacttatcgttacttcgctaacgtcgggaaccaaggtccaccggtccgtaaggtccacgaccccgaaggcccctaaacccgactcgtaccncgtcgttaccccgg

SEQ ID NO: 6471 - DNA, 574 bp, Homo sapiens
  misc_feature: GYAE6OF01A47UN.52.78.H01.1.454.CMB.1.raw
  modified_base (405)..(405): a, c, t, g, unknown or other
  misc_feature (405)..(405): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattgtaccagcagaggccaggccaggcccccttattcggtgatatagtaaggaccatgagacggccctcgagggactcccgtgacgcgtattctctggccttaccgtcctcgtagggacaaactaggtactacgttgactcatcagtggacgtccgggnaggtaggacgaaggcgtagaactagttacctagtacaactacaacagtaacctagtacgtagtacctagttgtgacgtaggttcggacggaggtaccaagtcgtacggaccgttcgtaggtccgacgacccgaaggtccctaccgcccccgtggtccctacgttcccgg

SEQ ID NO: 6472 - DNA, 745 bp, Homo sapiens
  misc_feature: GYAE6OF01B4NZ4.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgaccaaagcaatatggttatggtaccagcagagcaggccaggcccctatggtgatatataaggaccatgagacggcctcgagggactcccgtgacgcgattctcgtcggcctcctccgtacgacgggtacaacgtagtaccgtacgttagacttcacgtacgaggttcgggacggttcccgggacgaacgggaacgggaaccggaacggggtacgttacggtaaccgtttaacgtttaaccgtacggttaacctaaacgttacccgaaaacgtaacggaaacccgttaaggttaaggttacgggtttaacctttaagttcgggttacgttaccggttaacgggtttaccggggacggggtaaacgggggtaacccgtaaaacggtccggttaaccgggtaacccggttaccccggttaaacggggttccccgaaaccgggtacccccgtaaacggggtcccgttaccccgggtacccccccggtttaccgggttccccgtaacccgttttcccccgg

SEQ ID NO: 6473 - DNA, 735 bp, Homo sapiens
  misc_feature: GYAE6OF01DO010.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagcccaccctcggtgtcagtgtcctcaggacagacggccaggactcacctgctctggagatgcactgaccaaagcaatagtggttattggtacagcagacggcaggccacggtccccttagtcggtgaatataagtaacgacctagtgacggacggccctacgacggtactcccgtgacgcgtacttctcgtcggtcctccgtcctacgaacgggaacaaactacggtactacgttcgaacgtacctaagtacgtaagggtggtacgggtaccgggcgaacgggtaggggaacgggaggtacgtagttaacgttaactttaacgtacgtaacgtaactaaccgaaacgtaacggtaacgtaacgggtttaaggttaacgggtttacctttaagggttacggttaccgtaaccgggtttaacgggtttaccgggggaaccggggtaacgggtaaacccgtaaacggtccggtaaccgggtaacccggttaccgggtacggttacccggaccggaaccccggtaacggtcccgtacccggtacccccggtacggttcccaaccgtttccccgg

SEQ ID NO: 6474 - DNA, 765 bp, Homo sapiens
  misc_feature: GYAE6OF01CZBU5.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggactcacctgctctggagatgacactgaccaaagcaatagtggttatggtaccagcagagcaggccacggccccttagttcggtgatataagtaacgaccagtgaaggacggccctagacgggtactcccgtagacgcgtacttctacgtcggtccttcccgtccctacgacgggaaccaacgtacgtaccgtacggttgaactacgtactacgagggtacggtaacgggtcccgggacggaagggaacggggaacggaacgggtacgttaggtaaccgtttaacgtttaccgtacggtaacctaaacttaaccgaaaaccgtaagtaaccgtaagggtttaacgggttaacggtttaaccgttttaagtcgggttacgaacggttaacggggttacggggtaaccgggaacggggtaaacccgtaagggtacccgttacggtaaccccggttaccggttaacggggttaaccccgaacccgggtaaccccggtaacgggttaccccggtaaccccggttccccccggttaccgggtaccctacccggttttacccccgg

SEQ ID NO: 6475 - DNA, 704 bp, Homo sapiens
  misc_feature: GYAE6OF01DXAW8.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggccccttagttcggtagataatagtaaggaccatagagacggcctcgacggactaccccgtgacgcgtattctcgtcggtcctccgtcctacgacgggaacaacgtacgtacgtacgttagactcgactcgtaggtcggacggtccgggacgaagggacgggaacggtaggacgttacggtaaccttagttaactggtaacctaaagttaccaaacgaagtaaccgtaaggttaacggttaggttaaccgtttagttacggtacggtacgtacgggttacggggtacgggaacggggtaaccgtaaacggccggttaaccgggtaaccccggttcccgttaaacggggtcccgaaaccgggtacccccgtaaagggtccccgttaccgggtacccccccgttaccgggtcccgttaaccgtttcccccgg

SEQ ID NO: 6476 - DNA, 582 bp, Homo sapiens
  misc_feature: GYAE6OF01AVP7Y.52.78.H01.1.454.CMB.1.raw
  modified_base (425)..(425): a, c, t, g, unknown or other
  misc_feature (425)..(425): n is a, c, g, or t
  modified_base (493)..(493): a, c, t, g, unknown or other
  misc_feature (493)..(493): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagtttcgtttgggattggttgtcgttgccaccagctcgcccctaccggctgccttacttctatctcgtcgggccgtggccacctggtcactgtcttctcncgtccctccaccgacggccctacgtccggtcccttcccccgtcgccctacccctccgtaccaacgacnccgtacctcggtcggggccacgacggccggcccgtgggccgtcggccgtggtaccgtaacggtaccttacctttcccgtccgtctcggg

SEQ ID NO: 6477 - DNA, 596 bp, Homo sapiens
  misc_feature: GYAE6OF01ETDI5.52.78.H01.1.454.CMB.1.raw
  modified_base (371)..(371): a, c, t, g, unknown or other
  misc_feature (371)..(371): n is a, c, g, or t
  modified_base (426)..(426): a, c, t, g, unknown or other
  misc_feature (426)..(426): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaaatgagcagcctgacatccgaggacacggccgtgtattactgtgcgagagtttcttgggatgttgtcgttgcacagctcgcccctaccggctnctacttcgatctcgtcggggtccgtcggccacccgtggtcacgtgtcttctcacnccctcccaccgaacggcccagtcccggtcccttcccccgtcggccctacccctccctaccgaacgcgccacctcggtcggggccacgacggtcccggcccgtgggccctcggcccgttcgggtaccgtaaccgggtaccttaacccgtttcccgttaagtacccggtacg

SEQ ID NO: 6478 - DNA, 735 bp, Homo sapiens
  misc_feature: GYAE6OF01ELYRV.52.78.H01.1.454.CMB.1.raw
  modified_base (109)..(109): a, c, t, g, unknown or other
  misc_feature (109)..(109): n is a, c, g, or t
  modified_base (229)..(229): a, c, t, g, unknown or other
  misc_feature (229)..(229): n is a, c, g, or t
  modified_base (571)..(571): a, c, t, g, unknown or other
  misc_feature (571)..(571): n is a, c, g, or t
tcagcgcagtacgacacgaccggtgctcgatttagtgtgagtagtttgggtttgggggtgggtccaggaggcagaactctgggtgttctcaccatggcctggatccctntacttctccccctctcactctctgcacaggctcgtggggccttccgttatgaactgactacagccaccctggtgtcagtgtcctcaggacaggacgccaggatcacctgctcgtcggganatgctactcgaccaaagctaattagttggttaagttacgggttaccaggtaccgaaggtaacggtaccgtaacgggcccgaaccgggtaccccccttttaaggttcgggttacgtaacgttaacgttaacgttaaacgggaacccgtaaggttacggaagggtaccgggtacccgtacggaacgggtaacttacccgtaggacgtacggtacgtttccgtacgtacggtacttacccgtaccgttacgacgggtacaacgtacgtacgtacgttagactactacgtacgtaggtcggacgtcgggacaggacggacgaggtctagacttagttactgtacanacaacgagacgtagtaacggtgttaacgttagtggtacgtacgtacgggtacgggtcgggtaacggtaccgtaggtccgttacggtacccggttacggttaacgggtactaaccggtacccgacggttcctaccggccccgtttccggtcgtacccgttacccg

SEQ ID NO: 6479 - DNA, 697 bp, Homo sapiens
  misc_feature: GYAE6OF01EPUEB.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtccctcaggacagacggccaggatcacctgctctggagatgcactgaccaaagcaatatggttattggtaccagcaggaggccgaggccacggtcccccttagttcggtgatatataaggaccatggagacggccctacgacgggtactcccgtgagcgtattcgtcgtcgccttccgtcctcgacgggacaacacgtcgtacgttgactactagtcaggttggaacggtcccgggtacgagggaaccgggtagaacgggtcgtacgtaactttacgttacgttacggtactaaacttaccgaaacgaacgaccgtaaggtaagtttacggttaactttagttcggtacgtcgtaacgggtttccgggacgggtaaacgggaacccgtaacggtaccgttaccgggaaccccggttacgtaaccgggttccgaaccccgggtacccgaaacgggttaccccggtttccccggacccccccggttacggttccccgtaccggtttacccccgg

SEQ ID NO: 6480 - DNA, 569 bp, Homo sapiens
  misc_feature: GYAE6OF01B6GXR.52.78.H01.1.454.CMB.1.raw
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaaatgagcagcctgacatccgaggacacggccgtgtattactgtgcgagtagtttcgttgggatggttgtcgttgcaccagctcgcccctaccggctcgctacttcgatctcgtgggccgtggccnccgtgtcactcgtcttctcncgtccctccaccgacggccctacgtccggtcccttccccgtggccctacccctcccgtaccgaacgacgcctaccgtccgtcggggccacgacggccggccgtcggctcgcccgtggtacaacggtactaccttcctcgtcgtcgg

SEQ ID NO: 6481 - DNA, 539 bp, Homo sapiens
  misc_feature: GYAE6OF01DS6WU.52.78.H01.1.454.CMB.1.raw
  modified_base (327)..(327): a, c, t, g, unknown or other
  misc_feature (327)..(327): n is a, c, g, or t
  modified_base (362)..(362): a, c, t, g, unknown or other
  misc_feature (362)..(362): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattcggtgatatataaggaccatgagaggccctcagggatccctgancgattctctggctcctcctcacgggacaacagtcncgttgagtcatccagtggtagtccgggcaggaggacgaggctggactattactgtcaatcaacagacagtagtgtactatgtgatagttcggcggagggaccgaagcgtcgaccggttaccgtagggttccaggccccgaacggtccgtacggcccccctcgggttcacccgttccc

SEQ ID NO: 6482 - DNA, 282 bp, Homo sapiens
  misc_feature: GYAE6OF01ARZDN.52.78.H01.1.454.CMB.1.raw
  modified_base (280)..(282): a, c, t, g, unknown or other
  misc_feature (280)..(282): n is a, c, g, or t
tcagcgcagtacgacacgaccggtgctcgatttagtgtgagtagtttgggtttggggtgtgagtaggtttcgggtttggggtgtggtcggtcgtccaacgtcccgtccttcgacgaggctgactattactggtcaatcaacgagacagtagtggtacttatgtgcagttcggcggagggaccaagctgaccgtcctaggtcagcccaaggctgccccctggtcactctcgttcccgccctcctctatacgatcgctgagcgggctggcaaggcgcatagnnn

SEQ ID NO: 6483 - DNA, 782 bp, Homo sapiens
  misc_feature: GYAE6OF01DMQ29.52.78.H01.1.454.CMB.1.raw
  modified_base (228)..(228): a, c, t, g, unknown or other
  misc_feature (228)..(228): n is a, c, g, or t
tcagcgcagtacgacacgaccggtgctcgatttagtgtgagtagtttgggtttgggggtgggtccaggaggcagaactctgggtgtctcaccatggcctggatccctctacttcctccccctcctcactctctgcacaggctcgtgggcctcctatgaactgacacacgcccaccctcggtgtcagtcgtcctcgaggacagacggccaggatcacctgctcgtgganatgcactcgaccaaagcaaatagtaggttattacggtaccagcgagacggccgaacggccgaccggtacccccttagttacggtgtaagttaataacgtaaacggaacctagtggaagaccggacccgtacgacgggtactcccgtaggacgcgtacttcgtccgtcggtcctcctccgtaccgtaacgggaactaaccgtacgtaccgtacgtagtaactcgtaacgtcgtagggtacgggacgggtaccgggacgaacgggagggaacggtaacgggtctacggtaacgtttaacgtttacggtacgtaaccgtaataaccgtaaacgtaagtaaccggtaaggtttaacgtaacggtttaaccgtttagtaccggtttagggaccggtttaacggggttaccggggaccgggggtaaaccgggacgttaaaccgggaccggttaccggtaaccccggtaccggttaacggtacccgaacgggtaaaccccgtacggtccccggttaccccggtacccccggttccgggttaaccctccggtttacccccgg

SEQ ID NO: 6484 - DNA, 686 bp, Homo sapiens
  misc_feature: GYAE6OF01C8623.52.78.H01.1.454.CMB.1.raw
  modified_base (368)..(368): a, c, t, g, unknown or other
  misc_feature (368)..(368): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaaagcaatatggttattggtaccagcagaggccaggccacggccccttatggtgatatataagaccatgagacggccctgagggactccccgtgagcgattcgtctggcctcctccgacgtacgggaactaacncgtacctacgttagactacactcgaggtaggacgtcccgggacaaggacggaacggaggtacgtacgtacgttaattacgtcgtacctaaagtaccaaacgtacgaacgtaaggttaacggtaggtttaaccgtttagttggtacggtaccgtagggtttccggggaacgggtaaccgggtaaccgaaacggtccgtaccggtaaccccggttacccggttaaccgggttcccgaaacccgggtccccggtaaacgggtcccgttaacccccgggtcccccccgttaccggggttaccctaccccggtttacccccgg

SEQ ID NO: 6485 - DNA, 549 bp, Homo sapiens
  misc_feature: GYAE6OF01CN99K.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctggagatgcactgccaaagcaatatggttatggtaccagcagaggccaggccaggccccttattcggtgatatagtaaggaccatgagagccctgagggactccctagagcgattctctggctcctcctcgagggacaacgagtacacgtttagatcacgtcaggtggacggtccgggactaggaacggacgaggctagacttattactgtacaattcaagagaactaggtagtagttacttaagtgtacgcgtaaggttcggacggacggacaagctacggaccgtcgtaggcacgcccgaaggtcccacgtccccctcgtccacgttcccg

SEQ ID NO: 6486 - DNA, 684 bp, Homo sapiens
  misc_feature: GYAE6OF01DENRC.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctcgtgggcctcctatgaactgacacagccaccctcggtgtcagtgtcctcaggacagacggccaggactcacctgctcgtggagatgcactgaccaaagcaatagtggttatgtaccagcagagccaggccacggtcccttagtggtgatataagaagacagtgaagcgccctagagggactccccgtaggacgcggtaactttcgtcgtcggtccttccgtcccgtacgaacgggaaccaacgagtctaacggtttgaactcagtcgtacggtagggaccgggttacccgggagaacgggaagggaacggacggtacgtaggtaaccgttaacgttaaccggtagttaaccaaacgttaccgaaaacgtaacgtaaacgaacggtttaacggttagggtttaaccttaggttaggtccggtacggtagggttaccgggcgggtaaacgggtaaccgaaagttccgggtacgtaacccgtaccgtcggtaccaccggaacccgtacgggtccacccggtaccccgtcgtacccgtccttccccg

SEQ ID NO: 6487 - DNA, 683 bp, Homo sapiens
  misc_feature: GYAE6OF01CUFE4.52.78.H01.1.454.CMB.1.raw
  modified_base (674)..(674): a, c, t, g, unknown or other
  misc_feature (674)..(674): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccgaggccacggtcccccttattggtcgatatagtaacgacatgagacggccctacgacgggtactcccgtagacgcggtacttcgtccgttcggtccttccctccgttccgacggggaaccaaacgtaccgtacgtacgtttaggaactactacgtacgaggttacgggaccgggttccgggacggaagggtaacgggacggacgggtaccgtacggtacgttactttacgtacgtaacgtaacgtaccgtaaacgacgtaaccgtaaggttaagtacgggtttaacttagttgttacgtacgttaagggttccggggacggtacgggtaaccgtaacgtccgtacggtacccgtcgttacgggtacccacggtacccgacgtcccgtaccgtacccccgtcggtcccncgtttcccg

SEQ ID NO: 6488 - DNA, 703 bp, Homo sapiens
  misc_feature: GYAE6OF01B31JL.52.78.H01.1.454.CMB.1.raw
  modified_base (185)..(185): a, c, t, g, unknown or other
  misc_feature (185)..(185): n is a, c, g, or t
  modified_base (219)..(219): a, c, t, g, unknown or other
  misc_feature (219)..(219): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctctcactctctgcacaggctctgggcctctatgaactgacacagccacctcggtgtcagtgtccncaggacagacggccaggactcacctgctctgganatgcactgaccaaaagcaaatagtggttatggtaccagcagagcaggccacggccccttatggtgatactaataaggaccagtgagacggcctacgagggactcccgtgacgcgtatctctggcctcctcctcgaacgggaccaacgacgtcgtacgttagactacacgtacgaggtcgggaaggtcccgggagaaggacgggtaacgaggtaccgtaggtaacgttaacgtttacgtacggtaactaaacggttacaaaccgttaaggtaccgaacggttacgggttaaggttaacccgttttaagtacggttacggtaacggttaacggtttccggggaccggggtaaacgggggaacccttaaaacgggtcggttaaaccggtacccggttaccgttaacgggtccggaaccggttaccccggaaacgggtcccgttacccggtaccccccggtttcggtaccccgtacgtttacccccgg

SEQ ID NO: 6489 - DNA, 842 bp, Homo sapiens
  misc_feature: GYAE6OF01EM4DA.52.78.H01.1.454.CMB.1.raw
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccgaggggaaggggctggagtgggtggccagcgtgaagcatgagtggaggtgaggaagactagtgcggactctgtagaagggccgtattccacctacttccagagacaacatacaaagaactcaattgtaactctaccaaatgacgacacgcctagacctacgtaccggacggaccgaccgggtccggttaggttactttaccgtggtcggacggtaggtacgttttcggttttagggtagttttggttttacggttcgttacgacctacccgagtaccgttccggccccccgtaaccggtcttcgtaccctttacgtttcgacgtttccgtcgggtcgggggttccgtccgggtcccttaaccccggtcggttacctacggtttcctttccgttacctaccgacgtccccgtacccgaaaccccggtaccgggtaccccttaccggtttcccccggttaccccgtttccccccggtaccggtaccccctacccccccttaccgttaaccccgaaacgtaccccggtacccgttacccgggttccggggtcccggggaaccgtacccggtacccgggccccggggtaccccggttcggggtaccccggttaccggtcccggttaacgggttaccggtaaaccggttaccctttaacccgtttaccctttaaacggtacccgttacccggg

SEQ ID NO: 6490 - DNA, 740 bp, Homo sapiens
  misc_feature: GYAE6OF01AOXKQ.52.78.H01.1.454.CMB.1.raw
  modified_base (108)..(108): a, c, t, g, unknown or other
  misc_feature (108)..(108): n is a, c, g, or t
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
tcagcgcagtacgacacgaccggtgctcgatttagtgtgagtagtttgggtttgggggtgggtccaggaggcagaactctgggtgtctcaccatggcctggatccctntacttctcccctcctcactctctcgcacaggctctgggcctctatgaactgacacagcccaccctcggtgtcagtcgtcctcaggacagacggccaggatcacctgctctggagatgcactgccaaagcaatntggttaatgtacagcagaggcaggccncggaccccttatcggtgatatagtaacggaccatgagcggccctgagggactccgtgagacgtactctcgtcggtcctccgtcctcgacgggactaacgacgtacgtacgtgtacgtacacgttacgtacgggtcggtaacgggttccgggacgaacgggtacggaacccgggtaggtccgtaagggttaaccttaacggtttaccgtacggttaacctaaacgtaccgtaaacgtaacgtaaccgtaaggtttaacggtacgggttaacctttaaggtccggttaacggtacggttaacgggtttacccggggaacgggaccggggttaaccccggtaacggttaaccccgggtaccggtttaaaccccgggtccgttaaaccgggttaccggaaccccgggtaaccccgtaacgggtacccggtttcccccgtaccccccggttacggttccccgtacgttccccccggg

SEQ ID NO: 6491 - DNA, 575 bp, Homo sapiens
  misc_feature: GYAE6OF01CNU5R.52.78.H01.1.454.CMB.1.raw
  modified_base (426)..(426): a, c, t, g, unknown or other
  misc_feature (426)..(426): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctggtgtcagtgtcctcaggacagacggccaggatcacctgctctggagatgcactgaccaaagcaatatggttatggtaccagcagaggccaggcccacggcccccttattggtgtataatataaggacctagtgagacggccctacgagggactccccgtaggacgcgtaacttcgtcgtcggtcctcccgtcctaccgagggaccaaacgagtacgacgtttagactctagtacaggtggacgtccggganaggaggacgaggctagactatacgtgtacaatacaacgagacaggtacgttggtacttagtgtgcgtaggtcggacgggacggaccgaaagcgtacggaccgtcgtacgcgacgacccacggcctacgccccctggcccgtcgttcccg

SEQ ID NO: 6492 - DNA, 832 bp, Homo sapiens
  misc_feature: GYAE6OF01CA413.52.78.H01.1.454.CMB.1.raw
  modified_base (231)..(231): a, c, t, g, unknown or other
  misc_feature (231)..(231): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctcgtggggcctcctatgaactgacacacgccaccctcggtgtcagtcgtcctcaggacaggacggccaggactcgacctgctcgtggaagntgcacgtcgaccaaagcaatagttggttattggtaccagcgagacggaccgtacggccgaccggtcccccgtttagttcgggtataagtagtaacgtaacggacctagtggaacggaccgggtacccttcggaaacgggtaccgtaccccgtcggtaaacggtccggttaactttccgtccgttccggtacccttcccgtcccgttaccggaacggggaaaccctaaaccgtacgttaccgtacggtttacgacttacgtacgttaccggtaggggtacgggtacggggtacccgggaacggaacgggaacgggggaaccggaacgggtccgttacggttaaacctttacgtttaacgtaaccggttaactaacgtaaccgaaacggtaacggaacgttaaggttaacggttacggtttacgtttaagtcgggttacgtacggttaccgggttacggggaccgggggtaacgtaaccggtacgggtaccgtaaccgggtcccggtttacccgaaacggggttcccaaaccgggttaccccggaaccggttaccccggtacccccggtaccccgttcccggttaccgtccccgtttcccggg

SEQ ID NO: 6493 - DNA, 632 bp, Homo sapiens
  misc_feature: GYAE6OF01EQ21A.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactcgaccaaagcaatagtggttattcggtaccagcaggacggccgaggccacggcccccttattcggtagattataataacggaccagttggaaggacggcccttacggagggactcccgtagagacggtattctactcggaccttcctcccgtacgaacggacaaacgcgtacgacgttgatcgataccgagtgggacggtccgggagaacggagggacgacgggtcgtacgacgttaattacgtacggtactaactcaaacagagtagtaggtacgttattagtgtgtacgtcggtacggcgggtagggaaccgaggtaccgtacgggacccttagggttacggcgaccggacccgtaacggtccctacccggtaccccgttccggtcctcccgtttacccgg

SEQ ID NO: 6494 - DNA, 672 bp, Homo sapiens
  misc_feature: GYAE6OF01A0R03.52.78.H01.1.454.CMB.1.raw
tcagcgcagtacgacacgaccggtgctcgatttagtgtgagtagtttgggtttggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactcgaccaaagcaatagttggttattacggtaccagcaaggacgccgaacggccaccggtcccccttagttcggtagtactagtacgtaaggacctagtacggaggacggtacccgcgaacgggtactcccgtaggacgacgtacttcgtcgtcggtccttcccgtccgtacgacggaccaacgtacgtactacgttagtatacatacgagtacgggacggtaccgggagaggtacgggacgtacggtacgtagtaacgttaagtttacgtacgtaacgaaaccgttacgaaacaacggtaaccgtaagggttaacgttacggttaacgttgttaggtacgtacgtacgggtcgggacggacgggtaacgagtcgtaccggtaccgtacggttacgcgaaccgacccgacggtcccacccgtcccccgtgtcccgtcgttccccgg

SEQ ID NO: 6495 - DNA, 746 bp, Homo sapiens
  misc_feature: GYAE6OF01DKNDS.52.78.H01.1.454.CMB.1.raw
  modified_base (297)..(297): a, c, t, g, unknown or other
  misc_feature (297)..(297): n is a, c, g, or t
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccgagggaagggctggagtgggtgccagcgtgaagcatgatggagtgaaggaagactatgcggactcgtggtaggaagggccgatttccacctacttccagacgaaccaacatacaaagactcaatgtactcctaaccaaatgancagcctagaccagtcccggaaggaccgaccgggtccgttagttactttaccgtggtcgacggtagtacggttttcggtttgggatttcggtttggtcgttnccaacgtgtccgtccgtaccccgtaccggtntacgtcctttacgtcgtactcgtcgggtcggggtcccgtcggtcccaccgggttggtaccttcgttcgtttccttccgtacgaccgtcccctaacccgaacccggaaccggtccccttacgttcccggttccccttccccggccggtacccctacccccttcccgtaaccgaacggtccaacccgtcccggtacgggtccgggtacccaaccggtccgggaccccgggtcccggtcgggtacccgttccgggtaccggttacgggtaacccgtaaccggtttaacccttaccgttaacccgtacgtacgtacccggg

SEQ ID NO: 6496 - DNA, 740 bp, Homo sapiens
  misc_feature: GYAE6OF01D246X.52.78.H01.1.454.CMB.1.raw
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
tcagcgcagtacgacacgaccggtgctcgatttagtgtgagtagtttgggtttgggggtgggtccaggaggcagaactctgggtgtctcaccatggcctggatcccctctacttcctcccccctcctcactctctgcacaggctcgtcgggcctctatgaactgacacacgcccacccgtcggtgtcagtcgtcctacgaggacacgacggccaggatccacctgcttcgtaggagagtcgaccacgtcgaaccgaaagctaattagttaggttacttacggtaccacgacgaaggacggaccgacggaccgaccggtaccccctttagttggtagattaacgtaagtaacggacctagtgaggacggccctaggacggtactcccgngacgtcgtattccgtntcggctcccgtctcgacggacaacgtcgtcctacgtcgtactctacgtacgtagggtacggtacgggtcccgggaagagggaaacgggtacggacggtcgtaacgttacgtttactttacgttacgtaactaacttaccgaacgaacgtaacgtaggttaacggtacggtttaacgtttagtggttacgtacggttacgggttccggggaacgggtaaccgggaaaccgtacgtaccggtaccgggttacccgtacgggttacggtacccgaaccgttacccggaaccggttccgttaccccgacccccggttaccgttccgtaccctttccccgg

SEQ ID NO: 6497 - DNA, 627 bp, Homo sapiens
  misc_feature: GYAE6OF01AQYIN.52.78.H01.1.454.CMB.1.raw
  modified_base (178)..(178): a, c, t, g, unknown or other
  misc_feature (178)..(178): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtntcagtgtcctcaggacagacggccaggatcacctgctctggagatgcactgaccaaagcaatattggttaattggtaccagcagaggccaggccacggccccttagttggtagatatataacggaccagtgagaggccctcgaagggactcccgtgacgcgtattctcgtcggcctcctcctcgagggacacacgtcacgttgatcatcaggtggacggtaccgggacgaggagggacggacgggtacgtacgtaacttactttacgttacgtacgtaactacgaaccaagaacgtaacgttaagttacggttaactttagttgtacggtacgtacggttccggggacgggtaacgggaccgtaacggccgtacggacccgttaccgtaggtccgtaccggacccgacggtacccgtccggacccccgttccggtccgtcttaccccgg

SEQ ID NO: 6498 - DNA, 644 bp, Homo sapiens
  misc_feature: GYAE6OF01B9V3T.52.78.H01.1.454.CMB.1.raw
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
tcagcgcagtacgacacgaccggtgctcgatttagtgtgagtagtttgggtttgggggtgggtccaggaggcagaactctgggtgtctcaccatggcctggatccctctacttcctccccctcctcactctctgcacaggctctggggcctcctatgaactgacacagcccacccctcggtgtcagtgtcctcaggacaggacggccaggactcacctgctctggagatgcactgaccaaagcaatgtggttattggtaccagcagaggccgaggccacggccccttattggtgatatataagaccatgagcgaccctcgagggtactcccgtgacgcgtattcgntcggcctccgtcctacgaggacaacgngtcacgttnacgtcatcgagtcggacggtccgggcgaagggagggacgaacggtcgtacgtaagttacgttaccgttaggtacctaaagttaccgaaacgagaaccgtaagttaacggttacggttactttaggtagttcgtaagtcgggttacggaggggtacggaacccgtaagggtccgtaccggtacccgttaccggtaggttaccgaaccgaccccgtaaggtccccgttacccggacccccgttcggtcgtccctttaccccggg

SEQ ID NO: 6499 - DNA, 747 bp, Homo sapiens
  misc_feature: GYAE6OF01DK4NT.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctcgtggagatgcactgaccaaagcaatagtggttatggtaccagcagaggccacggccacggtccccttagttggtgatataagtaaggaccagtagagacggccctacgagggtactcccgtagacgtacgtattcgtcgtcggtcctccctccgtacgaacggaccaaacgtacgttacgacggttagacttactagtaccgtagggtcgggtacgggtcccgggtacgaacgggaacggggaaccggtacgggtacgttaacggtaaccgtttaagtttaccgttacgggttaacctaaacgttaacccgtaaaccgaacggtaaaccgtaacggggtttaacggtttaagggtttaaaccgtttaggtttaggtacgtaccggttaacggggttccgggtacggggaaccgggtaaccgaaacggtccgtaaccggtacccggttaccgttaccgggtaccgtaacccggacccgaacggtcccgtaccccgggtaccccgttccgggtacccgttccgttaccccgg

SEQ ID NO: 6500 - DNA, 890 bp, Homo sapiens
  misc_feature: GYAE6OF01DLTP6.52.78.H01.1.454.CMB.1.raw
  modified_base (147)..(147): a, c, t, g, unknown or other
  misc_feature (147)..(147): n is a, c, g, or t
tcagcgcagtacgacacgaccggtgctcgatttagtgtgagtagtttgggtttgggggaggcttggtccagccgtggggggtccctgacactctcctgtgtagcctctggattcaccttcagtacccatagaatgcactgggtcccnccaggctaccaggcgaaggggctgggaggtgggtgactagttatactcctatgagtaggaagacaataagcacgtacgacgagtacggtaccgtaggaacgggaccgtaagttcgacctacttcctaccgaaggacaaccaacgttacggaaaagtaacgttaccggtttactttacaaactaaacgtaacgaacaacgtacctaggaagacgtcgtaggaacgaccgacggtacttagtttcgtttaacgtggtacggacggtaagggtaacggtaaaccgtcgtaaacgttacgacgtaccgaaccggtacccctaacggaaaacgtaactacgtaactaaggtcgtaagttcggtttactttaggtactttaacggtaccgggttacggggaacccggaaacgggtaccttaaagggttcggttacgttacgttttacgttacccttgttacccgaccgtaccccgttaacccggaaacccgggtaaccgggttaccccttaacgggtttcccccggttaccccgtttcccccgaacggtaccccctaacccccggtttactaacccggaacggtccgtaccccgttacccgggtacggggtaacccggggtaccaaccggggtacccgggttccccgggtaccggtcgggtacccgttccgggtacccggttacgggaaacccgttaaacccgggtttaaccctttaaccgttaccccggttaagttaaccggtacccg

SEQ ID NO: 6501 - DNA, 747 bp, Homo sapiens
  misc_feature: GYAE6OF01CZYMT.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcgaggacagaccggccaggactcacctgctcgtggagatgccacgtcgaccaaagactaatagttaggttacgttggtaaccaggacacggaggtaccgacggacccgacggttccccttagttacggtagattataagtaacggaccagtggacgaccggtccctacggacgggtactcccgtagacgtcgtacttcgtcgtcggtcctccgtccgtacgacgggaactaacgacgttaccgtacggtttgactacgtacgttacggtacgggtacgggtaccgggtacccgggacggaaaggacgggggaacggtacgggtacgttaacggtaaccgtttaacgttaccgttacggttaaacaactaccgaaacgacgtaaacgttacggttaacgggttacgggtttaactttacggtaggttcgtacggttacgggttccgggaacgggtaaccggggtaaccacggtcggtacccggtaccggtcggttaacggtcgacccggtaaccgacggtcccttacccggcccccgttacgtacccgtccgttacccg

SEQ ID NO: 6502 - DNA, 799 bp, Homo sapiens
  misc_feature: GYAE6OF01DL502.52.78.H01.1.454.CMB.1.raw
  modified_base (200)..(200): a, c, t, g, unknown or other
  misc_feature (200)..(200): n is a, c, g, or t
  modified_base (480)..(480): a, c, t, g, unknown or other
  misc_feature (480)..(480): n is a, c, g, or t
  modified_base (684)..(684): a, c, t, g, unknown or other
  misc_feature (684)..(684): n is a, c, g, or t
  modified_base (713)..(713): a, c, t, g, unknown or other
  misc_feature (713)..(713): n is a, c, g, or t
  modified_base (746)..(746): a, c, t, g, unknown or other
  misc_feature (746)..(746): n is a, c, g, or t
tcagcgcagtacgacacgaccggtgctcgatttagtgtgagtagtttgggtttgggggtgggtccaggaggcagaactctgggtgtctcaccatggcctggatccctctacttcctcccctcctcactctctgcacaggctcgtcggggcctcctatcgaacgtgacacacgcccacccgttcggtgtctagtcgttccncgaaggacgacggaccggaccaaggactccacctcgtccgttcgtagggaagtacgtcgccaacgttccggaccctaaaaagactaaagtttaaggtttggggttttacttaaccgggtaaccgtaacggaccgaacgggaccgggaccccgaacgggacccgtaccggttaccccgttttaaggttcggtagtaaactttaacggtaaacgtaaacgggaacctaggtacgggaaccgtaccggtccctaacgggacgggtaccgttcccgagggtacngtacttcgtcgtcgtcctcccgtacgtacggaaggaacacggtacgtccctagttacgtaactcgtaacttcgggagggttacgggaccggggtacccgggaaggtacgggaaacgggtccggtaggtacgttaacgtacctttagtacgttacgtaccgaacttacgaaacgctaaggtaggttaacctagttaactggttcncggtactcgggtacgggacggaaccgacncgtacggacccggtttgacccgttaggtacccncccgggaacgttcggacccaccccggttccctaggtccccgtaattcccccgg

SEQ ID NO: 6503 - DNA, 683 bp, Homo sapiens
  misc_feature: GYAE6OF01AUYHI.52.78.H01.1.454.CMB.1.raw
  modified_base (542)..(542): a, c, t, g, unknown or other
  misc_feature (542)..(542): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggactcgacctgctcgtggacgatgacactggaccaaagcaatactggttattcggtacctagcaggacggccgtacggccgaacggtccccttaagttggtcgtaatagtagtaaacggaccagtacgaaggacggcccgtagacgggtactacccgtaggactacggtacttccgtcgttcggtccttcccttccgtacgtaacgggacctaaacgtacgtaaccgtacggttacgacgttacagttaccgaggttcgacgggggggttaccgacggtaacgggacgggaacggtaacggcgtagaacctttaagttacgtacgtacaataccgaanagaaccgtaagtaggtacgttacttagtacgtagacgtacggtacgggacggacggaacgacgtacgtacggccgttacggtcggtaccgaccggtaccgacggtaccgtacccggtccctccggtccgtcgttaccccgg

SEQ ID NO: 6504 - DNA, 664 bp, Homo sapiens
  misc_feature: GYAE6OF01BHVCO.52.78.H01.1.454.CMB.1.raw
  modified_base (224)..(224): a, c, t, g, unknown or other
  misc_feature (224)..(224): n is a, c, g, or t
  modified_base (292)..(292): a, c, t, g, unknown or other
  misc_feature (292)..(292): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctctcactctctgcacaggctctggggcctcctatgaactgacacagccacccgtcggtgtcagtgtcctcaggacagacggccaggatccactgctcgtagganatgcactgaccaaagcaatagttgttatggtaccagcagaggccacggccacggtccccttagttggngaatataagtaacggaccatacggagacgcccgtagaaggtctccgtggacgtacgtacttcgtaccgtcgtcctccctcgtacgaggacaaacctgtactacgtagtattcaagtacgaggtaggacggtaccggagacggaaggtacggacgtcgtaacgaccgtttaattacgtcgtaactaagtaaccgaacgtacgaacgtaggttaaccgtaggtttaacttagggtcgttaaccggaggttaaccgggtggggaaccggttaacgggaaaccgtacgtaccggtaccgtaaccggttaccggttacggaacgaccgtaacccaggttccccgacccgttccccgtacggtaccttcggtaccccc

SEQ ID NO: 6505 - DNA, 604 bp, Homo sapiens
  misc_feature: GYAE6OF01CLZC5.52.78.H01.1.454.CMB.1.raw
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagagcctcngggatccctgagcgattctctggctcctcctnagggtacaacagtcacgttgatcatcagtggacgtccgggacaggaggacgaggactgaacttattaactcgtacaaagttaccaaacgacgaaccgagttaacggtagggttaacctttaagtgttgcttaacggtttcgggacgggtaaggggaacccaaaggtctacggaacccggtttaccgaagggttccgaaccggtaccccgaaagggtcccgtaccgtacccccccgttcggttccgaacccgtttccccgg

SEQ ID NO: 6506 - DNA, 776 bp, Homo sapiens
  misc_feature: GYAE6OF01C6V3X.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctcgtggggcctcctatgaactgacacacgccaccctcggtgtcagtgtcctcgaggacagacgccagatcacctgctcgtgagatcgcactgaccaaagctaatagtagttacttaggtaaccagacgaggacggccgacggacccgaccggtacccccttagttaggtacgagttaataagtaacgaaccagtagaggacggccctacggacgggtactcccgtagacgacgtacttctcgtcggtcctcccgttaccgtacgacgggaactaaacgtacgtacctacgttagtactactacgtacgtacgggttaggaccgggttccgggacgaacgggacggggtaaccggacgggtacgttaaccgggtaactttaacgtttaccgttacgttaaccaacgtttaacgaaaccgtaaggtaaccgtaagggttaacggttacgggttaaactttagggttacggtacggaacgtttacggggtacggggaaccggggtaaaccgggtaccgtaacggtcccggtaacggtaaacccggtttacccggtacgggtaaccgaacccggtaccccggaaacgggtcccgttacccggtacccccgttaccgggtacccttaaccgtttaccccgg

SEQ ID NO: 6507 - DNA, 713 bp, Homo sapiens
  misc_feature: GYAE6OF01CHWAI.52.78.H01.1.454.CMB.1.raw
  modified_base (235)..(235): a, c, t, g, unknown or other
  misc_feature (235)..(235): n is a, c, g, or t
  modified_base (443)..(443): a, c, t, g, unknown or other
  misc_feature (443)..(443): n is a, c, g, or t
  modified_base (479)..(479): a, c, t, g, unknown or other
  misc_feature (479)..(479): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctctcactctctgcacaggctcgtgggcctcctatgaactgacacacgcccacccgtcggtgtcagttcgtcctacaggacagaccggccgtaggactccaccgtgtctcgtgganatgctactcgaccaaagctaatagttggttattcggtaccaggactaggacggacgacggccgaccggtccccttagtcggtagtaagtataacgtaaggtaccagtacggacggtaccggtccctaggaacgggtactcccgtaggaccgtcgtattcgtccgtcgtcctccctcgtacgaacggactaacacgtacgtacgtttanacttactagtacgaggttacgggacggtaccggganagggaacgggtacggaggtcgtaacgtaacgtttacgtaacgtttcgaaaccttaacggaacaaacggtacgtaaccgttaaggttacggttaacggttaccgtttaagtggtaccggtagttacgggtacgaacgggtacggaactacgggtccgtaacggtcccggtactacgggtcgaccccggcgtacggtaccctccccggtacccgtccggttccgtcccttcccggg

SEQ ID NO: 6508 - DNA, 815 bp, Homo sapiens
  misc_feature: GYAE6OF01D670P.52.78.H01.1.454.CMB.1.raw
tcagcgcagtacgaacacgaccggtgctcgatttagtgtgagtagtttgggtttgggggtgggtccaggaggcagaactctgggtgtctcaccatggcctggactccctctacttcctcccctctcactctctgcacaggctcgtcgggcctctatgaactcgacacacgcccaccgttcggtagtacgtacgtcgtcctacgaacgggacacggaccggaccgaaggtactaccgacctcgtacctcggtaggagtactaggacctacgtacgaacgtaaaacgacttaaagttaggtttaggttaaggtttaccggaacgaacggacgaacggaccggaccggacggtacccgtaaccggttacccgtttaggtacggtaagttaaacgtaacgtaaacgtaaaccggacgtaacgtacgggaacggtaccggtaccggtacggaaccggttacgtccggtacgtacggtacgttacgttcgtacgtccgtccgtaccgtacgtacggaacggtaacgaacgtacgtacgtactacgtacgtcgacgtacggacggtacggtacggtacggacggacggaacgggtacgtacgtacgttaacgtacgttaacgtacgtaacgtaacgtaacaacgtaacgaacgtaagtacggttaagttacgtagttacggtacgtcggtacggtaacgggtacggaaccggtaacggtaccggtaacggtaccgtaaccggttaccgttacggtaacgtccgaaccgaaccggtaccgtcccggtaccccggtacccgttaccggttccctccgttacccg

SEQ ID NO: 6509 - DNA, 806 bp, Homo sapiens
  misc_feature: GYAE6OF01CPHG9.52.78.H01.1.454.CMB.1.raw
  modified_base (233)..(233): a, c, t, g, unknown or other
  misc_feature (233)..(233): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctcgtgggcctcctatgaactgacacacgccacctcggtgtcagtcgtcctacacggacacggaccgccgaggactcgaccgtgctcgtggagntcgacacgtcgaaccaaagcctaagtagtttaggttacttaacggttaccgacgtaccaggacgtaccgaacggacccgaaccggttcccccttaagttacgggtacgaattaacgtaacgtaaccgggtacctagtacggaacgacccggttacccgtagaacgggtacccttacccgttggaaccgtccgtaacgttccgtcggtacggtccgttccgtacccgttaggaccggggtaaacctacgtacggtaccgtacgtttacgactacaacgttcgaagtcggaccggtcggaccgaggacgggtgaacgtcgtaacgttaccgtattacgttacgtaacgtaacttacccgaagaactaacgggttaaccgttagggttaaaccggttttccttaaagggttcgtaaccggtcggttaacggttccgggtaacgggaaccgggttacccaagggttaccgtaccgggtaccccgttacggttaaccggaccgtaacccgggtaacccgtacgggtcccttaacccccgggtacccccgttcggtaacccgttccccggtttccccgg

SEQ ID NO: 6510 - DNA, 870 bp, Homo sapiens
  misc_feature: GYAE6OF01CU8YS.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctcgtcggggcctcctatcgaactgacacacgccacccgtcggtcgtcacgttcgtcctcgaggacaggaccggccgaggactcgacctcgactcgtggagatcgcacgtcgaccaaacgctaatacgtggttacttggaacgacgcaggacggtccacgggaccgaccggtccccttaggttaggtcgaattaacgtaagtaaacggaaccagttacggaacggtaccgggtccctacggtaacgggtaccttaccccggtaggtaccggtacgttaacgtttccgtaccgttcggtcccgtacccgttaccgttaccggaacgggaaccgttaacgtacggttaccgtaacggtttagaacgtacctaacgtacgggttacgggtacgggttaccgggaccgggacgggtaagggacggggtaaccggtacgggtaacgttaacggtaaccgtttaacgttacgtcggtaaaactaacccgtaacgtaaacgtaacggaaacggttttaacgggttaaacggttaacgggtttaaccgtttaggtacgggttaccgttacggtacggggggtttccgggaaccggggttaacgggacccaaaggtttccccgggtaaacggttaccgggtacccggttaaacgggtcccggaaacccggtaacccggtaacccgggttcgggtaccccccgttaccccggttacggtaccccgttacggtttccccccgg

SEQ ID NO: 6511 - DNA, 718 bp, Homo sapiens
  misc_feature: GYAE6OF01BG31W.52.78.H01.1.454.CMB.1.raw
  modified_base (289)..(289): a, c, t, g, unknown or other
  misc_feature (289)..(289): n is a, c, g, or t
tcagcgcagtacgacacgaccggtgctcgatttagtgtgagtagtttgggtttgggggaggcttggtccagcctggggggtccctgacactctcctgtgtagcctctggattccacctttaacagttattggatgacttgggtccgccaggctccagggaaggggctggagtgggtggccagcgtgaagcatgatgggaggtgaggaagactatgcggactctgtggaaggccgattcacctacttccagacgacaacatacaaagaactcaatgtatctacaaatgancagcctgacatccgaggaccacggcgtgtatactgtcggacgagtagtttcgttgggtattggtttcggtcgttcgacctaaccgtagtccgtccgtccccgtacccgggctcggtcccttacgtttcgacttccgtccggtcgggggtccgtcggaccctacccgttggtacctacgttcgttccttcctccgtaccgtaccccttacccgaacccggtaaccgggtcccctaacggttccccggttcccctttcccccgtcggtacccctaccccgttaccctacccgaacgtccgaccctacccggtccgggtccgggggacctaccggaccgggtcccgggtcccggttcggggccgttccgggtacccgttcgggtaaccgtaaacggttaccttacccgtttaccgtaaacgttcccggtacg

SEQ ID NO: 6512 - DNA, 784 bp, Homo sapiens
  misc_feature: GYAE6OF01B08FY.52.78.H01.1.454.CMB.1.raw
  modified_base (422)..(422): a, c, t, g, unknown or other
  misc_feature (422)..(422): n is a, c, g, or t
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
tcagcgcagtacgacacgaccggtgctcgatttagtgtgagtagtttgggtttgggggtgggtccaggaggcagaactctgggtgtctcaccatggcctggactccctctacttcctccccctctcactctctgcacaggctcgtcgggcctctactagactgaaccacacgcccaccgtcggtcgtactaggtcgtccgtacgaaggaccgaaggaccggcaacggtactccgaccgttggacctcgtagggaagtagtacggactacgtacggaacccaaaaggaccttaaagttaggtttaaggtttagttaccggtaacgacgacgaaggcggaccgacggccgaccgttcccgttagtcggtaatattaagaacggtacgaacagtacgacggtaccggaccgtcgacggactccgngacggtactcgttacgcggtccgtacctaccgtcacggtaacgacaacgtcgaacgtacgttnaaactgacgtacggngtcgggaccggtacggacgtaagggacgaacgggagttacgaacggttaactaagtttacccgtagtaaaccgaacgttaacaaacggataaccgaggttaccggtttagtttacgttaacgttcgtaaccgtttacggtacccgaaacggttaaccgggtacggaaacccgtagggtaccccgtttaacgggccctaaaggtcccggaaacccgtaacccgaaaccccggtaaccccgtacgtacccttacccggaacccgtttccgttccggtttaaccccc

SEQ ID NO: 6513 - DNA, 685 bp, Homo sapiens
  misc_feature: GYAE6OF01D6JNB.52.78.H01.1.454.CMB.1.raw
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
tcagcgcagtacgacacgaccggtgctcgatttagtgtgagtagtttgggtttgggggaggcttggtccagcctgggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattccaccacttccagacgacaacatacaagaactcaatgtatctaccaaatgagcagcctgacagtccgaggacacggccgtgtattactgtgcgagtagtttcgttgggattgttgtcgtgcaccgnctcgccccgtacccggntcgctacgttcgactcctcggtcggggtccggtcggtcccaccgtcggtctacgttcgttccttctccacgtcccgtacccgaaccgaaccgggtcccctacgttcccggttccccgttcccccgtcgggtacccctacccccttacccgtaaccccgtaaaggacccgtacccgtacccgttccggtacgggggcctaccggaccggtcccgggtcccccggtgggtcccgtcggtcccggttacgggtaacccgtaaacgggttaacccgttacccgtttacccgttaacgtaccggttaccgg

SEQ ID NO: 6514 - DNA, 937 bp, Homo sapiens
  misc_feature: GYAE6OF01AXNVP.52.78.H01.1.454.CMB.1.raw
  modified_base (162)..(162): a, c, t, g, unknown or other
  misc_feature (162)..(162): n is a, c, g, or t
  modified_base (316)..(316): a, c, t, g, unknown or other
  misc_feature (316)..(316): n is a, c, g, or t
  modified_base (376)..(376): a, c, t, g, unknown or other
  misc_feature (376)..(376): n is a, c, g, or t
  modified_base (503)..(503): a, c, t, g, unknown or other
  misc_feature (503)..(503): n is a, c, g, or t
  modified_base (542)..(542): a, c, t, g, unknown or other
  misc_feature (542)..(542): n is a, c, g, or t
  modified_base (782)..(782): a, c, t, g, unknown or other
  misc_feature (782)..(782): n is a, c, g, or t
tcagcgcagtacgacacgaccggtgctcgatttagtgtgagtagtttgggtttggggagcttggtccagccgtggggggtccctgacactctcctgtgtagcctcgtggacttcctaacccttttaactagtttaatttgggatggtaccgtttgggtcccnccaggtcctaccggaagggggaagggggtctagggtagggttggggtacggacccgaggtcggtagaacgctaagttgaggtgggagggtaggagggaaactactgtcggcggacttcgtggagggaacggccttataccacctacttaccganaacgacaacactacaaataactataatgttactacctaacaataggctaccgactcgtanacgaccgtccggaacggaccgccgggtcgttactttagtaccgtaggtcggtacgtagtttggttttacgggttgtagtttcgggttcgtttcgaccgacacgttcgcctaccgtcccccggttacncgttactccgttaactaccgcgtttccggttacgggggngggttcccccgtacgggtacccccgttaccgggtttaggtttcccctacttccgtttttacccctccgggttaaccctacccgttccccccggaacccgtacccgggtaaacccccggggtttccccttcccgggttttcccccgttacccccttcccccggtaaccgttaaccccccttacccggtttaccccgggtaacgaaacccgggttccgtaccccccgggttttaacccgggngggggtccccggtaaaactcccggggtacccccgggttcccgggttaccccgggtcccgttacggttcccggggtaaccgtaaccccgggtttacgtaaaccccggggttttcccccttaagggttttccccaaccgggttaccctcccccgggg

SEQ ID NO: 6515 - DNA, 961 bp, Homo sapiens
  misc_feature: GYAE6OF01BSU3Q.52.78.H01.1.454.CMB.1.raw
  modified_base (146)..(146): a, c, t, g, unknown or other
  misc_feature (146)..(146): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttcgggtccncaggctccgaggggaagggctggagtgggtgccagcgtgaagcatgagtgggaggtgaggagactagtgacggactcgtggtggaacgggcctacttccaacctactaccgagtacgaacaactatacaagtaactcgtaatgtactacctaccaaagtgacgacacgtacctacggaacctacgtaccggaaggaaccggtacccggtacccgtaacctttacgttttaaccgtaacgggtaaaaccggtaaaaacggtaaccttaacccgaaccgaacggtacggtccggtaaacgggtaaccggggtaaacgggaacccgaaaaccccgggaaacggggtacccgttaaaacctttaccggtttttaccgtttaaccggaaaccggtttaaccgggaccgggggggtaacccccgtaaaacggggtaaccccgttccggttaaccccgttaacccggtttcccttaaaccccggttccgtaacccggtacccccttaaccccgggaaaacccggtaccgggacccccgtttaaacggtttcccccgggtttaacccccgttcccccccggtacgttacccccgaacccccgttttaccccgaaccggtaacgtcccgtaacccgttacccgggtcggggtcccgggaaacccctaccgggttcccgggtcccgggtcccggttacggacccggtttaccgggtacccggttacgggttaacccggaaaccgtttccctttaacccgggtttacaaaccgggttacaccggttacggacccgttagggggaccgtccggggtcaaaccggggg

SEQ ID NO: 6516 - DNA, 770 bp, Homo sapiens
  misc_feature: GYAE6OF01BQO2D.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctggtgtcagtgtcctcaggacagacggccaggactcacctgctcgtggagatgccactcgaccaaagtcctaatagttggtttaattcgggtaacccaggcgaacggacggccgacggcccgacggtcccccttagttcggtagataagtaacgtaacggacctagtagacgacggtaccctacgacgggtacctccccgtagaccggtacgtacgttaccgtccgtacggtccttaccccgttccgtccgaaacgggtaaccaaccgtagtcgtacgttgactctactcgaggtcggacggtccgggtacgaggtacggacggacgtcgtacgaacgttagttaccgtagtacctaaactacgaaactacggtaaccgtaagggttacggtttaacggttaacgtttaacgttcgggttacgtccggtttaacgggttccgggggaaccggtaaacggggtacccgtaaacggtcccgttaaaccgggtacccggttaccccggttaacgggttacccgtaacccggaccccggttaaacccggtcccgttacccccgggccccccgtttacgggtcccgtaccgttttcccccggg

SEQ ID NO: 6517 - DNA, 841 bp, Homo sapiens
  misc_feature: GYAE6OF01CQ3CC.52.78.H01.1.454.CMB.1.raw
  modified_base (109)..(109): a, c, t, g, unknown or other
  misc_feature (109)..(109): n is a, c, g, or t
  modified_base (138)..(138): a, c, t, g, unknown or other
  misc_feature (138)..(138): n is a, c, g, or t
  modified_base (165)..(165): a, c, t, g, unknown or other
  misc_feature (165)..(165): n is a, c, g, or t
  modified_base (240)..(240): a, c, t, g, unknown or other
  misc_feature (240)..(240): n is a, c, g, or t
tcagcgcagtacgacacgaccggtgctcgatttagtgtgagtagtttgggtttgggggtgggtccaggaggcagaactcgtgggtgtctcaccatggcctggatccctntacttcctccccctctcactctctgcacnggctcgtcgggcctctatgaactgacncacgccctacccgttggtgtcagttcgtactcgaggacacggcggccaggtactccaccgtgcctggtaggacgntcgccacgtcgaaccaaaggctaattgttacgttacgtcgtaccgagcgtaacggcgaccgcggaccgttaccggtaccccgtttaaggttcggtagtaacttaagttaacgaaaccggtacctaaggttacgggaacggaacccggtcccgttacggacgggtaccgttccccggaaggtacggtacgtttaccgtttcgttcggtaccggtttcctacccgtttacccgtaacgggtaacgtaaccggtaaccgtacggttaccctaacggtttacgtaacttacgtacgttaacgggtacgggttaacggtaccggggtcccggtaaggacgggaaccggtacggtaccggtacgttaacgttacttaagttaccgtacgtaactaaccgtacgaaacgtacgtaagtacggttacgttacgttaagttacgtggttacgtaacggttcgggacggtaaccggcgtaaacggtccggttaacccggtaccggttaaccggtaggttaccccggacggttaaccccggtacccggtccccggttaccccggtaccccgttccggaacccgtttcccggttccccggtttacccccccgg

SEQ ID NO: 6518 - DNA, 772 bp, Homo sapiens
  misc_feature: GYAE6OF01BD4LS.52.78.H01.1.454.CMB.1.raw
  modified_base (145)..(145): a, c, t, g, unknown or other
  misc_feature (145)..(145): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccnccaggctccagggagggctggagtgggtggccagcgtgaagctatgatgggaggtgaggtaanacgtatggccggacttcgnggtggaacggggtccctattccaacccgtacttacccgaagacgaaccaactagtaccaaaggaacttccgaaattggtaacttccctaccaaaattggaacgtccacggtccctgaactacgtccggaggaccaccgggtccgtagttacttacgtgtcgcggtaagtacgtttcgttaggggatttggttcgttcgttacgcaccgtaggcctcggcccccgtaccggtactcgtaccgttacttcggactttcgtaccgggtcggggggtcccgtggccctacccggttgggtaccctacggtttcgttcccttagcccgaccgtccccttaccggaacccggaacgggccccttacgtttccccggtcccccgtttaacccctccggtaccccctacccgtccccgtaccggtaacgacccgtccgtaccccgtggggttacccggggcctacgaccccggggccggtcccccgtgggtccctcccgggtccgtaggttacccggaaacgtacccgtttacttccgtaaggtcccgtacgg

SEQ ID NO: 6519 - DNA, 505 bp, Homo sapiens
  misc_feature: GYAE6OF02HNAP1.52.78.H01.1.454.CMB.1.raw
  modified_base (313)..(313): a, c, t, g, unknown or other
  misc_feature (313)..(313): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagccaccctcggtgtcagtgtcctcaggacagacggccaggatcacctgctctggagatgcactgccaaaagcaatatggttattggtaccagcagaggccaggccaggcccccttattggtgatatataaggaccatgagaggccctnagggatccctgagcgattctctggctcctcctcagggacaacagtcacgttgatcatcagtggagtcgggcagaggacgaggctgactatactgtcaatcaacagacagtagtggtactatgtgcagttcggcggtaggaccagctaggaccgtcctaggtcacgcccgaaggctcgcccctcggtcactcg

SEQ ID NO: 6520 - DNA, 555 bp, Homo sapiens
  misc_feature: GYAE6OF02IGACS.52.78.H01.1.454.CMB.1.raw
  modified_base (403)..(403): a, c, t, g, unknown or other
  misc_feature (403)..(403): n is a, c, g, or t
tcagcgcagtacgacacgaccggtgctcgatttagtgtgagtagtttgggtttgggggtgggtcccaggaggcagaactcttgggtgtctcaccatggcctggatcccgtctacttctccccttcctccactctctaggacgacagggcctcgtggggccttcctattcgaaccttgacacacgccacccttcggttgtcaggtgtccgtcaagggaccagacggccaggatcacctgctctggagatgcactgaccaaagcaatatggttatgtaccagcagagccaggccaggccccttatgtgatatataaggaccatgagaggccctcagggatccctgagcgattctctggctcctcctcagggacaacagtcaacgttgatcatcagtgagtccggnagaggacgaggctgacgtattactgtacaatcaaacgagacagtagtagttactttatgtgcgtagttcggcgggagggaccagccgtaggacccgtccgttaggtaccgacgacccgaaggcctccgaccccccgtcggtcccacttcccg

SEQ ID NO: 6521 - DNA, 562 bp, Homo sapiens
  misc_feature: GYAE6OF02GJHA5.52.78.H01.1.454.CMB.1.raw
tcagcgcagtacgacacgaccggtgctcgatttagtgtgagtagtttgggtttgggggaggcttggtccagcctgggggtcccagacactctcctgtgtagcctctggattcacctttaacagttattggatgacttgggtccgccaggctccagggaagggctggagtgggtggccagcgtgaagcatgatggaggtgaggaagactatgcggactctgtgaagggccgattcaccacttccagagacaacatcaaagaactcaaatgtatctccaaatgagcagcctgacatccgaggacacggccgtgtattactgtgcgagagttctttgggatgttgtcgttgctaccagctgccctaccggctgctacttcgatctctgggccgtggcaccctggtcactgtcttctcagcctccaccaacgggcccatccggtcttcccctcggccaccctccctcccaacgacgccacctcgtcggggccacgacggccggcccgtacgggccgtcggcccgttgggtaccgaacggtaccttaccgtttccctataccgtacg

SEQ ID NO: 6522 - DNA, 530 bp, Homo sapiens
  misc_feature: GYAE6OF02I5VR0.52.78.H01.1.454.CMB.1.raw
tcagcgcagtacgacacgaccggtgctcgatttagtgtgagtagtttgggtttgggggaggcttggtccagcctgggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttcttgggatgttgtcgttgcaccagctgccctaccggctgctacttcgatctctgggccgtggcaccctggtcactgtcttctcagcctccaccaacgggcccatccggtcttccccgtcggccaccctcctccacgacgcacctctcggggcacgacgcggccctcgggctgcctggtcaacggacctactcctatcgtacg

SEQ ID NO: 6523 - DNA, 527 bp, Homo sapiens
  misc_feature: GYAE6OF02IBA9D.52.78.H01.1.454.CMB.1.raw
  modified_base (309)..(309): a, c, t, g, unknown or other
  misc_feature (309)..(309): n is a, c, g, or t
  modified_base (388)..(388): a, c, t, g, unknown or other
  misc_feature (388)..(388): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctctcactctctgcacaggctctgggcctcctatgaactgacacagccaccctcggtgtcagtgtcctcaggacagacggccaggatcacctgctctggagatgcactgccaaagcaatatggttattggtaccagcagagccaggccaggccccttatcggtgatatataaggaccatgagacggcctnagggatcccgtgtagcgattctctcggcctcctcctcgagggacaacagtcacgttgactcaatcagtggagtccgggnagaggagaggctgactatactgtcaatcaacagacagttagtagtacttatgtgacgtaggttcggcggaagggaccaagtcgtacggaaccgtccgtaggtcacgccgaaggctccggtccccgtcggtccacttccg

SEQ ID NO: 6524 - DNA, 597 bp, Homo sapiens
  misc_feature: GYAE6OF02JX7TB.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggccccttattcggtgatatataaggaccagtagagacggcctcgagggactcccgtgacgcgtacttctcgtcggtctcctcctcgtacggacaacgacgtctacgttgatcatctagtaggacgtccggagaggaggacgaggctaggactattacgtcgtactaactacgtaacgaacgacgtaagtagttaggtactttagtgttacgacgtaggttacgggacgggacgggtaccgagtacgtacggtaccgttaccgtaggtaccacggacccgtaacgggtcccgtaccggccccgtacggtccctaccgttcccgg

SEQ ID NO: 6525 - DNA, 561 bp, Homo sapiens
  misc_feature: GYAE6OF02I3FVS.52.78.H01.1.454.CMB.1.raw
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctaccggctgctacttcgatctcgtggggccgtggcaccctggtcactgtcttctcagcctcaccaacgggcccatccggtccttccccgtggccacccctcctccaacgacgccacccgtcgtcgggggccacgacgccgggccccgttgggcctcggcccgtgggtaccaacgggtacccttacttccctagtacgtacg

SEQ ID NO: 6526 - DNA, 632 bp, Homo sapiens
  misc_feature: GYAE6OF02IZPJY.52.78.H01.1.454.CMB.1.raw
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatggcggactctgtgaagggccgattcaccacttccagagacaacatcaaagaactcaatgtatctaccaaatgagcagcctgacatccgaggacacggccgtgtacttacngtgcgagtagttcttgggattgttgtcgttgcaccngctgcccctaccggctgcctacttcgatcgtcgtcggggtccgtcggcctacccgtcggtccacgttcgtcctttctacgacgtccctccgaacccgtaacgggcccctagttcccggttccctttcccccgtcggtccctaccccttccctacccgaacgtacgacccgtaacccgtccgtcgggggtaccacgtacggcccggtcccgtgggtccgtcggcccgttcggtcgaacgggtaacccttaccgtttacccgtacgtaccgtaccg

SEQ ID NO: 6527 - DNA, 607 bp, Homo sapiens
  misc_feature: GYAE6OF02IWV9V.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacacgccaccctcggtgtcagtgtcctcaggacagacggccaggatcacctgctctggagatgcactgaccaaagcaatatggttatggtaccagcagaggccaggccacggcccccttatcggtgatataataaggaccagtagagacgcctcgagggatccctagagcgtatctcgtggcttcctcctacgagggtaacaaacagtaccgtacgttggatcgatccaggttcggaggtccgggacaagagggacgagggactagtacgttaaatcgttctacgtaattaccgaaagtagtaaccgagtaggtacgttacttaagtggtagcgacggtttcggaacgggacgggtaaccgaggtacgtacggtacccgttacgaacgggtcgaacgacccggtaacgggcctccggtaccccccgttggttacccacgttcccg

SEQ ID NO: 6528 - DNA, 628 bp, Homo sapiens
  misc_feature: GYAE6OF02HW7VU.52.78.H01.1.454.CMB.1.raw
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctaccaaatgagcagcctgacatccgagacacggccgtgtattactgtgcgagtagttcgtttgggattggttgtcgtttgcaccagtctgcctcgtacccggctgcttactcgatctcgtgggccgtggcctacctggtctactcgtcttcctcacgccctccacccgaacgggccctacgttccggttcccttcccccgtcggtccctacccctccgtacccgaagtacgacctacccgttcggtccggggccaccggacggcccgggtccccggtcggggtcccttacgggtcccgttacgggtaccgtaaaccgggttaccctttaacccgtttcccgttaacgtaacccgg

SEQ ID NO: 6529 - DNA, 603 bp, Homo sapiens
  misc_feature: GYAE6OF02HX1S3.52.78.H01.1.454.CMB.1.raw
  modified_base (324)..(324): a, c, t, g, unknown or other
  misc_feature (324)..(324): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccgaggggaaggggctggagtgggtggccagcgtgaagcatgatggaggtgaggaagactatggcggactcgtgtgaagggccgattccaccacttccagagacaacatacaaagaactcaatgtatctacaaatgagcagcctgacatccgagacacggccgtgtattacngtgcgagtagttctttgggattggttgtcgtgcacagctcgcccctaccggctcgcttacttcgactcgtcgtcggggccgtcggcctacccgtggtccacgttcgtcttctcgacgtcctaccgaccgaacggccctacgtccggtcccttccccgtcggccctaccccgtcccaccgaacgacgcccgtaccgtccggtcggggaccacggcgtccgggcccgtcggcctcggtccgtcggtacgtaacggtccttaccgttacctacgtacgtacg

SEQ ID NO: 6530 - DNA, 521 bp, Homo sapiens
  misc_feature: GYAE6OF02FQIM7.52.78.H01.1.454.CMB.1.raw
  modified_base (386)..(386): a, c, t, g, unknown or other
  misc_feature (386)..(386): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttatggtaccagcagaggcaggccaggcccccttattggtgatatataagggaccatgagaggccctcagggatcccgtgagcgattctctggctcctcctcagggtacaacagtcacgttgatcatcagtggagtccgggnaggaggacggaggctagactattactgtcaagtcaacagacagtagtagtacttattgtgcgtagttcggcggagggaccagcctgacccgtcgtaggtcagcccgaaggctaccgccccgtggtccacgtcccg

SEQ ID NO: 6531 - DNA, 565 bp, Homo sapiens
  misc_feature: GYAE6OF02HSI86.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaaagcaatatggttattggtaccagcagaggccaggccacggcccccttattggtgatatataaggacatgagaggccctcgagggactccctgacgcgattcctcgtcggcctcctcctacgacgggacaaacacgtcacgttgatcatcagtggacgtcggacaggaggacgaggctgaactagttactagtacaatcaaacgagacgtagtagtaggttacttagtgtagacgtaggtcggagggacggaccagtcgtacggtaacccgtccgtacggtacaccggaccgaacggtcccgtccgcccccgtcggtacctcgttacccg

SEQ ID NO: 6532 - DNA, 562 bp, Homo sapiens
  misc_feature: GYAE6OF02H7D4J.52.78.H01.1.454.CMB.1.raw
  modified_base (188)..(188): a, c, t, g, unknown or other
  misc_feature (188)..(188): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtccnctttttttttaggacagacggccaggatcacctgctctggagatgcactgaccaaagcaatatggttattggtaccagcagaggccaggccaggcccccttatcggtgatatataaggaccatgagaggccctcgagggactcccgtgagcgattctctggcctcctcctcgagggacaacgagtcacgttgactcatcagtggaggtccgggnagaggacgnggctgactattactgtacatacaacagacagtagtagtattatgtgcgtagtcggacggtacggaccgagcgtacggtaccgtaccgtacggtaccgtacgacccgaacggccgtccgtacccccggtccggtacccgtaccgttacccgg

SEQ ID NO: 6533 - DNA, 576 bp, Homo sapiens
  misc_feature: GYAE6OF02GX9OX.52.78.H01.1.454.CMB.1.raw
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgcccctaccggctgctacttcgatctcgtggggcctggccacccgtggtcactgtcttctcacgcctccaccaacggcccagtccggtccttcccccgtcggccctaccccgtcctacccgaacgacgccacccgtcgtcgggggccacgacggccgggccctggggcctcggcccgttcggtaccgaacgggtaccttaccgtttccctataccgtacg

SEQ ID NO: 6534 - DNA, 534 bp, Homo sapiens
  misc_feature: GYAE6OF02HYFX5.52.78.H01.1.454.CMB.1.raw
  modified_base (451)..(451): a, c, t, g, unknown or other
  misc_feature (451)..(451): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccattcaccacttccagagacaacatcaagactcaatgtatctccaaatgagcaagcctgacatccgaggacacggccgtgtattactgtgcgagagttctttgggatgttgtcgtttgcaccagctgccctaccggctgctacttcgattctcgtggggccgtcggcacccgtgtcactgtctctcagcctccaccacggcccatccgtcctcccctgccnccctcctcacgacgcacctcgtcggggcacgacgccggcccgtcggctcgccgtggtcaacggaccttacttcctatacgacg

SEQ ID NO: 6535 - DNA, 621 bp, Homo sapiens
  misc_feature: GYAE6OF02JBTYO.52.78.H01.1.454.CMB.1.raw
  modified_base (224)..(224): a, c, t, g, unknown or other
  misc_feature (224)..(224): n is a, c, g, or t
  modified_base (365)..(365): a, c, t, g, unknown or other
  misc_feature (365)..(365): n is a, c, g, or t
  modified_base (508)..(508): a, c, t, g, unknown or other
  misc_feature (508)..(508): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctcgtggggcctcctatgaactgacacagcccaccctcggtgtcagtgtcctcaggacagacggccaggatcacctgctctgganatgacactgaccaaagcaatagtggttattcggtaccagcagacggccaggccacggcccccttagttcggtgtatataataaggaccatgagacggcctacgagggactcccgagacgcgtattctactcggctccgtcncgaggacaacgtacgtctacgttagactcactacgtaggtcggacggtccgggacgaaggaacggaccggtaggtaacgtcggtaacttacgttaacgtgttaacctaacgacaacgagacgtacgtaggtacgttacttagngtacgagtacggtaggaccgggaagggaccaggtcgacgtacccggtactacgggtaccaaccgacgtaaccggtcgtaccccggtacccccgtaggtaccctcgttacccgg

SEQ ID NO: 6536 - DNA, 532 bp, Homo sapiens
  misc_feature: GYAE6OF02GRO3S.52.78.H01.1.454.CMB.1.raw
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (524)..(524): a, c, t, g, unknown or other
  misc_feature (524)..(524): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaggccacggcccccttattcggtgatatataaggaccatgagacggccctcgaggggactcccgtgagcgattctcgtggctcctcctcagggacaacngtacacgttnatcatcagtggaggtccgggcaggaggacgaggctgacttatactgtactatcaacgagacagtagtgtattatgtgatggtcggaggaggaccagcgtacgaccgtcctaggcaccgaccgaaggcctaccggcccccgtaggtcccncttcccgg

SEQ ID NO: 6537 - DNA, 648 bp, Homo sapiens
  misc_feature: GYAE6OF02GHU31.52.78.H01.1.454.CMB.1.raw
  modified_base (225)..(225): a, c, t, g, unknown or other
  misc_feature (225)..(225): n is a, c, g, or t
  modified_base (497)..(497): a, c, t, g, unknown or other
  misc_feature (497)..(497): n is a, c, g, or t
tcagcgcagtacgacacgaccggtgctcgatttagtgtgagtagtttgggtttgggggttggggtccaggaggccagaactctgggtgtctcacatggcctggatccctctacttctcccctcctcgactctctgcacaggctctggggcctcctatgaactgacacagccaccctcggtgtcacgtgtcctcaggacagacggcaggatcacctgactctgganatgctacgtcgaccaaagcaaatacgtggttatggtaccagctaaggcggcgacggccacggacccccttagtaggtagatatactaaggacatgagtacggcctgacgggacttcccgtagacgtcgtaacttcgtacgttcggcctcccgtacctacgtaagggactaaacggacgttacgtacgttgaactacgtacgtacgaggtagtacggtccgggactaggaacggagacggtactaggaacttacgtttaacgtcgtacgtaanactaaacgtaagtactaagttaagttagtttactagttagtgtaacgtggttaccggacggtaacggacgtacggtcgtacggacccggtatacgggtaaccacggtacccgaacggcggttacccgcccggtcggtacctacgttacccg

SEQ ID NO: 6538 - DNA, 693 bp, Homo sapiens
  misc_feature: GYAE6OF02JZPQJ.52.78.H01.1.454.CMB.1.raw
  modified_base (179)..(179): a, c, t, g, unknown or other
  misc_feature (179)..(179): n is a, c, g, or t
  modified_base (262)..(262): a, c, t, g, unknown or other
  misc_feature (262)..(262): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtntcagtgtcctcaggacagacggccaggatcacctgctctggagatgcactgccaaagcaaatatgttattcggtaccagcagnggccaaggccacggccccttattggtgatataagtaaggaccatgagacggcctacgagggtactcccgtagagacgtattcgtcgtcggtctccctcttaccgagggtacaacgtagtctaacgttcgacgtcagtcgaaggttcggaacggtccgggacgtaagggacggtacggaggtcgtagtaaccgttattaccgtaggtaccaagttaccgaaacgacgtaacctaagttaacggtacggttaaccttagttcgggtacgtaacgttaacggttcgggaaccggaacgggtaaccgtacgtaaccgttaccggtaacccggttaccggtttaaccgggtaccgtaaccggtaccccggttaaacggttcccgtaaaccccgggttccccccgtaaccggggttacccttaaccgttacccccgg

SEQ ID NO: 6539 - DNA, 507 bp, Homo sapiens
  misc_feature: GYAE6OF02FZVY1.52.78.H01.1.454.CMB.1.raw
  modified_base (449)..(449): a, c, t, g, unknown or other
  misc_feature (449)..(449): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagtcggnggagggaccagctgaccgtctaggtcacgcccgaaggctcgcccctcggtccactccg

SEQ ID NO: 6540 - DNA, 565 bp, Homo sapiens
  misc_feature: GYAE6OF02JEJL9.52.78.H01.1.454.CMB.1.raw
  modified_base (320)..(320): a, c, t, g, unknown or other
  misc_feature (320)..(320): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgcaggctccagggaaggggctggagtgggtggccagcgtgaagcatgatggaggtgaggaagactatgcggactctgtgaacgggccgattcaccacttcagagacaacatcaagaactcaatgtatctacaaatgaagcagcctgacatccgaggacacggccgtgtaacttacngtgcgagacgtttctttgggatgttgcgttgcacngctgccctacgntgctactgatcngtggctgcnccgtggcatgtctactcacgcctccaccgtaacgggccctagtccggtcctttccccgcggcctacccctcctaccgaagcgcctaccgtacgtcggggccacgtcggcccggtacccgtgggccttcggccgttacgggtacgaaacggtccttaaccttcgtaacgtaccgtacg

SEQ ID NO: 6541 - DNA, 657 bp, Homo sapiens
  misc_feature: GYAE6OF02H75H8.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattcggtacagcagaggaccaggccacggtccccttagttcggtagtataatagtaaagaccagtagagacggccctacgagggtactccgagacgcgtattctcgtcgtcctcctcctcgacgggaactaacgacgtcgaacgttagactacgtactacgtaggttcgggaccggtaccggggagtaacggaagggaccggtagggaccgtaggtaacttaagttacgtcgttaacccaagtacctaaacgaacgtaacgtaggttaacggtagttaaacttgtacgttcgtacgtacgggttcgggacgggtaacgggaccaacggcgtacggtacccgtacggttacggcgtaaccgacccgacggtacctccccggttaccccctggttacccgtaccttacccgg

SEQ ID NO: 6542 - DNA, 815 bp, Homo sapiens
  misc_feature: GYAE6OF02H1BB0.52.78.H01.1.454.CMB.1.raw
  modified_base (283)..(283): a, c, t, g, unknown or other
  misc_feature (283)..(283): n is a, c, g, or t
  modified_base (321)..(321): a, c, t, g, unknown or other
  misc_feature (321)..(321): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgcaggctccgagggaaggggctggagtgggtggccagcgtgaagcatgatggaggtgaggaagactatgcggactctgtgaagggccgattcaccacttccagagacaacatcaagaactcaatgtatctacaaatgancagcctgacagtccgaggacacggcgtagtattactgngacgagtgttttcgtttgggattggttgtacggttcgaccaccaggtccttcggtacccccgtaacccggtctcggaccctttaacgttcgacttccgtttaccggttcgggggcccggttacgggtacccgtaccccgtttcgggttaccctaccgtttcgttacccgtttcccgttccgtaacccggtccccgtttaaccccgaaaccccgggtaaacccggggttacccccgtaaacgtttccccggggtttacccccctttttacccccccggtaccgggtaccccctaccccccgttaccccgtttacccccgaaacggtaacccgtcccgttaacccgttccgggttaccgggggaccctaccggaaccgggtccccgggtaccccggttccggggtcccgttaccggtccccggtttacgggtaccgtaaaccgggttaacccctttacccggttttaccccgtttaccggttacccgtttcccggg

SEQ ID NO: 6543 - DNA, 638 bp, Homo sapiens
  misc_feature: GYAE6OF02JE3DE.52.78.H01.1.454.CMB.1.raw
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctaccaaatgagcagcctgacatccgaggacacggccgtagtattactgtgcgagtagtttcgtttgggattggttgtcgttgcacctagctcgccctaccggctgcttacttcgattccgtcgtcggggccgtcggtccacccgttggtacctacttcggttcctttcgtaccgtacgtcccttacccgaacccgtaacggggtcccctacgttcccggttcccgttcccccgtcggacccctaccccgttcctacccgtaacgcgtcctaccgtcgtacgggggccaccgcggaccggtcccggttggcctcggtccgttcgggtaccgtaacggtaccgttaccttaccgtacgtaccgtacg

SEQ ID NO: 6544 - DNA, 608 bp, Homo sapiens
  misc_feature: GYAE6OF02HVDNX.52.78.H01.1.454.CMB.1.raw
  modified_base (222)..(222): a, c, t, g, unknown or other
  misc_feature (222)..(222): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgaccaaaagcaatatggttattggtaccagcagaggccaggccaggcccccttagttggtgatatataaggaccatgagaggccctcgagggactcccgtgacgtcgattctctcggctcctcctcgacgggacaacgacgtcgacgttgactcatcgaggtggacggtccgggcgaaggagggacgaggctagtaaccgttattacgttcgtacaattaccaaacgtacgaacgtaggttaacgtaggttacttaagtggtacgtcgtaggttcggaggacgggaccgagtccgtacggacccggttaccgtacgggtacgaccgacccggaacggtcccgttaccgtcccccggttcggtacccgtccgttacccgg

SEQ ID NO: 6545 - DNA, 584 bp, Homo sapiens
  misc_feature: GYAE6OF02IWYYF.52.78.H01.1.454.CMB.1.raw
  modified_base (372)..(372): a, c, t, g, unknown or other
  misc_feature (372)..(372): n is a, c, g, or t
  modified_base (425)..(425): a, c, t, g, unknown or other
  misc_feature (425)..(425): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctaccaaatgagcagcctgacatccgaggacacggccgtgtacttactgtgcgagtagttctttgggatggttgtcgttgcaccagctcgccctaccggntgctactcgatccgtcgtcggggccgtggccaccgtgtcacttcgtcttctcncgtcctccaccgacggcccacgtccggtcccttccccgtcggccctaccctccctaccgaacgacgccgtaccgtcgtcggggccacgcggtcccggcccgtcgggcctcggccgttcggtaccgtaacggtccttaaccgttcccgtacgtacgtacg

SEQ ID NO: 6546 - DNA, 588 bp, Homo sapiens
  misc_feature: GYAE6OF02I783G.52.78.H01.1.454.CMB.1.raw
  modified_base (282)..(282): a, c, t, g, unknown or other
  misc_feature (282)..(282): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaagggctggagtgggtggccagcgtgaagcatgatggaggtgaggaagactatgcggactctgtgaagggccgattcaccacttccagagacaacatcaagactcaatgtatctaccaaatgancagcctgacatccgaggacacggccgtgtattacgtgtgcgagtagttcgtttgggatgttgtcgttgcaccngctcgccctaccggntgctacttcgatcgtcgtcggggccgtcggctaccgtggtcacgttntcttctcacncctaccgaccacgggccctacgtccggtaccttccccgtggccctcccgtacctccgaacgcgaccaccgtcgtcggggcaccgcggtcccggccgtcgggtccgtacggtcccgttagggtaccgaaccggtaccgttaccgttacctacgtacgtaccg

SEQ ID NO: 6547 - DNA, 795 bp, Homo sapiens
  misc_feature: GYAE6OF02I72XF.52.78.H01.1.454.CMB.1.raw
  modified_base (286)..(286): a, c, t, g, unknown or other
  misc_feature (286)..(286): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagcccaccctcggtgtcagtgtcctcaggacagacggccaggatcacctgctctggagatcgcactgaccaaagcaatatggttattggtacagcagaggccagccacggccccttatggtnatataataacgaccatgacggacggacctcgaagggactacccgtgagacgattctcgtcggtactcctcctcgaacgggaacaacgtacgtacgtaacgtttacgaacgtacctaacgtacgtaacgggttacggggtaacggtccccgggggtaactaacgggggaaccggaaacgggtacgggtaaccgttacgggtaaactttaaaccgtttaaccgttacgttaaaccgtaaaacgttaacccgtaaaacgtaaaccggtaaccgttaaacggtttaacgggtaagggtttaaacccgttttaagtttacggttacggtaaccgggttaacgggtttacccgggaaccggggtaacggggtaaacccgtaacgggtaccgttacccgggggttaacccggttaacccggtaacgggttaacccggaaccggtaacccccggtaaaggggccccgtttaccccggaccccccgggtttaccggttaccccgtaccgtttccccgg

SEQ ID NO: 6548 - DNA, 824 bp, Homo sapiens
  misc_feature: GYAE6OF02H3YIW.52.78.H01.1.454.CMB.1.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (311)..(311): a, c, t, g, unknown or other
  misc_feature (311)..(311): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctcgtcgggcctcctatcgaactgacacacgccaccctcggtgtcagtcgtccccaggacagacggcaggatcacctgctcgtgganatcgactagttcgacccaaacgntatgtacttagtggtaaccagaccaagtaacggcccgggccgaacggcccttggtggttggngtattgtaaataaagccagttacggagccgggtccctacggagggtacctcccgtaggacgtcgtagttccgtcgtcggtccctaccgtacggtcgaacggggtaccctaaacgggtctaacgtcggttacgtaccgtaactaccggtagggtacgggtaaccgttaccggaagggaccgaaaggggacgggtaaccggacggtacgtaacggtaacttaaaccgttttctacggttaactaaactaaccgaaacgtaagtaacgtaacggttaaggttaaccggtttaagtttaacgtttagtacggtacccggttaaggggtttccggggaaaccgggttaaccgggaaccggtaacgtcccgggtttaacccgggtaccccggggtttaaccggttaaccgggtacccggttaaacccggaaccccggtaaccgggtccccgttaccccgggtaccccccccggtttagggttacccccctacccggtttaccccgttttcccccccggg

SEQ ID NO: 6549 - DNA, 273 bp, Homo sapiens
  misc_feature: GYAE6OF02H53DB.52.78.H01.1.454.CMB.1.raw
  modified_base (248)..(248): a, c, t, g, unknown or other
  misc_feature (248)..(248): n is a, c, g, or t
  modified_base (263)..(273): a, c, t, g, unknown or other
  misc_feature (263)..(273): n is a, c, g, or t
tcagcgcagtacgacacgaccggtgctcgatttagtgtgagtagtttgggtttggggtgtgagtagtttgggtttgggtgtggtggtctccactcccgccttgacgaggctgactattactgtcaatcaacagacagtagtggtacttatgtgcagttcggcgggaggaccagctgaccgtctaggtcagccaggctgcccctggcactctgttcccaccctcctctatacgatcgctgagcgggtcnggcaaggcgcatagnnnnnnnnnnn

SEQ ID NO: 6550 - DNA, 814 bp, Homo sapiens
  misc_feature: GYAE6OF02I2VNC.52.78.H01.1.454.CMB.1.raw
tcagcgcagtacgacacgaccggtgctcgatttagtgtgagtagtttgggtttgggggtagggcgttggtccagcctggggggtcccgtgacactctcctgtgtagcctctggattcacctttaacagttattggtatgacttgggtccgccaggctccagggaaggggctggagtgggtggccaggcgtgaagcatgatggaggtgaggaagactatgcggactctgtgaagggccgattcaccacttccaagacgacaaacatacaaagaactacaatgtaatcctaccaaaagtcgaagcaacgtcctagaacacgtcccggaagggtaaccaacggggtcctagtaacttaacgtgtcgacgtagtagtttcgttgggattggtttacgtcgttcgacctaacctagccttaccggaccccgtaccgggcttcggtacttaccgttcggaacttccgttcggtacgggggcccgttcgggaccctaacccggttcggtactaccgttcgttcttaccgttaccgacgtcccgttacccgaaccggtaaccgggtacccctaccgttacccgggttccccttcccccggtccgggtacccctacccccgtcccgttaacccgtaacggaccgttacccgtacccggtacccgggttacgggggaaccctaccgggtaccggccccggggttaaccccgggttcccggggtaccggttcccggtaccccggttttcggggtaacccggttaaaacccgggttacccgttttaaccccggtttccccgttaccccgggttaccgttacccggg

SEQ ID NO: 6551 - DNA, 823 bp, Homo sapiens
  misc_feature: GYAE6OF02IS4ZS.52.78.H01.1.454.CMB.1.raw
  modified_base (470)..(470): a, c, t, g, unknown or other
  misc_feature (470)..(470): n is a, c, g, or t
tcagcgcagtacgacacgaccggtgctcgatttagtgtgagtagtttgggtttggggggaggcttggtccagcctggggggtccctgacactctcctgtgtagcctctggattcactttaatagttattggatgacttgggtccgctaggctccagggaagggctggagtgggtggcctaggcgtgaagcatgatggaggtgaggaagactatggcggactcgtggtgaacgggcctattccgaaccctacttccaaggacgtaccaaacatacgaaaggtaacctcaagttgttactccttaccaaaatcgagtaccagcctagactacgtccggaggaccacgggccgttaggtaacttaccgtggtcggacgaacggtaggtttccgtttacggggatttcgggtttcggttacggttcggaccgtaaccgtacggtccggttaccgtacccccggttaaccccggngtttaccgtccttaaccgttacgtacgttacccgttcggtacggggggtcccgtacggtacccgtaccccggttaggtacccgtacgttacgtccgtttaccaccgtacgtacccgttacccgtaaccggtaacccgggttccctacggttacccggtcccgtttacccccggtacgtaccccgtaccccctaccgtaacccggtaagtacccgacccgtacccggttccggtacgggggacccacggtaccgggtcccggtacccggttcgggtaccgtccggtacccggttcgggtaaccgtaaccgggtacccgtttaacccgtttacccgtaaccggtaccgtaaccgg

SEQ ID NO: 6552 - DNA, 697 bp, Homo sapiens
  misc_feature: GYAE6OF02IW22G.52.78.H01.1.454.CMB.1.raw
  modified_base (221)..(221): a, c, t, g, unknown or other
  misc_feature (221)..(221): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctctgganatgcactgaccaaagcaatatggttattggtacagcaggaggccaggccacggcccccttattggtgatatagtaaggaccagtgagcggccctagaggactcctgagcgtacttcgtcgtacggtcctacctcccgtacgacgggtacaacgtagtaccgtacgttacgaacttcaactccgtagggtcgggtaccggttaccgggacgtaagggtacgggaccggtaaggtccgttagtaacgttattacgttacgtaactaacttacgaaacgtagtaacgtagttacggttacgttacttaacggttgtaacgtacgttacggggttacggacggggtaaccggtaaccgtacgggtacgttaaccgggtaacccggttaccggttacgggtacccgtaaccgggtacccgttaaacgggtcccgtaccccggtaccccccggtttaccgggtacctacccgtttaccccgg

SEQ ID NO: 6553 - DNA, 639 bp, Homo sapiens
  misc_feature: GYAE6OF02JXIQ6.52.78.H01.1.454.CMB.1.raw
  modified_base (253)..(254): a, c, t, g, unknown or other
  misc_feature (253)..(254): n is a, c, g, or t
  modified_base (257)..(257): a, c, t, g, unknown or other
  misc_feature (257)..(257): n is a, c, g, or t
tcagcgcagtacgacacgaccggtgctcgatttagtgtgagtagtttgggtttgggggtgggtccaggaggcagaactctgggtggtctcaccactggcctcggatccctctacttctcccctcctcactctctgcacaggctctgggcctcctatgaactgacacagccaccctcggtgtcagtgtcctcaggacagacggccaggatcacctgctctggagatgcactgccaagcatatggttattgtacnnagngcagcacgcccctatggtgatatagtaaggaccatagagacggacctcgaagggactccctgtacgcggtacttcttcgcgtcttcctccgtacgacggggaacaaccgtgtaccgtaacggttcggaattaccgaacgtcgtaaggtacgggtacgtccggggacgacgggtacggacggtaacggcgtacgacgtacttacgtacgtcaactaccgaacagtacgacgtaaggttcgtacgtttagtagtcgtacgtacggtacgggtacggacgggtaaccgacgtacgtacggtaccggttaccgtacggtaaccgtacggtacccgtaacggtcccgtaccggacccccgttacggttcccgtaacccgtttcccgg

SEQ ID NO: 6554 - DNA, 286 bp, Homo sapiens
  misc_feature: GYAE6OF02IY8EL.52.78.H01.1.454.CMB.1.raw
  modified_base (260)..(260): a, c, t, g, unknown or other
  misc_feature (260)..(260): n is a, c, g, or t
  modified_base (266)..(269): a, c, t, g, unknown or other
  misc_feature (266)..(269): n is a, c, g, or t
  modified_base (271)..(273): a, c, t, g, unknown or other
  misc_feature (271)..(273): n is a, c, g, or t
  modified_base (276)..(286): a, c, t, g, unknown or other
  misc_feature (276)..(286): n is a, c, g, or t
tcagcgcagtacgacacgaccggtgctcgatttagtgtgagtagtttgggtttggggtgtgagtagtttgggtttgggtgtggtggtctccactcccgccttgacgaggctgactattactgtcaatcaacagacagtagtggtacttatgtgcagttcggcggagggaccaagctgaccgtcctaggtcagcccaaggctgcccctggtcactctgttcccacctcctctatacgatcgctgagcgggctggcaaggcncatagnnnngnnnatnnnnnnnnnnn

SEQ ID NO: 6555 - DNA, 702 bp, Homo sapiens
  misc_feature: GYAE6OF02JYK7Z.52.78.H01.1.454.CMB.1.raw
tcagcgcagtacgacacgaccggtgctcgatttagtgtgagtagtttgggtttgggggtgggtccgaggaggcagaactctgggtgtctcaccatggcctggatccctctacttctcccctcctcactctctgcacagctctgggcctcctatgaactgacacagccaccctcggtgtccagtgtcctcaaggacacgacggccaggatacacctgcctctggagatcgcaacgtgaccctaaagacaattagtggttaattcggtaccagcgaggaggccaggccgacggacccccttagttggtgagtagtaataacgacactagaggacggcccgtacgacgggtactcccgtgaacgcgaacgttctccgttacgccgtaccgagggttaccgaacggggtaacgaaccggttacaaaccgttgttacggcctacgtaccgtagtagggaccgtacgacggacgtaaggaacgggtaccgacgggtacgtcggtaacgttagttacttagtaccgaacttaacgaacagtaccaacgttacttaacggtactttaagttcgtacgttacgtaactcggtaacgaaccgtaacggtccgtaaccgttcccggtaagggtaccctaacggacccgtaaacccggccctaaaccccgtcggttacccgtaacctacccggttaccttacccggttaccccc

SEQ ID NO: 6556 - DNA, 668 bp, Homo sapiens
  misc_feature: GYAE6OF02H6BE2.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgggcctcctatgaactgacacagccaccctcggtgtcagtcgtcctcaggcagacggccaggatcaccgtgctcgtggagacgtgcactcggaccaaaagctaaatagttggtttagttacggactagcgaggacggacgacgccgaccggtccccttagtggtgaattagtaagtaacggacagtagagacgcctcgaagggtacgtccgagacgacggtacttcgtcgtcgtcccttcctccgtacgtaacgggaactaacgtacgttaccgtacgtttacgactaccgtagtaccgtagggtcggtacgggtccgggacgtaagggacggacggtaggctaacgtagttacgttaacttggtaacaacgtaacaaacgtagaacgtaaggtacggttaggtttactaagttgtacgtacgtcggtacgggacggtacgtaacgacgtcggtacggccgttacggtaccgacgtaccgacccggtaggaccctcccggtaccccgtgttacccaccgttcccg

SEQ ID NO: 6557 - DNA, 670 bp, Homo sapiens
  misc_feature: GYAE6OF02JK1HT.52.78.H01.1.454.CMB.1.raw
  modified_base (144)..(144): a, c, t, g, unknown or other
  misc_feature (144)..(144): n is a, c, g, or t
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (443)..(443): a, c, t, g, unknown or other
  misc_feature (443)..(443): n is a, c, g, or t
  modified_base (572)..(572): a, c, t, g, unknown or other
  misc_feature (572)..(572): n is a, c, g, or t
  modified_base (594)..(594): a, c, t, g, unknown or other
  misc_feature (594)..(594): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggccncaggctcagggagggctggagtgggtgccagcgtgaagcagtgatcggaggtgaggaagactatggccggactcgtggtcggaacgggcccaattccaccgtaccttccgaaggaacgaccaaagatacgaaaacgtacctacaaagttgtaactcctaacgaaagtggaacgacncgaccttggaacacgtccgaaggcctacgggtccttntaaccttntcgtgaccgtaagttgtttcggttgggattgggttgtcgttaacgcctaaccgtggacctcccggtacccgtaccgtntcgtaacttccgtgcttccgcggtcggtccgcgtcctccgtcgtactcgttcgtactcgtccgtacgcccgtacgaccgtacgtcctcgttcccgtccctcccgtcgccctaccctccgaacacgtacncccgtacggtcggaccggtacnccggacggtaccggtcccggcggttacgtccggtccgtacggtaacgtaccggtaccttactccgtaagtcctacg

SEQ ID NO: 6558 - DNA, 698 bp, Homo sapiens
  misc_feature: GYAE6OF02GU0YO.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctcccctcctcactctctgcacaggctctgggcctcctatgaactgacacagccaccctggtgtcagtcgtcctcaggacagacgccaggatcacctgctcgtggagtatcgcactgaccaaaagcaaatagttaggttaattggtaaccgagacgaaggacggccgaacggcccgaacggtccccccgtttaagttcggtacggtattaacgttaagttaaacggaacccctaagtacggaacggacgggtcccctacggaacgggacctccccgtaggacgcggtacttccgtcgtacggtccttcctaccttcggaacgggtaacctaaacgacgttacgtacggtttcgaactacctagtacgtagggtaggtaaccggtccgggaacagggaacggacggtagccgtagtaacttagttacgtagtactaacgtaaccaaacgacgaacgttagtaaggtacgttaagttatggttcgtacgttaggttacggacgggtacggaacgtacgtacgtcggaaccgttcgtagtccgacgacccggtaaggccgtccgttccccggtcgtacgacccttccg

SEQ ID NO: 6559 - DNA, 851 bp, Homo sapiens
  misc_feature: GYAE6OF02HUOKJ.52.78.H01.1.454.CMB.1.raw
  modified_base (532)..(532): a, c, t, g, unknown or other
  misc_feature (532)..(532): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacagctcgtgggccctcctatgaactgacacacgtccaccctcggtgtcagtgtcctcaggacagaccggcctaggaactcacctgctcgtggagactgcactgacccaaaagctaatagtttacggttattcggtaaccagtacgaaggtacgaccgacggacccgaccgggtacccccttagttgggtacgtaataataagtaacggacctagtacgaaggtacggtacccgttacgacggggaactcccgtagggacgtacgttacgttccgtcgttcggtacccttccctttaccgacggtacgggtaaaccctaaaacgcggttaaccgtaacggtttacgtaacgtacctacgttaccgaaggggtttaccgggaccgggttacccgggtanaaacgggggtaacgggtaaccgggtaagggtcccgttaagggttaacccgttttaaacgttaaccggtttacggtttaacctaaacgttaaccggaaacgttaaccgaaacgtttacgggttaagggtttaaccggttaacgtttacgtacgggtttacggtaccggtttaacggggttacccggacgggggtaaccggggaaccggttacgtaccggttaacccgggacccggtttaacgtaccgggtacccaaccgggtaccaaccgggttcccgtacccggtacccccgtttacggacccgttaccttaccccggg

SEQ ID NO: 6560 - DNA, 637 bp, Homo sapiens
  misc_feature: GYAE6OF02GAMOW.52.78.H01.1.454.CMB.1.raw
  modified_base (108)..(108): a, c, t, g, unknown or other
  misc_feature (108)..(108): n is a, c, g, or t
  modified_base (445)..(445): a, c, t, g, unknown or other
  misc_feature (445)..(445): n is a, c, g, or t
tcagcgcagtacgacacgaccggtgctcgatttagtgtgagtagtttgggtttgggggtgggtccaggaggcagaactctgggtgtctcaccatggcctggatccctntacttctccccctcctcactctctgcacaggctctggggcctcctatgaactgacacagccaccctggtgtcagtgtcctcaggacagacggccaggatcacctgctctggagatgcactcgaccaaagcaatagtggttattggtaccagcgaggacggccgacggccgacggtcccccttagttggtacgatataagtaaggaccagtagagacggcctacgagggactcccgtagacgtacgtacttctcgtcggtcctaccctccgtacgacggtaccaacgtacgtactacgttgactcagtcgaggtcggcgtccggagacggaggacggngtcgtagtactacgttacgtacgtacgtaactacgaaacgagtacgtaagttaggttagtactttagtgttacggacgttagggtccggacgggtacggaaccgtagtccgtacggtacccggttacgtacggtaccgaccgtaccggaacggtcccgtacccggtaccccgtcggtacctcccgttacccg

SEQ ID NO: 6561 - DNA, 601 bp, Homo sapiens
  misc_feature: GYAE6OF02FF52U.52.78.H01.1.454.CMB.1.raw
  modified_base (216)..(216): a, c, t, g, unknown or other
  misc_feature (216)..(216): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
tcagcgcagtacgacacgaccggtgctcgatttagtgtgagtagtttgggtttgggggaggctttggtccagcctggggggtccctgacactctcctgtgtagcctctggattcaccttttaacagttattggatgacttgggtccgccaggctccgagggaaggggctgggagtgggtggccagcgtgaagcatgatggaggtgaggaagactangcgactntgtgagggccattcaccacttcagngacaacatcaagactcaaatgtatctaccaaatgacncagcctgacatccggagaccacggccttagttacttacgggtcgcgagtgtttcgttgggatttggttgttcgtcncgacngcctcgcccgtccggtcgctttactcgtatcgtggtcgggccgtgcctccgtcggtctacgtcgttcttctcgacgtccctaccgaccgaacggccctacgttccgtcccttccccgtcggccctaccctcctaccgacgtacgcctaccgtcgtcggggacacgacgccggtcccgtggccgtcgtccggtcggtaccgaacggtaccttaccgtttcccgtacgttacgtcgg

SEQ ID NO: 6562 - DNA, 719 bp, Homo sapiens
  misc_feature: GYAE6OF02JIFYA.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaatatggttattggtaccagcagaggccaaggccgacggcccccttagttcggtagtatataataacggaccagtgagaggccctacgagggactcccgtgacgtacgtattcctcgtggccttccgtccgtacgacgggacaacgacgtcgtacgttcgactcacgtcgtaacggtcggtaacggtcccgggacgtaagggagggtaaccggaggaccgttacggtaaccttaacgtttaccgttggtacctaaacgttaccaaacgaggtaaccgtaaggttacggttacggttaaccgttaagttcgggtacgtaccgttacgggtttaccgggaacgggtaacgggtaacccgtacgtaccggtacgggtaaccccggtttaccggtaacgggttacccgtaacggtacccccgaaacgggttccccgtaacccgggtccccccgtttaaccgggttcccgtaacccgtttccccgg

SEQ ID NO: 6563 - DNA, 712 bp, Homo sapiens
  misc_feature: GYAE6OF02GGIBO.52.78.H01.1.454.CMB.1.raw
  modified_base (216)..(216): a, c, t, g, unknown or other
  misc_feature (216)..(216): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacgccaggatcacctgctntggagatgcactgaccaaagcaaatagttggttattcggtaaccagcaggaggccaggccacggcccccttagttggtgatatagtaaggacctatgagacgccgtacagggactccgagacgtacgtattctacgtcggtctcccgtcctacggacgggacaaccgtacgtacgtacgtagacttaccgattacgtacgggtaggtaacgggtccgggtacgaacgggacgggacggacgggtaccgtacggtaaccttaacgtttaaccgtcgtaacgtaacgttaccgaaaacgacgtaaacgtaacggttaaggttacgggttaacgttaacgtgttaacggtcgttaacgggttacgggtaacgggaacggggtaacccagggtaccgtaccgggtaacccgtaccggttaaccggtaccgtaaccgggacccgtacgggtacccggttaccccgtaccccgggttacccgacccgttcccgttaccccgg

SEQ ID NO: 6564 - DNA, 797 bp, Homo sapiens
  misc_feature: GYAE6OF02I4KOF.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctgaggtcctcctatgagctgacacagcccaccctggtgtcagtcgtccccgaggacagaccggccgaggatcacctgctcgtggagatgcattcgaccaaaaccgatactgtctttagttcgggtaccagacgaacggaacggacccgggccgaccgggtccccttggtggtttggggtagtacgttaggttaaagttaaaacggaccgtaacgtgggaacggtaccgggcccctaacggacgggggtaccttacccgtgggtaacgtccggttactttaccggttcggtcgtaccgttaccggtacgggtaccggacggggtaaaccggtaaccgggttacctaacgttaacgttacgggacctaacgttcggtacgggttacgggtaaccgtaccgacggggtaaccgaagggtaacgggacggtacgggacgtacggtaacgttaacgttttagtacgtacctaaacgttaaccaaccgtaaacgtacccgttaacttaacggtttacgttaactttacgttcggtttaccgttacggtaaccgtcggaaccgttaccgaaggttcccacggtttcccggtcggtaacgcccgtacccgaacggaccccctaacccgttaccgtaccgtaccctcgttaccccgttaccccg

SEQ ID NO: 6565 - DNA, 697 bp, Homo sapiens
  misc_feature: GYAE6OF02JPQYR.52.78.H01.1.454.CMB.1.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
tcagcgcagtacgacacgaccggtgctcgatttagtgtgagtagtttgggtttgggggtgggtccaggaggcagaactctgggtgtctcaccatggcctggatccctctacttctcccctctcactctctgcacaggctcgtggggcctcctatgaactgaacacacgccaccctggtgtcagtgtcctacacggacaggaccggccaaggactcacctgctctggganatgacactcgaccaaagcaagtgtgttactgacctagcaggacggccgacggaccacggtccccttaagttggngtactataagtaacgacctagtaggacgaccggtccctacggacgggaaccttcccgtaggaacgcgtacttctcggtcggtcctacctacgtacggaacgggaaccaacgtacgttacgtacgttacgactctacgtcgtaacgggtcggtaacgggtcccgggagtaacgggtaacggtacgggacgtcgttaacggtaacgttaagttaccgtaagtaacctaacgacaacgtacgacgtaagttacggtagttacgttagtagtcgacgttaggtacgggtaaggccgtaacgtaggtacgtaccggtaaccgtcggttaacgacggttaacccgaccggtacggtacccgtacccggttaccccggtacgtaccgtccgttaccccggg

SEQ ID NO: 6566 - DNA, 792 bp, Homo sapiens
  misc_feature: GYAE6OF02GKH2V.52.78.H01.1.454.CMB.1.raw
  modified_base (226)..(226): a, c, t, g, unknown or other
  misc_feature (226)..(226): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctcgtggggcctcctatgaactgacacacgccaccctcggtgtcagtgtcctcaggacagacggccaggactcacctgctcgtgganatgctactcgaccaaagcaatagtaggttattacggtaccagcaggacggaccgacggccgaccggtaccccccgttagttcgggtagtaattaagtaagtaaacggaccgtaagttaggaacggtaccggtccccgtacggaacggggtactaccccgttggacggtacgtacttccgttccggtcggtcccttcccgtcccgtacggaacgggaacctaacgtacgttacgtaaccgtttggaactactacgtacgtagggtacgggtaccgggtccgggacgaagggtaacgggacggtacggtacgtacggtaccgttaacgttacgttaacgtacaacgttaccgaaacgaacggtaaccgttacggttaaggttaccggttaactttagttcggtacgtaccggttacgggttaccgggaacggggacgggtaaccgtaccgggtacgtaccgggtaaccggttacccggtaacgggttacccggtaacccggtacccggaacgggttcccggtaccccggttacccccgggtcccggttaccctcccggtttaccccgg

SEQ ID NO: 6567 - DNA, 805 bp, Homo sapiens
  misc_feature: GYAE6OF02JIKEZ.52.78.H01.1.454.CMB.1.raw
  modified_base (261)..(261): a, c, t, g, unknown or other
  misc_feature (261)..(261): n is a, c, g, or t
  modified_base (471)..(471): a, c, t, g, unknown or other
  misc_feature (471)..(471): n is a, c, g, or t
  modified_base (682)..(682): a, c, t, g, unknown or other
  misc_feature (682)..(682): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtccgcaggctccgagggagggctggagtgggtgccagcgtgaagcatgatggagtgaggagactatgcggactctgtgaagggccattcacctactccagacgacaacatcaaagaactnaatcgtatcctaccaaatcgagacgacgtcctaggtaaccacgttacccggaaggaacccgaccggggtccgttagttaacgtttaaccgtttgggcggtaaccggtaaggttaggtttttaccgtttacgggggaattttcgggtttaggttcccggttagaccccgtaaaccgtagggtccttaccggtcccccgttaaacccggggntttcgggtaccctttaacgttcggaactttccggtaccgggtacggggtcccggtcggtacccgtacccgttcggtacctaccgttacgtttccgttaccgtccgtacgttacccgttacccgtaacccggtaaaccggggtcccgtaacgttcccggtacccctttccccggtcggtaccccgtaccccttcccgtaaccgaacgtaccncccgtaccgttccggtacggggacctaccggacggtcccggtcccggttacgggtacctccgggtaccgtacggtacccggtaacggttacccttaaccgttaccgttacgtaccgttaccgg

SEQ ID NO: 6568 - DNA, 574 bp, Homo sapiens
  misc_feature: GYAE6OF02HZ6W5.52.78.H01.1.454.CMB.1.raw
  modified_base (222)..(222): a, c, t, g, unknown or other
  misc_feature (222)..(222): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctgganatgcactgacccaaagcaaatagtggttattggtaccagcagaggccaggccacggcccccttagttggtagatatataaggaccagtgagacgccctcgagggactccctagagcgtattctcgtcggccttccctcctcgagggacaacgagtcgtacgttcgatcatcgaggtggacggtccgggcgaggaggacgaggctgtaacgttattacgtgtacaagtaccaagagacagtagtagtacttagtgtgctaggtcggcggacggacctaggcgtacggccgttaccgtacgggtccaccgaccgacggccgtcccgacccccggttcggtacctaccgttcccg

SEQ ID NO: 6569 - DNA, 837 bp, Homo sapiens
  misc_feature: GYAE6OF02FTMXY.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctctggggccctcctatgaactgacacagccaccctcggtgtcagtgtcctcaggacagacggccaggatcacctgctcgtgggagatgccactgaccaaagctaatagttggttattacggtaccagtcaggacggccgacggccgtacggtccccctttagttcgggtagtatattaagtaacggacctagtgaggacggtaccctacgacgggactcccgtaggacggtcgtacttcgtcgtcggtcccttcctccgtcggtaacgggactaacggacttacccgtacggtagtactacgtacgtacgtacggtacggggtaccggtaccggggacgtaaacggggacggggtaaccgggtaagggtccgtaaacggttaacccttaacgtttccggttaacggtaacccgttaaaccttaaccggaaaccggtaaacggtacggttaaacgggttaaaccgggtttacgggtttaacctttaagggttaccggtttaacgggaccgtttaaccggggtttaccggggaccgggggtaaccggggtaaacccggtaaccggggtccggtaacccgggttaaccccggttaacccggttacggggtaacccgtaccgggtaacccccggtaacggtccccgggttcccccggtacccccgggtttacccggttccccggttaccctttcccccggg

SEQ ID NO: 6570 - DNA, 720 bp, Homo sapiens
  misc_feature: GYAE6OF02FPC7N.52.78.H01.1.454.CMB.1.raw
  modified_base (227)..(227): a, c, t, g, unknown or other
  misc_feature (227)..(227): n is a, c, g, or t
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
  modified_base (565)..(565): a, c, t, g, unknown or other
  misc_feature (565)..(565): n is a, c, g, or t
  modified_base (604)..(604): a, c, t, g, unknown or other
  misc_feature (604)..(604): n is a, c, g, or t
  modified_base (668)..(668): a, c, t, g, unknown or other
  misc_feature (668)..(668): n is a, c, g, or t
tcagcgcagtacgacacgaccggtgctcgatttagtgtgagtagtttgggtttgggggaggcttggtccagcctggggggtccctgacactctcctgtgtagcctctggattcacctttaacagttattggatgacttgggtcccgcgaggctccgaggggaaggggctggagtgggtggccaggcgtgaagcagtgatggaggtgaggaagactatagcggtactntgtagacggccgtattcacctacttcgagagactaacatacgaaanacctacaatgtactcctaacaaatcggancacgtacctagacacgtaccggaacggtaccgtaccggccgttaagttacttacgtggtacggacggaaggttttacgtttttcgggtttaaggggtactttgggtttcgtttaccggtttaccggaaccgtaccgtaaggtccccggtttaccgacccccggttaccgggtctacgttacctttaaccgttcgtacgttcccgttacgggtcggggtcccgtacgtcccgtaccgttcgtactccgttagttcctccgtacncgtccacgaccgacggtccctcgtcccttccgtacccgngtcccctacctccgaaccagcccgtacgaccgtcggtacgtacgtacgccgggtaccgtccggnggtcctaccggtcgtacggtacgtaccgttacctaccgttctactacgtacg

SEQ ID NO: 6571 - DNA, 998 bp, Homo sapiens
  misc_feature: GYAE6OF02JUDAV.52.78.H01.1.454.CMB.1.raw
  modified_base (338)..(338): a, c, t, g, unknown or other
  misc_feature (338)..(338): n is a, c, g, or t
tcagcgcagtacgacacgaccggtgctcgatttagtgtgagtagtttgggtttgggggtagggcgttggtccagcctggggggtcccgtgacgactctcctgtgtgcctctggattcacctttaacagttattggatgtattgggtccgccagggctcccgagggaaggggctgggaggtggggttcgggccgaggcggtaggtaacggcgatggagtgggtaagggtggagggaaacgcgtagttcggaccggaacttcggtggttagaacggggcccggtaatttccgaaccctacgttacccgagaacgtacaaactactacaaaggtaaacctnaagttagtaacttctaacccgaaaagttggaaaacgcgaacgtcccggttagacgtaacgtacccgggaaggtaccgaacccggggacccgtttaggtaaccttttacgtaacggttcggtaccccgaagggttaaccggtttttccggttttaagggggttacccttttaggggtttccgggttttaaggttcccggttaccgtaaacccggtaacgtccgggtttacccggtacccccgggtttccccgggaacctttcgggtcccgtttttaaaaccgttcccgaaacgtttcccgttaacccgggttcccgggggttaccgggtaaccgggttcccggtaaccccccggtttcggtaacccgttaccggttccggtttacccttaccgtttacccggaaccgttaccccgttcccgtaaacccggtaacccggggttacccctaaccgggttttacccggtccccgtttaccccgggtcccggttaccccgtaccccggtttaccccgcccggttaaaccggaccgttaaaccccgcccgttaaccggggtccggggttacccgacgttaccggacccggggtcccgttacggtccgtacggtccgttaccggtacgtaacggtccgttaaccctaccggttactacgtaacccgg

SEQ ID NO: 6572 - DNA, 716 bp, Homo sapiens
  misc_feature: GYAE6OF02FR244.52.78.H01.1.454.CMB.1.raw
  modified_base (234)..(234): a, c, t, g, unknown or other
  misc_feature (234)..(234): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctctcactctctgcacaggctcgtggggcctcctatgaacctgacacacgcctaccctcggtcgtcagttcgtcctcgaggacagaccggccaggatcaccgttgctcgtggaanagtgaccacgtcgaccaacgactaatatggtttaatcggtacaggcagacggccgcggaccgtacccgacccgtttattggggtactaatacgtaagtaaacggtaccagttagaacggaccggccgtaggacgggtaaccgtccgtaggaccgtacggtacttccgtcgtccgtccgttccgtctacgggaggaacctaacgagtaccgtagtagtacgtcgtaactcgacggtttaggcgggtacggtcgaagggacgacgagccgtagtaacggttaattaccggtagtacttaacgtacaaacgtcgtaaccggtaaaggttcgttacggtttaaacgtttgtacggtacgttccggtaacggggttccggtaagggtaaccgggaacctggttacccgtaacggtacccgttaccggttagaaccgaccgtaccgtacggccgttcccgtaacccggtcgtacccaaccctttccgg

SEQ ID NO: 6573 - DNA, 788 bp, Homo sapiens
  misc_feature: GYAE6OF02JX58G.52.78.H01.1.454.CMB.1.raw
  modified_base (725)..(725): a, c, t, g, unknown or other
  misc_feature (725)..(725): n is a, c, g, or t
tcagcgcagtacgacacgaccggtgctcgatttagtgtgagtagtttgggtttgggggtgggtccaggaggcagaactctgggtgtctcaccatggcctggatccctctacttctccccctctcactctctgcacagctcgtgggcctcctatgaactgacacacgccctacccgtcggtgtacagttcgtcctgaaggtccagaccgcctagatccaaccgtgctcgtagggatacgtacgctacgtcgaaaccaaaagtaccaaattaggtacggtttagttaccggtacagacacgaggaccgtacggaccgaccggtaccccgttaagttcggtacggtactaaacgtaacgtaaacggtaaccattaacgacggacggtacccttaaggacggggtaacctcgtacgtaggacgttaacgttccgtaacgtcggtacccttaccgtacgtttaccggaacggtaaacgaacgtaccggtaacgtacggttacgtaaactcgtaaacgtcgtacgggtaagtccggtaccggtacgaacggtacgggaacgacggtacgtaacggttacgtacttaaaccggtgtaacctaaacgtaccgttaaagaaaccgttaaccggacgttaaacggttagtaacgtttaacgtacgggtcttaaaccggttacgggtaccggttaggaaaccgggtaccgtaatcggttaaccgccggtttaacgnggtaaaccgtacccgacggttaacgcccgttaaccgccccggtagttcccggacgtttacccg

SEQ ID NO: 6574 - DNA, 815 bp, Homo sapiens
  misc_feature: GYAE6OF02JBBJC.52.78.H01.1.454.CMB.1.raw
tcagcgcagtacgacacgaccggtgctcgatttagtgtgagtagtttgggtttgggggaggcttggtccagcctgggggggtccctgacactctcctgtgtagcctctggattcacctttaacagttattggatgacttgggtcccgccgaggctccgaggggaaggggctgggagtggggtcggccagcgtgaagcatgagtggagggtgaaggaagtactagtggcggactctggtaggaagggccgattccacctacttccgaagacgaacaaacataccaaagtaacctcaaattgtaactcctaaccaaaattcgaagccaacgcctagaacacgtccggaaggtaaccgacggtccggttagtacgttactggtcgacgtacggtagtttcggtttgggtactttggttacgggttcgtacgtccgtaacgacggtaccgtcccggtaccccgtaacccgggtccgttacgttacccgttaacgttcccggtactttcccgggtttcgggtccgggggtccggtccggtaccccgtacccggttcgggtacctacgttcgtttcccgttcctaccgtaccgtccccttaaccggaaccggaaccgggtccctaacccggtttcccggtccccccgttttaccccggccgttacccccgtaccccctttccgtaccgaaaccggtccgtacccgtacccggttcggggtccggggaccacccgacgggtccccgggtcccgtccgggtactccggttacccggtcggtaacggtaaccggtaacctttaccgtaacctagtaccgtaccg

SEQ ID NO: 6575 - DNA, 934 bp, Homo sapiens
  misc_feature: GYAE6OF02GCCAR.52.78.H01.1.454.CMB.1.raw
tcagcgcagtacgacacgaccggtgctcgatttagtgtgagtagtttgggtttgggggtgggtccaggaggcagaactctgggtgtctcaccatggcctggatccctctacttctccccctcctcactctctgcacaggctcgtgggcctcctatgaactgacacgagtccacccgttcggtgtcaaggtcgttccctcgaaggaccaggaccggcctaggacttccaccgtgccttacgtgggaagtctaggcctaccgtacgaacccgaaaagtactaaagttacgttagggttttaacgtttaccggggttaaccaacggtacgaacgggtaacggacccgtaaacggggcccccgtaccggttacccccccgttttaggtttacgggttagaagtttaacttaaaacggttaaaccgggtaaccgaagttacggaacggtaaccggtccccgttaacggacggggtaccttacccgtggtacgtacggttacttccgttccgtcggtcccgttcccgttccgtacggtaaccgggtaaccaaaccgtacgttaccgtaacggttacgtacttaccgaacgtacgtagggtacgggtaccgggtacccgggtacgaagggaaccgggtacggacggtaaccgttacggtaaccgtttaacgttacgtaaccggttaactaacgtaaccgtaaacggttaacggaaaccggtttaggtttaacgggttaacgttttaaacgtttacgtggggttacgttaccggtttaccggggttaccggggtaaccgggaaacccggggttaaccggtaccggttccggtaacccggggttcccttacccgggtacggttacccgaaccggaacccggtttaccgggcccggttaacccggtcccccgggtttaaggttcccccttaacgtttcccccgg

SEQ ID NO: 6576 - DNA, 316 bp, Homo sapiens
  misc_feature: GYAE6OF01ACCBA.3.78.H01.1.454.CMB.1.raw
  modified_base (307)..(316): a, c, t, g, unknown or other
  misc_feature (307)..(316): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnnnnn

SEQ ID NO: 6577 - DNA, 308 bp, Homo sapiens
  misc_feature: GYAE6OF01AQ69T.3.78.H01.1.454.CMB.1.raw
  modified_base (305)..(308): a, c, t, g, unknown or other
  misc_feature (305)..(308): n is a, c, g, or t
tcagagacgcactccacgaccggtgctcgatttagtgtgagtagtttgggtttgggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctggggcacagcggccctgggctgcctggtcaaggactacttccgagtgcgtctctgagcgggctggcaaggcgcatagnnnn

SEQ ID NO: 6578 - DNA, 310 bp, Homo sapiens
  misc_feature: GYAE6OF01COZ5T.3.78.H01.1.454.CMB.1.raw
  modified_base (306)..(310): a, c, t, g, unknown or other
  misc_feature (306)..(310): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcggctggcaaggcgcatagnnnnn

SEQ ID NO: 6579 - DNA, 308 bp, Homo sapiens
  misc_feature: GYAE6OF01C12T6.3.78.H01.1.454.CMB.1.raw
  modified_base (306)..(308): a, c, t, g, unknown or other
  misc_feature (306)..(308): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgctttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnn

SEQ ID NO: 6580 - DNA, 308 bp, Homo sapiens
  misc_feature: GYAE6OF01BM733.3.78.H01.1.454.CMB.1.raw
  modified_base (306)..(308): a, c, t, g, unknown or other
  misc_feature (306)..(308): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctgggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnn

SEQ ID NO: 6581 - DNA, 383 bp, Homo sapiens
  misc_feature: GYAE6OF01D09TR.3.78.H01.1.454.CMB.1.raw
  modified_base (321)..(321): a, c, t, g, unknown or other
  misc_feature (321)..(321): n is a, c, g, or t
  modified_base (324)..(383): a, c, t, g, unknown or other
  misc_feature (324)..(383): n is a, c, g, or t
tcagagacgcactccacgaccggtgctcgatttagtgtgagtagtttgggtttgggaggtctctgtgaccgtccgcagacacggccatgtattactgtgcgagggcagtataactatggttattccgagtgcttttgatgtctggggccaagggacagtggtcaccgtctcttcagcctcaccaagggcccatcgggtcttccccctggccaccctcgtccgaagagcaccgtcgtcgggggacacagcggccgtgggctgacctggtcaaggactacttccgagtcgcgtctctgagcggctgggcaaggcgacaatcgntgnnnnnnnnnnnnnnnnnnnnnnnnnnnnnnnnnnnnnnnnnnnnnnnnnnnnnnnnnnnn

SEQ ID NO: 6582 - DNA, 256 bp, Homo sapiens
  misc_feature: GYAE6OF01ARJAH.3.78.H01.1.454.CMB.1.raw
  modified_base (253)..(256): a, c, t, g, unknown or other
  misc_feature (253)..(256): n is a, c, g, or t
tcagagacgcactccacgaccggtgctcgatttagtgtgagtagtttgggtttgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttcatcttcccgccatctgagagtgcgtctctgagcgggctggcaaggcgcatagnnnn

SEQ ID NO: 6583 - DNA, 253 bp, Homo sapiens
  misc_feature: GYAE6OF01AXSD7.3.78.H01.1.454.CMB.1.raw
  modified_base (253)..(253): a, c, t, g, unknown or other
  misc_feature (253)..(253): n is a, c, g, or t
tcagagacgcactccacgaccggtgctcgatttagtgtgagtagtttgggtttgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttcatcttcccgccatctgagagtgcgtctctgagcgggctggcaaggcgcatagn

SEQ ID NO: 6584 - DNA, 307 bp, Homo sapiens
  misc_feature: GYAE6OF01ERJS3.3.78.H01.1.454.CMB.1.raw
  modified_base (306)..(307): a, c, t, g, unknown or other
  misc_feature (306)..(307): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctgggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnn

SEQ ID NO: 6585 - DNA, 312 bp, Homo sapiens
  misc_feature: GYAE6OF01C90WU.3.78.H01.1.454.CMB.1.raw
  modified_base (305)..(312): a, c, t, g, unknown or other
  misc_feature (305)..(312): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctgggccaagggacagtggtcaccgtctcttcagcctccaccaagggcccatcggtcttcccctggcaccctcctccaagagcacctctgggggcacagcggccctgggctgcctggtcaaggactacttccgagtgcgtctctgagcgggctggcaaggcgcatagnnnnnnnn

SEQ ID NO: 6586 - DNA, 311 bp, Homo sapiens
  misc_feature: GYAE6OF01D5H2D.3.78.H01.1.454.CMB.1.raw
  modified_base (307)..(311): a, c, t, g, unknown or other
  misc_feature (307)..(311): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnn

SEQ ID NO: 6587 - DNA, 312 bp, Homo sapiens
  misc_feature: GYAE6OF01CYWZ7.3.78.H01.1.454.CMB.1.raw
  modified_base (306)..(312): a, c, t, g, unknown or other
  misc_feature (306)..(312): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctgggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnn

SEQ ID NO: 6588 - DNA, 309 bp, Homo sapiens
  misc_feature: GYAE6OF01CUHNJ.3.78.H01.1.454.CMB.1.raw
  modified_base (305)..(309): a, c, t, g, unknown or other
  misc_feature (305)..(309): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctgggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcggctggcaaggcgcatagnnnnn

SEQ ID NO: 6589 - DNA, 308 bp, Homo sapiens
  misc_feature: GYAE6OF01DSE5D.3.78.H01.1.454.CMB.1.raw
  modified_base (171)..(171): a, c, t, g, unknown or other
  misc_feature (171)..(171): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (253)..(256): a, c, t, g, unknown or other
  misc_feature (253)..(256): n is a, c, g, or t
  modified_base (259)..(308): a, c, t, g, unknown or other
  misc_feature (259)..(308): n is a, c, g, or t
tcagagacgcactccacgaccggtgctcgatttagtgtgagtagtttgggttgggacagacttcgactctcaccatcagcagccgtagagcctagaacgatttcgcagtttattactgtcagcagcgtagcaactcggctgactcaaccttcggcaagggcacgactgganattaaacgactgtgctgcaccagtctgtcttcatcttcccgcatctgagagtgcgtcntgagcggctggacaaggcncatgnnnngcnnnnnnnnnnnnnnnnnnnnnnnnnnnnnnnnnnnnnnnnnnnnnnnnnn

SEQ ID NO: 6590 - DNA, 317 bp, Homo sapiens
  misc_feature: GYAE6OF01BVHKU.3.78.H01.1.454.CMB.1.raw
  modified_base (307)..(317): a, c, t, g, unknown or other
  misc_feature (307)..(317): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnnnnnn

SEQ ID NO: 6591 - DNA, 310 bp, Homo sapiens
  misc_feature: GYAE6OF01AEDZB.3.78.H01.1.454.CMB.1.raw
  modified_base (307)..(310): a, c, t, g, unknown or other
  misc_feature (307)..(310): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnn

SEQ ID NO: 6592 - DNA, 321 bp, Homo sapiens
  misc_feature: GYAE6OF01AFMHW.3.78.H01.1.454.CMB.1.raw
  modified_base (307)..(307): a, c, t, g, unknown or other
  misc_feature (307)..(307): n is a, c, g, or t
  modified_base (313)..(321): a, c, t, g, unknown or other
  misc_feature (313)..(321): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggccaccctcctccaagagccacctcgtgggggcacgagccggccctgggcctgcctggtcaaggactacttccgagtgcgtctctgagcgggctggcaaggcncatagnnnnnnnnn

SEQ ID NO: 6593 - DNA, 313 bp, Homo sapiens
  misc_feature: GYAE6OF01D40VA.3.78.H01.1.454.CMB.1.raw
  modified_base (302)..(302): a, c, t, g, unknown or other
  misc_feature (302)..(302): n is a, c, g, or t
  modified_base (308)..(313): a, c, t, g, unknown or other
  misc_feature (308)..(313): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgacgcgggctggcaaggcncatagnnnnnn

SEQ ID NO: 6594 - DNA, 315 bp, Homo sapiens
  misc_feature: GYAE6OF01DKG8R.3.78.H01.1.454.CMB.1.raw
  modified_base (311)..(315): a, c, t, g, unknown or other
  misc_feature (311)..(315): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtccttcccctggccaccctcctccaagacgcacctcgtgggggcacgagcggccctgggctgcctggtcaaggactacttccgagtgcgtctctgagcggctggcaaggcgacatagnnnnn

SEQ ID NO: 6595 - DNA, 311 bp, Homo sapiens
  misc_feature: GYAE6OF01DEB45.3.78.H01.1.454.CMB.1.raw
  modified_base (197)..(197): a, c, t, g, unknown or other
  misc_feature (197)..(197): n is a, c, g, or t
  modified_base (264)..(311): a, c, t, g, unknown or other
  misc_feature (264)..(311): n is a, c, g, or t
tcagagacgcactccacgaccggtgctcgatttagtgtgagtagtttgggtttgggacagacttcactctcaccatcagctagcctagagcctgaagatttcgcagtttattactgtcagcagcgtagcaactggctgatcaccttcggccaagggcacgctggagattaaacgactgtgctgcaccagtctgtctnatcctccgcatctgagtagtcgcgtctacgtgacgcggtctggccaaggggctcaatagcagcacgnnnnnnnnnnnnnnnnnnnnnnnnnnnnnnnnnnnnnnnnnnnnnnnn

SEQ ID NO: 6596 - DNA, 316 bp, Homo sapiens
  misc_feature: GYAE6OF01C0XZ0.3.78.H01.1.454.CMB.1.raw
  modified_base (307)..(316): a, c, t, g, unknown or other
  misc_feature (307)..(316): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctgggccaagggacagtggtcaccgtctcttcagcctccaccaagggcccatcggtcttccccctggcaccctcctccaagagcacctcgtgggggcacagcggccctgggctgcctggtcaaggactacttccgagtgcgtctctgagcgggctggcaaggcgcatagnnnnnnnnnn

SEQ ID NO: 6597 - DNA, 316 bp, Homo sapiens
  misc_feature: GYAE6OF01COM4S.3.78.H01.1.454.CMB.1.raw
  modified_base (309)..(316): a, c, t, g, unknown or other
  misc_feature (309)..(316): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggccaccctcctccaagagcacctcgtgggggcacagcggccctgggctgcctggtcaaggactactccgagtgcgtctctgagcgggctggcaaggcgcagtagnnnnnnnn

SEQ ID NO: 6598 - DNA, 331 bp, Homo sapiens
  misc_feature: GYAE6OF01CTB2Q.3.78.H01.1.454.CMB.1.raw
  modified_base (319)..(331): a, c, t, g, unknown or other
  misc_feature (319)..(331): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctgggccaagggacagtggtcaccgtctcttcagcctccaccaagggcccatcggtcttccccctggccaccctcctccaagacgccaccgtcgtcggggcacgagcggccctgggctgcctggtcaaggacctacttccgagtgcgtactctggacgcgggatcggacaaggcgacatagnnnnnnnnnnnnn

SEQ ID NO: 6599 - DNA, 331 bp, Homo sapiens
  misc_feature: GYAE6OF01D1L7M.3.78.H01.1.454.CMB.1.raw
  modified_base (317)..(331): a, c, t, g, unknown or other
  misc_feature (317)..(331): n is a, c, g, or t
tcagagacgcactccacgaccggtgctcgatttagtgtgagtagtttgggtttggggagctctgtgaccgccgcagacacggccatgtattactgtgcgagggcatataaactatggttattccgatgcttttgatgtctgggccaagggacagtggtcaccgtctcttcagcctccaccaaggcccatcggtccttccccctggccacccctcctccaagagcaccgtcgtcgggggcacgagcggccctgggctgcctggtcaaggctacttccgagtcgcgtctctgagcgggctggacaagggcgacagtagnnnnnnnnnnnnnnn

SEQ ID NO: 6600 - DNA, 313 bp, Homo sapiens
  misc_feature: GYAE6OF01B0R4L.3.78.H01.1.454.CMB.1.raw
  modified_base (307)..(313): a, c, t, g, unknown or other
  misc_feature (307)..(313): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnn

SEQ ID NO: 6601 - DNA, 317 bp, Homo sapiens
  misc_feature: GYAE6OF01EF6QE.3.78.H01.1.454.CMB.1.raw
  modified_base (303)..(303): a, c, t, g, unknown or other
  misc_feature (303)..(303): n is a, c, g, or t
  modified_base (309)..(317): a, c, t, g, unknown or other
  misc_feature (309)..(317): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaaggcccatcggtctcccctgcaccctcctccaagagcactcgtggggcacgagccggccctgggctgcctggtcaaggtacctacttccgagtcgcgtctctgacgcgggctggcaaggcgnactagnnnnnnnnn

SEQ ID NO: 6602 - DNA, 388 bp, Homo sapiens
  misc_feature: GYAE6OF01BC2V8.3.78.H01.1.454.CMB.1.raw
  modified_base (205)..(205): a, c, t, g, unknown or other
  misc_feature (205)..(205): n is a, c, g, or t
  modified_base (308)..(308): a, c, t, g, unknown or other
  misc_feature (308)..(308): n is a, c, g, or t
  modified_base (315)..(316): a, c, t, g, unknown or other
  misc_feature (315)..(316): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (323)..(333): a, c, t, g, unknown or other
  misc_feature (323)..(333): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (339)..(388): a, c, t, g, unknown or other
  misc_feature (339)..(388): n is a, c, g, or t
tcagagacgcactccacgaccggtgctcgatttagtgtgagtagtttgggtttgggggagctctgtgaccgccgcagacacggccatgtattacctgtgcgagggcatataactatggttattccgatgcttttgatgtctggggccaagggacagtggtcaccgtctcttcagcctccaccaagggcccatcggtcttcccccnggcaccctcctccaagagcacctcgtcgggggcacgagcggccctgggctgcctggtcaaggctacttccgatcgcgtctctgagcgggtctggctaaggcgntagtagnncnagncnnnnnnnnnnnananannnnnnnnnnnnnnnnnnnnnnnnnnnnnnnnnnnnnnnnnnnnnnnnnn

SEQ ID NO: 6603 - DNA, 319 bp, Homo sapiens
  misc_feature: GYAE6OF01A09RZ.3.78.H01.1.454.CMB.1.raw
  modified_base (306)..(319): a, c, t, g, unknown or other
  misc_feature (306)..(319): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggccaccctcctccaagagcacctctgggggcacagcgccctgggctgcctggtcaaggactacttccgagtgcgtctctgagcggctggcaaggcgcatagnnnnnnnnnnnnnn

SEQ ID NO: 6604 - DNA, 335 bp, Homo sapiens
  misc_feature: GYAE6OF01BCS60.3.78.H01.1.454.CMB.1.raw
  modified_base (319)..(335): a, c, t, g, unknown or other
  misc_feature (319)..(335): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaaggcccatcggtccttccccctggccacccctcctccaagagccacctcgtgggggcacgacgccggcccgtgggcctgccgtggtacaaggactactccgagtgctctcgtgacgcggctggcgaaggccgcatagnnnnnnnnnnnnnnnnn

SEQ ID NO: 6605 - DNA, 463 bp, Homo sapiens
  misc_feature: GYAE6OF01AIDUR.3.78.H01.1.454.CMB.1.raw
  modified_base (224)..(224): a, c, t, g, unknown or other
  misc_feature (224)..(224): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (391)..(392): a, c, t, g, unknown or other
  misc_feature (391)..(392): n is a, c, g, or t
  modified_base (397)..(397): a, c, t, g, unknown or other
  misc_feature (397)..(397): n is a, c, g, or t
  modified_base (399)..(450): a, c, t, g, unknown or other
  misc_feature (399)..(450): n is a, c, g, or t
  modified_base (452)..(463): a, c, t, g, unknown or other
  misc_feature (452)..(463): n is a, c, g, or t
tcagagacgcactccacgaccggtgctcgatttagtgtgagtagtttggggtttgggggagctctgtgaccgccgcagacacggccatgtattactgtgcgagggcatataactatggttattccgatgtcttttgattggtcgtggggaccaaggggactaggtcggtcaccgtctcttcacgccctccaacgaacgggcccagttccggttcccttcccccnggccctaccccgtcctaccgaagacgcctaccgtcgggtcgggggaccacgacggcccggtccggtcgggtactcggtccgtggtacgaacggtaccttccgttccgagtcgccgtctagcgacggcggcgtcggacgaggccgacagtangnagtngctncgtagnngtacngnnnnnnnnnnnnnnnnnnnnnnnnnnnnnnnnnnnnnnnnnnnnnnnnnnnngnnnnnnnnnnnn

SEQ ID NO: 6606 - DNA, 339 bp, Homo sapiens
  misc_feature: GYAE6OF01A4K63.3.78.H01.1.454.CMB.1.raw
  modified_base (323)..(339): a, c, t, g, unknown or other
  misc_feature (323)..(339): n is a, c, g, or t
tcagagacgcactccacgaccggtgctcgatttagtgtgagtagtttgggtttgggagctctgtgaccgccgcagacacggccatgtattactgtgcgagggcatataactatggttattccgatgcttttgatgtctgggccaagggcagtggtcaccgtctcttcagcctccaccaacgggcccatccggtccttccccctggccacccctcctccaagacgccacctcgtggggccacacgccggcccgtgggctgccgtgcgaaggactacgttccgagtcgccgtctcgtgacggcggcgtggcaaggcgcagtagcnnnnnnnnnnnnnnnnn

SEQ ID NO: 6607 - DNA, 446 bp, Homo sapiens
  misc_feature: GYAE6OF01DFPRS.3.78.H01.1.454.CMB.1.raw
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (398)..(446): a, c, t, g, unknown or other
  misc_feature (398)..(446): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgtcttttgatggtcgtggggccaagggacaggtggtccaccggtctctcacgccctccaaccgaacgggcccaagtccggtccttccccctaggccctacccctcctaccaaggcgcctaccgtcgggtcgggggcaacgcggcccggtccccgtggggtacctccggtccgtgggtaacaaacgggtaccttaccgttaccggagttcggtactctcggaggcggcgggctagggacgaaggctacaagtggntnccgatntnaaccgntnnnnnnnnnnnnnnnnnnnnnnnnnnnnnnnnnnnnnnnnnnnnnnnnn

SEQ ID NO: 6608 - DNA, 538 bp, Homo sapiens
  misc_feature: GYAE6OF01D4LHA.3.78.H01.1.454.CMB.1.raw
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (487)..(489): a, c, t, g, unknown or other
  misc_feature (487)..(489): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(504): a, c, t, g, unknown or other
  misc_feature (503)..(504): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (519)..(524): a, c, t, g, unknown or other
  misc_feature (519)..(524): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtcgtggggccaagggacagtggtcaccgtctcttcacgcctccaccgaacgggcccagtccggtccttcccccgtggcctaccccgtccctaccgaagacgaccaccgtcggtcgggggaccacgacggccggtcccgtgggcctcgaccgtggtaccgaaacggtaccttaccttccggaggtcgtccgttctacgtaggacggccgggtcgtacgggaccgaacggggtccgacgtaagttacggctagcgtntagcggactgcagcgtaagcgagtcngactgagcgatcgagctgcgagcgangngagagncacgacgcgacacgatatacnagtacagcanactannnaganacngtnangnncgcgcgngngngcgnnnnnngtcanancngngcg

SEQ ID NO: 6609 - DNA, 303 bp, Homo sapiens
  misc_feature: GYAE6OF02IV6JR.3.78.H01.1.454.CMB.1.raw
  modified_base (302)..(303): a, c, t, g, unknown or other
  misc_feature (302)..(303): n is a, c, g, or t
tcagagacgcactccacgaccggtgctcgatttagtgtgagtagtttgggtttgggagctctgtgaccgccgcagacacggccatgtattactgtgcgagggcatataactatggttattccgatgctttgatgtctgggccaagggacagtggtcaccgtctcttcagcctccaccaagggcccatcggtcttcccctggcaccctcctccaagagcacctctggggcacagcggccctgggctgcctggtcaaggactacttccgagtgcgtctctgagcgggctggcaaggcgcatagnn

SEQ ID NO: 6610 - DNA, 324 bp, Homo sapiens
  misc_feature: GYAE6OF02HBULC.3.78.H01.1.454.CMB.1.raw
  modified_base (306)..(324): a, c, t, g, unknown or other
  misc_feature (306)..(324): n is a, c, g, or t
tcagagacgcactccacgaccggtgctcgatttagtgtgagtagtttgggtttgggagctctgtgaccgccgcagacacggccatgtattactgtgcgtagggcatataactatggttattccgatgcttttgatggtctggggccaagggacagtggtcaccgtctcttcagcctccaccaagggcccatcggtcttccccctggcaccctcctccaagagcacctctgggggcacagcggcctgggctgcctggtcaaggctacttccgagtgcgtctctgagcgggctggcaaggcgcatagnnnnnnnnnnnnnnnnnnn

SEQ ID NO: 6611 - DNA, 318 bp, Homo sapiens
  misc_feature: GYAE6OF02HKY8P.3.78.H01.1.454.CMB.1.raw
  modified_base (303)..(303): a, c, t, g, unknown or other
  misc_feature (303)..(303): n is a, c, g, or t
  modified_base (309)..(318): a, c, t, g, unknown or other
  misc_feature (309)..(318): n is a, c, g, or t
tcagagacgcactccacgaccggtgctcgatttagtgtgagtagtttgggtttggggagctctgtagaccgccgcagacacggccatcgtattactgtgcgagggcatataactatggttattccgatgcttttgatgtctgggccaagggacagtggtcaccgtctcttcagcctccaccaagggcccatcggtcttcccccgtggcaccctcctccaagagcacctctgggggcacagcggccctgggctgcctggtcaaggctacttccgagtgcgttctctgagcgggctggcaaggcncatagnnnnnnnnnn

SEQ ID NO: 6612 - DNA, 310 bp, Homo sapiens
  misc_feature: GYAE6OF02I2Z1Y.3.78.H01.1.454.CMB.1.raw
  modified_base (306)..(310): a, c, t, g, unknown or other
  misc_feature (306)..(310): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggctacttccgagtgcgtctctgagcgggctggcaaggcgcatagnnnnn

SEQ ID NO: 6613 - DNA, 310 bp, Homo sapiens; identical to SEQ ID NO: 6591
  misc_feature: GYAE6OF02GUDKP.3.78.H01.1.454.CMB.1.raw
  modified_base (307)..(310): a, c, t, g, unknown or other
  misc_feature (307)..(310): n is a, c, g, or t

SEQ ID NO: 6614 - DNA, 311 bp, Homo sapiens
  misc_feature: GYAE6OF02GMFUX.3.78.H01.1.454.CMB.1.raw
  modified_base (308)..(311): a, c, t, g, unknown or other
  misc_feature (308)..(311): n is a, c, g, or t
tcagagacgcactccacgaccggtgctcgatttagtgtgagtagtttgggtttggggagtctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnn

SEQ ID NO: 6615 - DNA, 359 bp, Homo sapiens
  misc_feature: GYAE6OF02FIJ67.3.78.H01.1.454.CMB.1.raw
  modified_base (290)..(290): a, c, t, g, unknown or other
  misc_feature (290)..(290): n is a, c, g, or t
  modified_base (316)..(359): a, c, t, g, unknown or other
  misc_feature (316)..(359): n is a, c, g, or t
tcagagacgcactccacgaccggtgctcgatttagtgtgagtagtttgggtttggggagcgtctgtgaccgccgcagacgacggccatgtattactgtgcgagggcatataactattggttattccgatgcttttgatgtctggggccaagggacgagtggtcaccgtctcttccagcctccaccaagggccccatcggtcttccccctggccacccgtcctccaaggacgcacctctgggggcacagcggccctgggctgcctggtcaaggctactccgagtagcgtcnctgagcgggctggcaaggcgcatagnnnnnnnnnnnnnnnnnnnnnnnnnnnnnnnnnnnnnnnnnnnn

SEQ ID NO: 6616 - DNA, 326 bp, Homo sapiens
  misc_feature: GYAE6OF02IAH3Z.3.78.H01.1.454.CMB.1.raw
  modified_base (301)..(301): a, c, t, g, unknown or other
  misc_feature (301)..(301): n is a, c, g, or t
  modified_base (307)..(308): a, c, t, g, unknown or other
  misc_feature (307)..(308): n is a, c, g, or t
  modified_base (310)..(326): a, c, t, g, unknown or other
  misc_feature (310)..(326): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctgggccaagggacagtggtcaccgtctcttcagcctccaccaagggcccatcggtcttccccctggcaccctcctccaagagcacctctgggggcacagcggccctgggcctgcctggtcaaggactacttccgagtgcgtctctgagcgggctggcaaggcncatagnngnnnnnnnnnnnnnnnnn

SEQ ID NO: 6617 - DNA, 328 bp, Homo sapiens
  misc_feature: GYAE6OF02FFG2A.3.78.H01.1.454.CMB.1.raw
  modified_base (288)..(288): a, c, t, g, unknown or other
  misc_feature (288)..(288): n is a, c, g, or t
  modified_base (314)..(328): a, c, t, g, unknown or other
  misc_feature (314)..(328): n is a, c, g, or t
tcagagacgcactccacgaccggtgctcgatttagtgtgagtagtttgggtttggggagctctcgtgaccgccgcagacacggcctatgtattactgtgcgaggcatataactatggttattccgatgcttttgatgtctgggccaagggtcagtggtcaccgttctcttcagcctccaccaagggcccatccggtcttccccgtggccacccgtctccaagagccaccgtcgtggggcacgacgccggccctgggctgccgtggtcaaggctacttccgatgcgtcnctgagcgggctggcaaggcgcatagnnnnnnnnnnnnnnn

SEQ ID NO: 6618 - DNA, 256 bp, Homo sapiens; identical to SEQ ID NO: 6582
  misc_feature: GYAE6OF02HXAV4.3.78.H01.1.454.CMB.1.raw
  modified_base (253)..(256): a, c, t, g, unknown or other
  misc_feature (253)..(256): n is a, c, g, or t

SEQ ID NO: 6619 - DNA, 309 bp, Homo sapiens
  misc_feature: GYAE6OF02FSWQI.3.78.H01.1.454.CMB.1.raw
  modified_base (307)..(309): a, c, t, g, unknown or other
  misc_feature (307)..(309): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnn

SEQ ID NO: 6620 - DNA, 307 bp, Homo sapiens
  misc_feature: GYAE6OF02IA24K.3.78.H01.1.454.CMB.1.raw
  modified_base (300)..(300): a, c, t, g, unknown or other
  misc_feature (300)..(300): n is a, c, g, or t
  modified_base (306)..(307): a, c, t, g, unknown or other
  misc_feature (306)..(307): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaaggcccatcggtcttccccctggcaccctcctccaagagcacctctgggggcacagcggccctgggctgcctggtcaaggactacttccgagtgcgtctctgagcgggctggcaaggcncatagnn

SEQ ID NO: 6621 - DNA, 258 bp, Homo sapiens
  misc_feature: GYAE6OF02H6HH7.3.78.H01.1.454.CMB.1.raw
  modified_base (252)..(258): a, c, t, g, unknown or other
  misc_feature (252)..(258): n is a, c, g, or t
tcagagacgcactccacgaccggtgctcgatttagtgtgagtagtttgggtttgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttcatcttcccgcatctgagagtgcgtctctgagcgggctggcaaggcgcatagnnnnnnn

SEQ ID NO: 6622 - DNA, 311 bp, Homo sapiens; identical to SEQ ID NO: 6586
  misc_feature: GYAE6OF02F7D6K.3.78.H01.1.454.CMB.1.raw
  modified_base (307)..(311): a, c, t, g, unknown or other
  misc_feature (307)..(311): n is a, c, g, or t

SEQ ID NO: 6623 - DNA, 316 bp, Homo sapiens
  misc_feature: GYAE6OF02JSIC7.3.78.H01.1.454.CMB.1.raw
  modified_base (308)..(316): a, c, t, g, unknown or other
  misc_feature (308)..(316): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggccaccctcctccaagacgcacctctgggggcacagcggccctgggctgcctggtcaaggctacttccgagtgcgtctctgagcgggctggcaaggcgcatagnnnnnnnnn

SEQ ID NO: 6624 - DNA, 255 bp, Homo sapiens
  misc_feature: GYAE6OF02GCBE3.3.78.H01.1.454.CMB.1.raw
  modified_base (253)..(255): a, c, t, g, unknown or other
  misc_feature (253)..(255): n is a, c, g, or t
tcagagacgcactccacgaccggtgctcgatttagtgtgagtagtttgggtttgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttcatcttcccgccatctgagagtgcgtctctgagcgggctggcaaggcgcatagnnn

SEQ ID NO: 6625 - DNA, 256 bp, Homo sapiens; identical to SEQ ID NO: 6582
  misc_feature: GYAE6OF02FYAO8.3.78.H01.1.454.CMB.1.raw
  modified_base (253)..(256): a, c, t, g, unknown or other
  misc_feature (253)..(256): n is a, c, g, or t

SEQ ID NO: 6626 - DNA, 258 bp, Homo sapiens
  misc_feature: GYAE6OF02HWDQU.3.78.H01.1.454.CMB.1.raw
  modified_base (254)..(258): a, c, t, g, unknown or other
  misc_feature (254)..(258): n is a, c, g, or t
tcagagacgcactccacgaccggtgctcgatttagtgtgagtagtttgggtttgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttcatcttcccgccatctgagagtgcgtctctgagcgggctggccaaggcgcatagnnnnn

SEQ ID NO: 6627 - DNA, 324 bp, Homo sapiens
  misc_feature: GYAE6OF02H5IN1.3.78.H01.1.454.CMB.1.raw
  modified_base (307)..(324): a, c, t, g, unknown or other
  misc_feature (307)..(324): n is a, c, g, or t
tcagagacgcactccacgaccggtgctcgatttagtgtgagtagtttgggtttgggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcggctggcaaggcgcatagnnnnnnnnnnnnnnnnnn

SEQ ID NO: 6628 - DNA, 311 bp, Homo sapiens
  misc_feature: GYAE6OF02G6U1I.3.78.H01.1.454.CMB.1.raw
  modified_base (306)..(311): a, c, t, g, unknown or other
  misc_feature (306)..(311): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttcccctggcaccctcctccaagagcacctctgggggcacagcggccctgggctgcctggtcaaggactacttccgagtgcgtctctgagcgggctggcaaggcgcatagnnnnnn

SEQ ID NO: 6629 - DNA, 310 bp, Homo sapiens
  misc_feature: GYAE6OF02GJ4T2.3.78.H01.1.454.CMB.1.raw
  modified_base (300)..(300): a, c, t, g, unknown or other
  misc_feature (300)..(300): n is a, c, g, or t
  modified_base (306)..(310): a, c, t, g, unknown or other
  misc_feature (306)..(310): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcggctggcaaggcncatagnnnnn

SEQ ID NO: 6630 - DNA, 402 bp, Homo sapiens
  misc_feature: GYAE6OF02JAZSC.3.78.H01.1.454.CMB.1.raw
  modified_base (308)..(309): a, c, t, g, unknown or other
  misc_feature (308)..(309): n is a, c, g, or t
  modified_base (315)..(316): a, c, t, g, unknown or other
  misc_feature (315)..(316): n is a, c, g, or t
  modified_base (323)..(324): a, c, t, g, unknown or other
  misc_feature (323)..(324): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (339)..(343): a, c, t, g, unknown or other
  misc_feature (339)..(343): n is a, c, g, or t
  modified_base (345)..(402): a, c, t, g, unknown or other
  misc_feature (345)..(402): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctggggccaagggacagtggtcaccgtctcttcagcctccaccaagggcccatcggtcttccccctggcaccctctccaagagcacctctgggggcacagcggccctgggctgcctggtcaaggactacttccgatgcgtctcctgagcgggctggcaaggcgcagtagtnnagtcanncgtgcanngcncgtncnctggcnnnnncnnnnnnnnnnnnnnnnnnnnnnnnnnnnnnnnnnnnnnnnnnnnnnnnnnnnnnnnnn

SEQ ID NO: 6631 - DNA, 321 bp, Homo sapiens
  misc_feature: GYAE6OF02H3EZE.3.78.H01.1.454.CMB.1.raw
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (314)..(315): a, c, t, g, unknown or other
  misc_feature (314)..(315): n is a, c, g, or t
  modified_base (318)..(321): a, c, t, g, unknown or other
  misc_feature (318)..(321): n is a, c, g, or t
tcagagacgcactccacgaccggtgctcgatttagtgtgagtagtttgggtttgggagctctgtgaccgccgcagacacggcatgtattactgtgcgagggcatataactatggttattccgatgcttttgatgtctgggccaagggacagtggtcaccgtctctcagcctccaccaaggcccatcggtcttccccctggccaccctcctccaagacgcacctcgtgggggcactagcggccctgggctgcctggtccaaggactacttccggagtgcgtctctgacgcgggctggcaaggcgccatagngncnngcnnnn

SEQ ID NO: 6632 - DNA, 335 bp, Homo sapiens
  misc_feature: GYAE6OF02JWWQX.3.78.H01.1.454.CMB.1.raw
  modified_base (323)..(335): a, c, t, g, unknown or other
  misc_feature (323)..(335): n is a, c, g, or t
tcagagacgcactccacgaccggtgctcgatttagtgtgagtagtttgggtttggggtagctctgtgaccgccgcagacacggccatgtattactgtgcgagggcatataactatggttattccgatgcttttgatgtctggggccaagggacagtggtcaccgtctcttcagcctccaccaaggcccatcggtcttccccctggccaccctcctccaagacgccacctctgggggccacgagcggccctgggcctcggcctggtcaacggacctacttccgagtgcgtctcctgacggcgggctgggcaaggcgacatacgnnnnnnnnnnnnn

SEQ ID NO: 6633 - DNA, 373 bp, Homo sapiens
  misc_feature: GYAE6OF02JSE4E.3.78.H01.1.454.CMB.1.raw
  modified_base (321)..(322): a, c, t, g, unknown or other
  misc_feature (321)..(322): n is a, c, g, or t
  modified_base (325)..(373): a, c, t, g, unknown or other
  misc_feature (325)..(373): n is a, c, g, or t
tcagagacgcactccacgaccggtgctcgatttagtgtgagtagtttgggtttgggggagctctgtgaccgccgcagacacggccatgtattactgtgcgagggcatataactatggttattccgatgcttttgatgtctggggccaagggacagtggtcaccgtctcttcagcctccaccaacgggcccatccggtccttcccccctggccaccctcctccaagacgccacctcgtgggggcacgagcggcccgtgggctgccgtggtcaaggactattccgagtgcgtctctgagcgggctgggcaaggcgacagtagnngcnnnnnnnnnnnnnnnnnnnnnnnnnnnnnnnnnnnnnnnnnnnnnnnnn

SEQ ID NO: 6634 - DNA, 316 bp, Homo sapiens
  misc_feature: GYAE6OF02JEKTD.3.78.H01.1.454.CMB.1.raw
  modified_base (306)..(316): a, c, t, g, unknown or other
  misc_feature (306)..(316): n is a, c, g, or t
tcagagacgcactccacgaccggtgctcgatttagtgtgagtagtttgggtttggggagctctgtgaccgccgcagacacggccatgtattactgtgcgagggcatataactatggttattccgatgcttttgatgtctgggccaagggacagtggtcaccgtctcttcagcctccaccaagggcccatcgtcttcccctggcaccctctcaagagcacctcgtggggcacagccggccctggggctgccgtggtcaaggctacttccggagtgcgtctctgagcgggctggcaaggcgcaagtgnnnnnnnnnnn

SEQ ID NO: 6635 - DNA, 477 bp, Homo sapiens
  misc_feature: GYAE6OF02FRMMR.3.78.H01.1.454.CMB.1.raw
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (404)..(406): a, c, t, g, unknown or other
  misc_feature (404)..(406): n is a, c, g, or t
  modified_base (409)..(411): a, c, t, g, unknown or other
  misc_feature (409)..(411): n is a, c, g, or t
  modified_base (418)..(418): a, c, t, g, unknown or other
  misc_feature (418)..(418): n is a, c, g, or t
  modified_base (426)..(427): a, c, t, g, unknown or other
  misc_feature (426)..(427): n is a, c, g, or t
  modified_base (430)..(430): a, c, t, g, unknown or other
  misc_feature (430)..(430): n is a, c, g, or t
  modified_base (434)..(435): a, c, t, g, unknown or other
  misc_feature (434)..(435): n is a, c, g, or t
  modified_base (437)..(437): a, c, t, g, unknown or other
  misc_feature (437)..(437): n is a, c, g, or t
  modified_base (439)..(440): a, c, t, g, unknown or other
  misc_feature (439)..(440): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (446)..(454): a, c, t, g, unknown or other
  misc_feature (446)..(454): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (461)..(462): a, c, t, g, unknown or other
  misc_feature (461)..(462): n is a, c, g, or t
  modified_base (464)..(465): a, c, t, g, unknown or other
  misc_feature (464)..(465): n is a, c, g, or t
  modified_base (467)..(468): a, c, t, g, unknown or other
  misc_feature (467)..(468): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (475)..(476): a, c, t, g, unknown or other
  misc_feature (475)..(476): n is a, c, g, or t
tcagagacgcactccacgaccggtgctcgatttagtgtgagtagtttgggtttgggagcctctgtgaccgccgcagacacggccatgtattactgtgcgagggcatataactatggttattccgatgcttttgactgtctgggccaagggacagtggtcaccgtctccttcagcctccaccaaggcccagtcggtcttcccctggcaccctctccaagagccacctacgtcggggacacgacgccggtccctgggctcggtacctggttacaacggtacttaccgttcgaagtgccgtcgtctacggtacgcggtcttggacaaggcgactacgtagcgtgngntcgctcgatntacncgtatcgcgtntcgactncgacgngatatcgngtantanagtgngnnntcnnnagatganagctcgtnntcncacnncncnncngncnnnnnnnnncncgncnnanncnncngcncnnc

SEQ ID NO: 6636 - DNA, 258 bp, Homo sapiens
  misc_feature: GYAE6OF01BYCTH.7.21.B10.1.454.CMB.1.raw
  modified_base (256)..(258): a, c, t, g, unknown or other
  misc_feature (256)..(258): n is a, c, g, or t
tcagcgtgtctctacacgaccggtgctcgatttagtgtcgtcgcaagaggaggggaaccagcgggagttccaagtactcctttgacgtctgggccagggtaccctggtcaccgtctcctcagcctccaccaagggcccatcggtcttcccctggcgccctgctccaggagcatctccgagagcacagcggccctgggctgcctggtcaaggactacttcctagagacacgctgagcgggctggcaaggcgcatagnnn

SEQ ID NO: 6637 - DNA, 236 bp, Homo sapiens
  misc_feature: GYAE6OF01D4OYP.7.21.B10.1.454.CMB.1.raw
  modified_base (205)..(236): a, c, t, g, unknown or other
  misc_feature (205)..(236): n is a, c, g, or t
tcagcgtgtctctacacgaccggtgctcgatttagtgtcgtcgcaagagaggagggggttttggtctgagcctcagtcactgtgttatgtcttcggaactgggaccaaggtcaccgtcctaggtcagcccaaggccaaccccactgtcactctgttcccaccctcctctagtagacacgctgagcgggctggcaaggcgcatagnnnnnnnnnnnnnnnnnnnnnnnnnnnnnnnn

SEQ ID NO: 6638 - DNA, 292 bp, Homo sapiens
  misc_feature: GYAE6OF01DT5KS.7.21.B10.1.454.CMB.1.raw
  modified_base (150)..(150): a, c, t, g, unknown or other
  misc_feature (150)..(150): n is a, c, g, or t
  modified_base (212)..(213): a, c, t, g, unknown or other
  misc_feature (212)..(213): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (219)..(221): a, c, t, g, unknown or other
  misc_feature (219)..(221): n is a, c, g, or t
  modified_base (224)..(224): a, c, t, g, unknown or other
  misc_feature (224)..(224): n is a, c, g, or t
  modified_base (228)..(292): a, c, t, g, unknown or other
  misc_feature (228)..(292): n is a, c, g, or t
tcagcgtgtctctacacgaccggtgctcgatttagtgtcgtcgcaagagaggagggggttttggtctgacgccgttcagtcacttgtgttatggtcttcgggaactgggaccaaggtcaccgttcctaggtcagcccaaggccaaccccntgtcactctgttccccaccctctctagagacacgctgagcgggctggcaaggccgcagtagnntnancnnncgnagtnnnnnnnnnnnnnnnnnnnnnnnnnnnnnnnnnnnnnnnnnnnnnnnnnnnnnnnnnnnnnnnnn

SEQ ID NO: 6639 - DNA, 267 bp, Homo sapiens
  misc_feature: GYAE6OF01BAW6Q.7.21.B10.1.454.CMB.1.raw
  modified_base (259)..(267): a, c, t, g, unknown or other
  misc_feature (259)..(267): n is a, c, g, or t
tcagcgtgtctctacacgaccggtgctcgatttagtgtcgtcgcaagaggaggggggaaccagcgggagttccaagtactcctttgacgtctggggccagggtaccctggtcaccgtctcctcagcctccaccaagggcccatcggtcttcccctggcgccctgctccaggagcacctccgagagcacagcggccctgggctgcctggtcaaggactacttcctagagacacgctgagcgggctggcaaggcgcatagnnnnnnnnn

SEQ ID NO: 6640 - DNA, 287 bp, Homo sapiens
  misc_feature: GYAE6OF01E23S9.7.21.B10.1.454.CMB.1.raw
  modified_base (268)..(268): a, c, t, g, unknown or other
  misc_feature (268)..(268): n is a, c, g, or t
  modified_base (274)..(287): a, c, t, g, unknown or other
  misc_feature (274)..(287): n is a, c, g, or t
tcagcgtgtctctacacgaccggtgctcgattttagtgtcgtcgcaagagggaggggggaaccagcgggagttccaagtactcctttgacgtctggggccagggtacccctggtcacccgtctccctcagccctccaccaagggccccatcggtccttccccctggccgcccctgcctccaggagcacctccgagagcacagccggccctgggctgcctggtcaaggacttacttcctagagacacgctgagcgggctggacaaggcncatagnnnnnnnnnnnnnn

SEQ ID NO: 6641 - DNA, 251 bp, Homo sapiens
  misc_feature: GYAE6OF02G2YBN.7.21.B10.1.454.CMB.1.raw
  modified_base (212)..(251): a, c, t, g, unknown or other
  misc_feature (212)..(251): n is a, c, g, or t
tcagcgtgtctctacacgaccggtgctcgatttagtgtcgtcgcaaggagagagggggttttggtctgagcctcgagtcactgtgttatgtcttcggaacctgggaccaaggtccaccgtcctaggtcagcccaaggccaaccccgactgtcactcctgttcccgccctcctctagagacacgcctcgagcgggctggcaacggcgcatagnnnnnnnnnnnnnnnnnnnnnnnnnnnnnnnnnnnnnnnn

SEQ ID NO: 6642 - DNA, 640 bp, Homo sapiens
  misc_feature: GYAE6OF02F1RWY.7.21.B10.1.454.CMB.1.raw
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (240)..(241): a, c, t, g, unknown or other
  misc_feature (240)..(241): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (273)..(275): a, c, t, g, unknown or other
  misc_feature (273)..(275): n is a, c, g, or t
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
tcagcgtgtctctacacgaccggtgctcgattttagtgtcgtcgcaagtaggtagggacgggggttttaacggtctcgacgtccgtcagttccactgtgttatgtccttcggaacctgggaccaaggtcacccgtcgtaggtcagccctaaggccaaccccactgtcactctagttcccgccctcctctacgagacacgctggagcgggctggcgaacggcgacgataaggccgngcngnngctcngngngctntgtactgttcatcncgcgnnnctagtganagacgacgagagangacgcgacgcacatatatgngcgngaggtggngtgttagtatactactacttattattacttcgtaggtcgtacggtggacgaacggtacgtacgtacgtaccgtcctacctaccgtaccgtacccgaaccggaccggaccgtaccgtccgtccgttccccgtccgcccgtcccgtccgtccgtaccgacggtacgtaccgtaccgtaccggtacggacgacgaccgaccggccggtccgtcggtcgtcgtccgtcgtacgtaccggtaccgttaccgttacccgttccgtccgttaccgtacgtacggtacggtccggtacggtacggtaccggacggtacg

SEQ ID NO: 6643 - DNA, 471 bp, Homo sapiens
  misc_feature: GYAE6OF01CT3FD.14.5.A05.1.454.CMB.1.raw
  modified_base (415)..(415): a, c, t, g, unknown or other
  misc_feature (415)..(415): n is a, c, g, or t
  modified_base (463)..(471): a, c, t, g, unknown or other
  misc_feature (463)..(471): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctggacagacttcactctcaccatcagcagcctagagtctgaagtattttgctagtttatactgtcagcaggcggggctaagttggccgtctctacgtttcgggcgggggaccagggtggagttcaacgatggtgctgcacatctgtctctactcctcccncactctgagtactagacgctgaggcggcgtggcgaaggcgacagtagnnnnnnnnn

SEQ ID NO: 6644 - DNA, 469 bp, Homo sapiens
  misc_feature: GYAE6OF01A555K.14.5.A05.1.454.CMB.1.raw
  modified_base (433)..(433): a, c, t, g, unknown or other
  misc_feature (433)..(433): n is a, c, g, or t
  modified_base (454)..(454): a, c, t, g, unknown or other
  misc_feature (454)..(454): n is a, c, g, or t
  modified_base (461)..(469): a, c, t, g, unknown or other
  misc_feature (461)..(469): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgctagtttattactgtcagcagcgtacaactggcctcctgcgctcactttcggcggagggaccaaggtggagatcaaacgactgtggctgcacatctgtcttcatccttcccgcatctgatactagacnctgagcgggctggcgaacggncgatcgnnnnnnnnn

SEQ ID NO: 6645 - DNA, 580 bp, Homo sapiens
  misc_feature: GYAE6OF01CGXO0.14.5.A05.1.454.CMB.1.raw
  modified_base (572)..(572): a, c, t, g, unknown or other
  misc_feature (572)..(572): n is a, c, g, or t
  modified_base (574)..(580): a, c, t, g, unknown or other
  misc_feature (574)..(580): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatccagggccacgtggcatccccagccaggttcaggtggcaggtgggtctggggacagtaccttcactcctacaccatcagcacgcctagagcctagaagtattttgactagtttattactgtcagcagcgtaccaactcggccctcgtgcgtctcgtaccgtttcgggacggtagggaacgtaagggtggaagactaaccgaaacggtaacgtggtcggcctaggacctaaccctagttccgttcggtcctttacctaacttcccgttacccccgtctaacttccgttacggtaacgttaccgacgtaccggagtcgggaccggtcgggaccgtcgggaacgacgggcgacgtagtacgnannnnnnn

SEQ ID NO: 6646 - DNA, 491 bp, Homo sapiens
  misc_feature: GYAE6OF01D3DBO.14.5.A05.1.454.CMB.1.raw
  modified_base (348)..(348): a, c, t, g, unknown or other
  misc_feature (348)..(348): n is a, c, g, or t
  modified_base (378)..(378): a, c, t, g, unknown or other
  misc_feature (378)..(378): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (486)..(487): a, c, t, g, unknown or other
  misc_feature (486)..(487): n is a, c, g, or t
  modified_base (489)..(491): a, c, t, g, unknown or other
  misc_feature (489)..(491): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcacgggccactggcatcccagccaggttcagtggcagtgggtctggacagacttcactctcaccatcagcagcctagacgcctagaagtattttgctagtttatactgtcagcagcgtacaacgtcgcctctgcnctctacgttcggcggacgggaccaggtganagtacaaacgaactgtagctagccactatctagtcttcncttcctccncctatcgtntagtacagaccgcgtggagcgggcgtcggacgaacggcganagtgntgnanncnnn

SEQ ID NO: 6647 - DNA, 643 bp, Homo sapiens
  misc_feature: GYAE6OF01CR2P7.14.5.A05.1.454.CMB.1.raw
  modified_base (630)..(630): a, c, t, g, unknown or other
  misc_feature (630)..(630): n is a, c, g, or t
  modified_base (635)..(637): a, c, t, g, unknown or other
  misc_feature (635)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggcctcccaggctcctcatctatgatgcatccatcgagggccacgtggcactcccagccaggttcaggtgcaggtggtcgtgggacagacttcactctcacctatcagcacgcctagacgcctaggtaagtgttttgacttaagtttacttaactcgtacacgcgagtaccgtaacctaacgtcggtccctccgtcggtccgtcttaccgttaaccggtttcgggaccgggtaacggggaacccgtaaggggtacggaacgtaacgtaaccgaaaacgtacgttgggtacggtcgtacgacccgtaacctagttccttggtttacccttctaaccgtttcccgttccccgtacctacgttccgtacggtaacgttaaccgtacggtaccgtcgttacggaccgggtcggggtccgtacgggtaccggtaacgggccgtacgaggttacgncgtannncngngn

SEQ ID NO: 6648 - DNA, 462 bp, Homo sapiens
  misc_feature: GYAE6OF02GTA79.14.5.A05.1.454.CMB.1.raw
  modified_base (452)..(453): a, c, t, g, unknown or other
  misc_feature (452)..(453): n is a, c, g, or t
  modified_base (457)..(462): a, c, t, g, unknown or other
  misc_feature (457)..(462): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtggtctgggacagacttcactctcaccatcagcagcctagagcctgaagattttgcagtttattactgtcagcagcgtacaactggcctctgcgctcactttcggcgggggacaggtgagatcaaacgactgtgctgcacatctgtctcatctcccgcatctgacgtactagacgctgagcggctggcaacggcgcagtagcnngtcnnnnnn

SEQ ID NO: 6649 - DNA, 464 bp, Homo sapiens
  misc_feature: GYAE6OF02IUIBQ.14.5.A05.1.454.CMB.1.raw
  modified_base (448)..(448): a, c, t, g, unknown or other
  misc_feature (448)..(448): n is a, c, g, or t
  modified_base (454)..(464): a, c, t, g, unknown or other
  misc_feature (454)..(464): n is a, c, g, or t
tcagcgtctagtaccacgaccggtgctcgatttagatagatagacagggtgcctgggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcatgggtctgggacagacttcactctcaccatcagcagcctagagcctgaagattttgcagtttattactgtcagtcagcggggcaattggccgctcacgtttcggcgggggaccaaggtggagttcgaacgaactgtggctgcacatctgtcttcatcttcccgcatctgagtactagacgctgagcggctggcaaggcncatagnnnnnnnnnnn

SEQ ID NO: 6650 - DNA, 474 bp, Homo sapiens
  misc_feature: GYAE6OF02FR8ZV.14.5.A05.1.454.CMB.1.raw
  modified_base (468)..(474): a, c, t, g, unknown or other
  misc_feature (468)..(474): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctggggacagacttcactctcaccatcagcagcctagagcctgaagatttgctagtttattactgtcagcagcgtaccaactggcctcctgcgctcactttcggcggacgggaccaagggtggagatacaaacgaactgtggctgcaccatctgtcttcatccttcccgcctatctgagtactagacgctgagcgggctggcgaaggcgcatgnnnnnnn

SEQ ID NO: 6651 - DNA, 465 bp, Homo sapiens
  misc_feature: GYAE6OF02JE6KW.14.5.A05.1.454.CMB.1.raw
  modified_base (456)..(465): a, c, t, g, unknown or other
  misc_feature (456)..(465): n is a, c, g, or t
tcagcgtctagtaccacgaccggtgctcgatttagatagatagacagggtgcctggagactgtgttgacacagtctccaggcaccctgtccttgtctccagggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagccctagagcctgaagattttgcagtttattactgtcagcagcgtacaactggcctctgcgctcactttcggcgagggaccaaggtggagatcaaacgactgtgctgcaccatctgtcttcatccttccgcatctgagtactaacgctgacgcgggctggcaaggcgcatagnnnnnnnnnn

SEQ ID NO: 6652 - DNA, 878 bp, Homo sapiens
  misc_feature: GYAE6OF02GUWWJ.14.5.A05.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (864)..(864): a, c, t, g, unknown or other
  misc_feature (864)..(864): n is a, c, g, or t
  modified_base (876)..(876): a, c, t, g, unknown or other
  misc_feature (876)..(876): n is a, c, g, or t
  modified_base (878)..(878): a, c, t, g, unknown or other
  misc_feature (878)..(878): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcggcgcngcgacnccncgcacgtcgtacgtaggcgacgtgggtcgtggtcggagacgttctactactcctaccaacctactacgacgacgaccgtaccgtaaggccgtaccgtaaggtaaagtttttacgtttcgaaccggttttaagtttttaacctttacggttcgtaacgtacgtacgtacggtaaccccgttaaaccgtaacggtcccggttacccctttccggtccggtacccgttcccgttaaccctttttacccggggtttcccgggggaacgggggtaaaccccgggtaaaccggggtaggggggtaacggaaacggttacccgtaaaaaccgggtaaaaacccggttacggtttcgggggtaccggttaccggtaccgaaaccccccgtaaaatttcccggttttaccggtttacccgtttttacccgttaaactttaccccgttttttcccccccgggtacccccgtaaaccgtttacccttttaccggggtaaacgggttttaaacccgtttaaaccggggttaacccgggtaaccccggtttccggtaaaacggggggtaccccggggggtcccggtttaccggggttccgggaaaacggggtaacccggggtacccctaaaggttaaggtacgcgtancgagcctagcgngn

SEQ ID NO: 6653 - DNA, 465 bp, Homo sapiens
  misc_feature: GYAE6OF02IIZK9.14.5.A05.1.454.CMB.1.raw
  modified_base (341)..(341): a, c, t, g, unknown or other
  misc_feature (341)..(341): n is a, c, g, or t
  modified_base (387)..(387): a, c, t, g, unknown or other
  misc_feature (387)..(387): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
  modified_base (457)..(465): a, c, t, g, unknown or other
  misc_feature (457)..(465): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtgcagtggtctgggacagacttcactctcaccatcagcagcctagagcctgaagattttgcagttttattactgtcagcagcgtaccaactggcctcngcgctcactttcggcggagggaccaaggtggagatcaaacgactgnggctgcaccatctgtcttcatcttccgccatctgagtactagcntgagcgggctgggcaaggcncatagnnnnnnnnn

SEQ ID NO: 6654 - DNA, 472 bp, Homo sapiens
  misc_feature: GYAE6OF02HEY0C.14.5.A05.1.454.CMB.1.raw
  modified_base (414)..(414): a, c, t, g, unknown or other
  misc_feature (414)..(414): n is a, c, g, or t
  modified_base (464)..(464): a, c, t, g, unknown or other
  misc_feature (464)..(464): n is a, c, g, or t
  modified_base (467)..(472): a, c, t, g, unknown or other
  misc_feature (467)..(472): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccactggcctctgcgctcactttcggcggaggaccaaggtggagatacaaacgactgtaggctgcaccatctgtcttcatctccnctatctgagtactagacgctgagcgggctgggctaacgggcgacagtagncannnnnn

SEQ ID NO: 6655 - DNA, 486 bp, Homo sapiens
  misc_feature: GYAE6OF02HJ0WA.14.5.A05.1.454.CMB.1.raw
  modified_base (295)..(295): a, c, t, g, unknown or other
  misc_feature (295)..(295): n is a, c, g, or t
  modified_base (469)..(469): a, c, t, g, unknown or other
  misc_feature (469)..(469): n is a, c, g, or t
  modified_base (478)..(486): a, c, t, g, unknown or other
  misc_feature (478)..(486): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagccngaagtattttgctagtttattactgtcagcagcgtaccaactggcctctgcgctcactttcggcggagggaccaagggtggagatacaaacgaactgtggctgccacaatctgttcttcatccttcccgcacttctagacgtactagaacgctgagcgggctggacgaacggcncaatacggnnnnnnnnn

SEQ ID NO: 6656 - DNA, 485 bp, Homo sapiens
  misc_feature: GYAE6OF02IVAF4.14.5.A05.1.454.CMB.1.raw
  modified_base (301)..(301): a, c, t, g, unknown or other
  misc_feature (301)..(301): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (449)..(449): a, c, t, g, unknown or other
  misc_feature (449)..(449): n is a, c, g, or t
  modified_base (476)..(477): a, c, t, g, unknown or other
  misc_feature (476)..(477): n is a, c, g, or t
  modified_base (480)..(485): a, c, t, g, unknown or other
  misc_feature (480)..(485): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagtnttttgctagtttattactgtcagcagcgtaaccactgcctctgcgctcacttcggcggaggaccaggtggagatacaaacgactgtgctcgcaccntctgtcttcncttcctccgctatctgacgtactagacgctagcggccgggtntcgggacgaagggccgacgtaagtagnngcnnnnnn

SEQ ID NO: 6657 - DNA, 624 bp, Homo sapiens
  misc_feature: GYAE6OF02ILW32.14.5.A05.1.454.CMB.1.raw
  modified_base (586)..(586): a, c, t, g, unknown or other
  misc_feature (586)..(586): n is a, c, g, or t
  modified_base (590)..(590): a, c, t, g, unknown or other
  misc_feature (590)..(590): n is a, c, g, or t
  modified_base (592)..(593): a, c, t, g, unknown or other
  misc_feature (592)..(593): n is a, c, g, or t
  modified_base (622)..(623): a, c, t, g, unknown or other
  misc_feature (622)..(623): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactgcatcccagccaggttcagtggcagtggtctgggacagacttcactctcaccatcagcagcctagacgcctagaagtacttttgctaagtttatttaactgttacagacacgcgtaaccaactggtacctccgtgcgctctactttcggacgtagggaccagggtgagataacgaaacgtaactggtacggtctacggaccacctaactttccgtacgtacctttcgaaccgtttccccgttacccgacccgttaacttccgtaggaacgtttaacccgtaacgtaccggttacctacgggtaacggtcccggggttaccgttacgggaccgggaaacgggttaccggaccgtaagtaacggngacnannctttttttttttttttttttttttttagnng

SEQ ID NO: 6658 - DNA, 547 bp, Homo sapiens
  misc_feature: GYAE6OF02IAK8I.14.5.A05.1.454.CMB.1.raw
  modified_base (546)..(547): a, c, t, g, unknown or other
  misc_feature (546)..(547): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggtcagtggcagtggtctgggacagacttcactctcacatcagcagcctagagcctgaagtattttgactagtttattactgtcagcagtcgtaccaactggacctctgcgctcactttcggcggtacgggaccaaggtggacgatcgaaaacgtactggtaggctgacctaccatcgttacgtcgttacacttcccttacccgcctaacgttccgttagaacgttactacggtaccgtccgtagacggtaccgggtcgtacgggccgtaaacggggccgacctaagttacggatcgacgctagctacgnn

SEQ ID NO: 6659 - DNA, 514 bp, Homo sapiens
  misc_feature: GYAE6OF02IQLU1.14.5.A05.1.454.CMB.1.raw
  modified_base (272)..(272): a, c, t, g, unknown or other
  misc_feature (272)..(272): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (504)..(506): a, c, t, g, unknown or other
  misc_feature (504)..(506): n is a, c, g, or t
  modified_base (508)..(514): a, c, t, g, unknown or other
  misc_feature (508)..(514): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggcccactggcactcccagccaggttcagtggcaggtgggtctgggacagacttcnctctcaccatcagcagcctagacgcctagaagtattttgactagtttattactgtcagcaggcggggctaagtcggccgtctcgtacgttcggggacgggggaccaagggtggacgttacgaacgaacgtgtgctgcacntctgtcttcatcctcccnctactctagtacgtactacgacgtcgtaggacggtcgggtcgtcggacgaacgggcgaccagtacgntacgnannncnnnnnnn

SEQ ID NO: 6660 - DNA, 753 bp, Homo sapiens
  misc_feature: GYAE6OF02HQSAV.14.5.A05.1.454.CMB.1.raw
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaaccaacagaaacctggccaggctcccaggctcctcatctatgatgcatccatcgagggccactggcactcccagccaggttcagtggcagtggtctgggacagacttcactctcaccatcagcagccgtagacgcctgaagtattttgctagtttattactgtcagcacgtcgtaaccaacgtcgggacccttccgtcggtccgccttacctaccgtttttccggggaccggggtaaccggggtaacccgtaaaggggttacgggtaaacggtaacgttaaaccgaaaaaccgggtaaaccgttacgggttaacgggtccgtttaaccgggaaccctaacccgttaaacgtttcccgttacggttttacccgtttaacgttaaaccgttttcccgtttaacccccccgggtcccttaaaccgtttacccgttacgggtaacgtttaaacccgttaacgggtaaacccggtccgttacgggtaaccgggtaccccgggggacgtttaccggggaaccggttaaacgggcccggtaacccgtaaaggtttaacccggagtacccgttaacggtacgtacgacgtagtagtacg

SEQ ID NO: 6661 - DNA, 670 bp, Homo sapiens
  misc_feature: GYAE6OF02JZE8U.14.5.A05.1.454.CMB.1.raw
  modified_base (165)..(165): a, c, t, g, unknown or other
  misc_feature (165)..(165): n is a, c, g, or t
  modified_base (193)..(193): a, c, t, g, unknown or other
  misc_feature (193)..(193): n is a, c, g, or t
  modified_base (660)..(660): a, c, t, g, unknown or other
  misc_feature (660)..(660): n is a, c, g, or t
  modified_base (665)..(665): a, c, t, g, unknown or other
  misc_feature (665)..(665): n is a, c, g, or t
  modified_base (668)..(670): a, c, t, g, unknown or other
  misc_feature (668)..(670): n is a, c, g, or t
tcagcgtctagtaccacgaccggtgctcgatttagatagatagacagggtgcctggagactgtgttgacacagtctccaggcacctgtccttgtctccaggggaaagagccaccctctcctgcagggccatcagagtgttgatacgtacttagcctggtaccaanagaacctggccaggcctcccaggctccncatctatgatgcatccatcgagggcccagtcggacctactccccgagccctaagggttccaggttggaccgtaggtcggggtacgttgggacgagtaccgttactactcgtccaccatccgacgacaccgccagtaccgccgttaggaacgtagttttacgacgttacgttttaacttaccgttagtacgtaacgtaccgaggtacccgtaaccctaaacgttccgggacccttaccgtcggaccgttaccgtccgtaccgttttcccgggacgggtaccgggtaacgtaacgggttaggacgtacgtacgaaacggtactagggtcggtactaggtaccactaacggtcttacgtccttcgccttaccgtcccgtaccttagtcccgtagtacgtaccgttacgacccgtcgaaggtccggaccggtcgttagggaccgtacgggtccacgtacgtagacgcgtancgtancgnnn

SEQ ID NO: 6662 - DNA, 659 bp, Homo sapiens
  misc_feature: GYAE6OF02IU243.14.5.A05.1.454.CMB.1.raw
  modified_base (250)..(250): a, c, t, g, unknown or other
  misc_feature (250)..(250): n is a, c, g, or t
  modified_base (633)..(633): a, c, t, g, unknown or other
  misc_feature (633)..(633): n is a, c, g, or t
  modified_base (642)..(642): a, c, t, g, unknown or other
  misc_feature (642)..(642): n is a, c, g, or t
  modified_base (647)..(647): a, c, t, g, unknown or other
  misc_feature (647)..(647): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaaacagaaacctggccaggctcccaggcctcctcatctatgatgcatccatcagggccactggcatcccagccaggttcagtggcngtgggtcctgggacagacttcactctcaccatcagcacgtcctagacgcctagaatagttttgcgtaagttttatacgtgtacagtcagactaaccaacgttcggaccctccgtacgtccgcctacgtaccgtttcgggaccgggtacgggaaccgaaagggtcggtaacgaaacgttaacccgaaaacggtaaccgttacgggttcggtaccgttacggaccgaacctactttccgttacgttccttacgtacttcccgttacccgtcctaactttccgtacgttaacggttaaccgtaacgttaaccgtaccgttcggtaacggggtcccggggtcgtacggggtaccggaaaccgggtaccggtaaccgtaagttaacgngttaaccgngtacncgcgtcagtacg

SEQ ID NO: 6663 - DNA, 636 bp, Homo sapiens
  misc_feature: GYAE6OF02G56X2.14.5.A05.1.454.CMB.1.raw
  modified_base (630)..(630): a, c, t, g, unknown or other
  misc_feature (630)..(630): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcgagggccactggcactcccagccaggttcagtggcgagtgggtcgtgggacagtacttcgactctccaccatcagcacgcctagacgcctaggtaagtattttgacttaagtttacttactgtacacgtcacgtcgtaacccacgttcgccctcctcgcctctcgtaccgttcggggacggacgggtaccgaagggtcgaagtaactaccgaaaacggtaccgtgggtcggactacggtaccaacctacgttcttaccggttaccttaccgtaccgtttcccgttaccccggaccttacgttaccgtagttaaccggttaacgtacgtacccggtacgtcgggaacgggtccgggtacgtacggggtaccgaaacggggtccctaaaggtacggttacgacgtcgcgtacgcgtancgagcg

SEQ ID NO: 6664 - DNA, 521 bp, Homo sapiens
  misc_feature: GYAE6OF02H4VME.14.5.A05.1.454.CMB.1.raw
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
  modified_base (519)..(521): a, c, t, g, unknown or other
  misc_feature (519)..(521): n is a, c, g, or t
tcagcgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaaccaacagaaacctgccaggctcccaggctcctcatctatgatgcatccatcagggccatggcactcccagccaggttcaggtgcagtggtctgggacagacttcactctcaccatcancagcctagacgcctagaagtattttgactaggtttattactagtnagcagcgtaaccaactacgcctccgtgcgtctacacgtttcggcgggacgggacctagggagagagtacaaacgactgtacggctcgcaccatctntcttcactctccnctatcgtnacgtactacgaacgtctagacggcggtcgtacgggacgtaacgggaccgtacgaacgtacggtancgacngacagnnn

SEQ ID NO: 6665 - DNA, 513 bp, Homo sapiens
  misc_feature: GYAE6OF01BS9EU.23.71.G05.1.454.CMB.1.raw
  modified_base (319)..(319): a, c, t, g, unknown or other
  misc_feature (319)..(319): n is a, c, g, or t
tcagacgcgagtatcacgaccggtgctcgatttagtgtcgtcgcaagagagaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatactttatgaggcactaagcggccctnaggggtttctagtcgcttctctggctccaagtctggcaacacggcctcctgaccatctctggcctccagcctgacgacgaggctgattattatgctgctcatatgcagatagtagttactttgaggttcggcggggacaggtgaccgtgtaggtcaggcccaaggctacgcccctggtccactcgtcgtccccg

SEQ ID NO: 6666 - DNA, 509 bp, Homo sapiens
  misc_feature: GYAE6OF01DQGB4.23.71.G05.1.454.CMB.1.raw
  modified_base (496)..(496): a, c, t, g, unknown or other
  misc_feature (496)..(496): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatgtctcgtggtaccaatacctccaggcaaacgcccccaaatcatacttatgaggcactaagcgcctcgaggggtttctagtcgcttctctggctcaagtctggcaacacggcctcctgaccatctctcgcctccagcctgacgacgaggctgattatattgctgctcatatgcagatagtagtactttgaggttcggcggggacaggtgaccgtcgtagtcacgcccaaggctcgcccctcggcnctcgtcgtccccg

SEQ ID NO: 6667 - DNA, 551 bp, Homo sapiens
  misc_feature: GYAE6OF01DQK2P.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatactttatgaggcactaagcggccctctaggggtttctagtcgcttctctggctccaagtctggcaacaccggccctccctgaccatctctggcctccacgcctgacgacgaggctgtattattattgctgctcatatgcagatagtagttactttgagggttcgggcgggggaccaagggtgaccggtcggtacggtcacggcccgaacgggcctaccggccccccgttcggtcctacctccgttcggttcccccg

SEQ ID NO: 6668 - DNA, 524 bp, Homo sapiens
  misc_feature: GYAE6OF01C8U0V.23.71.G05.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaatatggtctcgtggtaccaatacctccaggcaaacgccccaaatcatactttangaggcactaagcggcctnagggtttcagtcgcttctctggctcaagtctggacaacncggcctccngaccatctctgcctcacgcctgacgacgagctgattatattgctgctcatatgcagtatagtagttacttggtagggttcgggcggggacaagggtcgaccggtcggtaggtcacgcccgaaggctcgtcccctcggtaccactcgtcgttacccc

SEQ ID NO: 6669 - DNA, 519 bp, Homo sapiens
  misc_feature: GYAE6OF01B2L6L.23.71.G05.1.454.CMB.1.raw
  modified_base (361)..(361): a, c, t, g, unknown or other
  misc_feature (361)..(361): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaactcatactttatgaggcactaagcgcctcaggggtttctagtcgcttctctggctccaagtctggcaacncggcctccctgaccatctctggcctccagcctgacgacgaggctgattattattgctgctcatatgcagatagtagttactttgaggttcgggcgggggacagggtgaccgtcgtaggtcaggcccaaggctcgcccctcggtccactctcgtccccg

SEQ ID NO: 6670 - DNA, 563 bp, Homo sapiens
  misc_feature: GYAE6OF01D6J3U.23.71.G05.1.454.CMB.1.raw
  modified_base (365)..(365): a, c, t, g, unknown or other
  misc_feature (365)..(365): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaatcatactttatgagggcactaagccggccctcgagggtttctagtcgcttctctggctccaagtctggcaacncggcctccctgaccatctctcggcctccacgcctgacgacgaggctgtattattattgctgctcatatgacagtataggttagttacgtttggagggttcgggacggggggtaccaagggtcggtaccggtcggtacggtcgacggcccgaaggcctccggtccccccgttcggtcctaccttccgtcgttacccccc

SEQ ID NO: 6671 - DNA, 533 bp, Homo sapiens
  misc_feature: GYAE6OF01A8NJF.23.71.G05.1.454.CMB.1.raw
  modified_base (321)..(321): a, c, t, g, unknown or other
  misc_feature (321)..(321): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaatcatactttatgaggcactaagcggccctnagggtttctagtcgcttctctggctcagtctggcaacacggcctccctgaccatcctctggccctccagcctgacgacgaggctgattattattgctgctcatatgcagatagtagttactttggaggttcggcgggggaccaagggtcgaccggttcgtaggtcaggtcccaagggcctcggccccctcggtccacgttcctcgttccccc

SEQ ID NO: 6672 - DNA, 527 bp, Homo sapiens
  misc_feature: GYAE6OF01DK7VV.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaactcatactttatgagggcactaagcggccctcgaggggtttctagtcgcttctctggctccaagtctggcaacacggcctccctgaccatctctcggcctccacgcctgacgacgaggctgattattattgctgctcatatgcagatagtagttactttgtagggttcgggcgggggtaccaggtcgacgtcgtaggtcaggcccaaggctcgcccctcgtcactcgtcgttcccc

SEQ ID NO: 6673 - DNA, 574 bp, Homo sapiens
  misc_feature: GYAE6OF01B6I87.23.71.G05.1.454.CMB.1.raw
  modified_base (228)..(228): a, c, t, g, unknown or other
  misc_feature (228)..(228): n is a, c, g, or t
  modified_base (361)..(361): a, c, t, g, unknown or other
  misc_feature (361)..(361): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaatatggtctcgtggtaccaatacctccaggcaaacgcccccaaatcatactttatgaggcactaagcggccctgaggggtttctagtcgtcttctctggctcaagtctggcaacncggcctccctgaccatctctcggcctcagcctgacgacgagctgattattattgctgctcatatgacaagtataggttacgttacgtttggacgggttcgggacgggggtaacctaagggttcgaaccggttcggtacggtaccaacggtccccgaagggtccctaccggtccccccgttaggtaccctaccgttccgtccggttaccccccg

SEQ ID NO: 6674 - DNA, 575 bp, Homo sapiens
  misc_feature: GYAE6OF01BLQ07.23.71.G05.1.454.CMB.1.raw
  modified_base (373)..(373): a, c, t, g, unknown or other
  misc_feature (373)..(373): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatactttatgagggcactaagcggccctgaggggtttctagtcgcttctctggctccaagtctggcaacacggcctcccngaccatctctggccctccacgcctgacgacgaggctgattattattgctgctcatatgacagtatagttagttacgtttggacgggttcgggacggggggtaacctaagggtcggtaccggttcggtacggtcgaacggccccgaaagggccctccggaccccccgttcgggtaccctaccgttccgttccggttccccccg

SEQ ID NO: 6675 - DNA, 569 bp, Homo sapiens
  misc_feature: GYAE6OF01BNM5S.23.71.G05.1.454.CMB.1.raw
  modified_base (227)..(227): a, c, t, g, unknown or other
  misc_feature (227)..(227): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacgtctcctgcactggaacccncagtgatgttgggacttttatatggtctcgtggtaccaatacctccaggcaaagcccccaaatcatactttatgaggcactaagcggcctcgaggggtttctagtcgcttcnctggctcaagtctggcaacncggcctcctgaccatctctcggcctccagcctgacgacgagctgattattattgctgctcatatgcagtatagttagttactttggacgggtttcgggacgggggtaactaagggtcggtacccggttcggtacggtaccgacggtccccgaaagggtccttaccggtccccccgttacgggtaccctaccgtccgttccgttacccccc

SEQ ID NO: 6676 - DNA, 519 bp, Homo sapiens
  misc_feature: GYAE6OF01ARS48.23.71.G05.1.454.CMB.1.raw
  modified_base (248)..(248): a, c, t, g, unknown or other
  misc_feature (248)..(248): n is a, c, g, or t
tcagacgcgagtatcacgaccggtgctcgatttagtgtcgtcgcaagagagaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctccaggcaaagcccccaaatcatacttatgaggcactaagcgccctcaggggtttctagtcgcttctctggctccaagtctggcaacacggcctccctgaccatctctggcctccagcctgaccgacgaggctgatttatattgctgctcatatgcagatagtagtactttggaggttcgggcgggggtaccagggtcgaccggtgtaggtcaggcccaaggctcgcccctggtcactcgtcgtccccg

SEQ ID NO: 6677 - DNA, 572 bp, Homo sapiens
  misc_feature: GYAE6OF01BHLPU.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggacttttaatatggtctcgtggtaccaatacctccaggcaaacgcccccaaatcatacttatgaggcacgtaagcggccctgaggggtttctagtcgcttctctggctcaagtctggcaacacggccctcctgaccatctctcggcctccacgcctgacgacgagctagattattattgctgctcatatgcagatagttagttacgtttggagggttcgggcgggggtaaccaagggtcggtaaccggttcggtacgggtaccacggaccccgaagggtccctaccggtccccccgttaggtaccctaccgttccgttccggttaccccccc

SEQ ID NO: 6678 - DNA, 532 bp, Homo sapiens
  misc_feature: GYAE6OF01BRFYZ.23.71.G05.1.454.CMB.1.raw
  modified_base (320)..(320): a, c, t, g, unknown or other
  misc_feature (320)..(320): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttatgaggcactaagcggccctnaggggtttctagtcgcttctctggctccaagtctggcaacacggcctccctgaccatctctggcctccagcctgacgacgaggctgattattattgctgctcatatgcagatagtagttactttgaggttcgggcgggggacctaagggtcgaccggtcgtaggtcacggcccgaaggctcgtccccctcggtaccactccgtcgttccccc

SEQ ID NO: 6679 - DNA, 546 bp, Homo sapiens
  misc_feature: GYAE6OF01DLF3P.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggacttttaatatggtctcgtggtaccaatacctccaggcaaacgccccaaatcatacttatgaggcactaagcgcctcgtagggtttctagtcgcttctctggctccaagtctggcaacacggcctccctgaccatctctggcctccagcctgacgacgaggctgatttattattgctgctcatatgctagattagtagttactttggagggttcgggacggggactaagggtcgaccggtcggtaggtcacggcccgaacggcctcggtcccccgttggtaccctaccgttccgtccgttcccccg

SEQ ID NO: 6680 - DNA, 538 bp, Homo sapiens
  misc_feature: GYAE6OF01AC1ZR.23.71.G05.1.454.CMB.1.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (427)..(427): a, c, t, g, unknown or other
  misc_feature (427)..(427): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaanatggtctcgtggtaccaataccctccaggcaaacgcccccaaatcatacttangaggcactaagcgcctgagggtttctagtcgcttctctggctccagtctggacaacacggcctccctgaccatctctcggcctccgacgcctgacgacgaggctgtattattattgctgctcatntgcagatagtagtacgtttggaggttcgggacggggtacaagggtcgaccggtcgtacggtcgacgcccgaaggtcctcggccccctcggtacctacctcgtcgttacccc

SEQ ID NO: 6681 - DNA, 547 bp, Homo sapiens
  misc_feature: GYAE6OF01DSUNC.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggacttttaatatggtctcgtggtaccaatacctccaggcaaagccccaaactcatactttatgaggcactaagcgcctcagggtttctagtcgcttctctggctccaagtctggcaacacggcctccctgaccatctctcgcctccacgcctgacgacgagctgatttatattgctgctcatatgacagtatagtagttactttggagggttcgggaccgggggaacctaagggtcgaccggttcggtacggtcgacggacccaacggcctcgcccccgttacggtcctactccgtcgttcccccg

SEQ ID NO: 6682 - DNA, 534 bp, Homo sapiens
  misc_feature: GYAE6OF01BSYKI.23.71.G05.1.454.CMB.1.raw
  modified_base (228)..(228): a, c, t, g, unknown or other
  misc_feature (228)..(228): n is a, c, g, or t
  modified_base (519)..(519): a, c, t, g, unknown or other
  misc_feature (519)..(519): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttgggacttttaatatggtctcgtggtaccaatacctccaggcaaagcccccaaatcatacttatgaggcactaagcggccctcgaggggtttctagtcgcttctctggctcaagtctggcaacacggcctccctgaccatctctcggccctccacgcctgacgacgaggctagtattattattgctgctcatatgcagtatagtagttactttggagggttcgggcggggtacaaggtcgacgtcgtaggtcacggcccgaaggcctcgcccctcggtaccncttcgtcgttccccc

SEQ ID NO: 6683 - DNA, 531 bp, Homo sapiens
  misc_feature: GYAE6OF01E3G4U.23.71.G05.1.454.CMB.1.raw
  modified_base (250)..(250): a, c, t, g, unknown or other
  misc_feature (250)..(250): n is a, c, g, or t
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggactttttaanatggtctcgtggtaccaatacctcccaggcaaacgcccccaaaactcatactttangaggcactaagcggccctnaggggtttctagtcgcttctctggctccaagtctggcaacacggcctcctgaccatcctctcggcctccagcctgacgacgaggctgattattattgctgctcatatgcagatagtagttactttgaggttcgggcgggggaccaaggtgaccgtcggtaggtcacggcccaaggctcgccccctcggtccacttctcgttccccg

SEQ ID NO: 6684 - DNA, 547 bp, Homo sapiens
  misc_feature: GYAE6OF01B4DPJ.23.71.G05.1.454.CMB.1.raw
  modified_base (301)..(301): a, c, t, g, unknown or other
  misc_feature (301)..(301): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtgtaccaatacctccaggcaaagcccccaaatcatactttangaggcactaagcggcctgagggtttctagtcgcttctctggctcagtctgcacacgcctcctgaccatctctcggcctccacgtcctcgacgacgaggctgattattattgctgcttcatatgcagtagtagtagttactttggagggttccgggacgggggtaccagggtcgaccggttcggtacggtcacggtcccaaggtcctccggtcccccttcggtacctaccgtccgtcgttacccccg

SEQ ID NO: 6685 - DNA, 581 bp, Homo sapiens
  misc_feature: GYAE6OF01C5AZZ.23.71.G05.1.454.CMB.1.raw
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttgggacttttaatatggtctcgtggtaccaatacctccaggcaaacgccccaaactcatactttatgaggcactaagcggccctcgtaggggtttctagtcgcttctctggctcaagtctggcaacacgcctccctgacctatctctcgccctcacgcctgacgacgacggctgtattattattgtctgcctnatntcgcagtattagttagtacgtttaggtacgggttcgggacgggggtaccgtaagggtcggtaccggtacggtacgggtcgaacggtaccccgaacgggtccgtccggtccccccgttaccggtcgtaccttccgttcgttacccccc

SEQ ID NO: 6686 - DNA, 547 bp, Homo sapiens
  misc_feature: GYAE6OF01BRI8O.23.71.G05.1.454.CMB.1.raw
  modified_base (250)..(250): a, c, t, g, unknown or other
  misc_feature (250)..(250): n is a, c, g, or t
  modified_base (360)..(360): a, c, t, g, unknown or other
  misc_feature (360)..(360): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
  modified_base (530)..(530): a, c, t, g, unknown or other
  misc_feature (530)..(530): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctccaggcaaagcccccaatcatacttatgaggcactaagcggccctgaggggtttctagtcgcttctctggctccaagtctggcaacncggccctccctgaccatctctcggccctccacgcctgacgacgaggctgaattnttatgctgctcattangcagtatagtagtactttggagggttcgggacgggggacaagggtcgaccggtggtacggtcacggcccgaagggtccctccggcccccgttcggtaccncgtccgttccgtccccc

SEQ ID NO: 6687 - DNA, 548 bp, Homo sapiens
  misc_feature: GYAE6OF01A5NJ0.23.71.G05.1.454.CMB.1.raw
  modified_base (230)..(230): a, c, t, g, unknown or other
  misc_feature (230)..(230): n is a, c, g, or t
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (416)..(416): a, c, t, g, unknown or other
  misc_feature (416)..(416): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccnagtgatggttggacttttaatatggtctcgtgtaccaatacctccaggcaaacgcccccaaatcatacttangaggcactaagcgcctgtagggtttctagtcgcttctctgctcaagtctggacaacncgcctccngaccatctctcgcctcgacgcctgacgacgagctgattatatgctgctnatatgacagtatagttagttacgtttggagggttcgggacggggtactaagggtcgtaccggtcggtaggtcacggtcccgaaggtccctccggtccccccttacggtacctaccttcgtcccgttcccccg

SEQ ID NO: 6688 - DNA, 552 bp, Homo sapiens
  misc_feature: GYAE6OF01BGZFM.23.71.G05.1.454.CMB.1.raw
  modified_base (229)..(229): a, c, t, g, unknown or other
  misc_feature (229)..(229): n is a, c, g, or t
  modified_base (423)..(423): a, c, t, g, unknown or other
  misc_feature (423)..(423): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaatatggtctcgtggtaccaatacctccagcaaacgcccccaaatcatacttatgaggcactaagcggccctgagggtttctagtcgcttctctggctcgaagtctaggcaacgcggccctccctgaccatctcgtcgccctccagcctgacgacgagctgtattattatgctgctnatatgcagtatagtagttacgtttgagggttccgggacggggacctaagggtcgaacccggttcggtaggtacacggtacccgaaaggtcctccgcccccgtacggtccacgttccgtccgttcccccg

SEQ ID NO: 6689 - DNA, 512 bp, Homo sapiens
  misc_feature: GYAE6OF01EQEMU.23.71.G05.1.454.CMB.1.raw
  modified_base (501)..(501): a, c, t, g, unknown or other
  misc_feature (501)..(501): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatgttgggactttttaatatggtctcgtggtaccaatacctccagcaaagcccccaaatcatacttatgaggcactaagcggcctcagggtttctagtcgcttctctgctccaagtctggcaacacgcctccctgaccatctctcggcctccacgcctgacgacgagctgattattattgctgctctatatgcagatagtagttactttgaggttcgggcggggacaggtcgaccgtgtaggtcacgccgaggctcgcccctggtcnctctcgtcccc

SEQ ID NO: 6690 - DNA, 692 bp, Homo sapiens
  misc_feature: GYAE6OF01BJ1CN.23.71.G05.1.454.CMB.1.raw
  modified_base (301)..(301): a, c, t, g, unknown or other
  misc_feature (301)..(301): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactggaacccgcagtgatgttggacttttaatatggtctcgtgtaccaatacctccaggcaaacgccccaaatcatactttangaggcactaagcggcctcgagggtttctagtcgcttctctggctccaagtcgtggacaacgacggtccctcccgtgacctatcctcgtcggtccctccgacgtcccgtacgaaccggtaccgaggtcctaggtaactttaactttacgttacggtcttacggtcctacgtaattacgtggtacctaaggtattaacgggttacgtttaacggtttttacgggtacgggggtttaccggggtacccgggggggtaaaccgtaaaggggttcggtaacccgggttcgggttaaccgggttaccggaaccggtaccccggtaaacggtccccgttaccggtcccccccggttacgggttaccctacccggttccgttcccgggtttcccccccg

SEQ ID NO: 6691 - DNA, 527 bp, Homo sapiens
  misc_feature: GYAE6OF01BHGXA.23.71.G05.1.454.CMB.1.raw
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
  modified_base (513)..(513): a, c, t, g, unknown or other
  misc_feature (513)..(513): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctccaggcaaagcccccaaatcatactttangagggcactaagcgcctgagggtttctagtcgcttctctggctccaagtctggcaacncggcctccctgacccatcctctcggcctccagcctgacgacgaggctgattattattgctgctcatatgcagatagtagttactttggaggttcggcgggggtaccaaggtcgaccgtcgtaggtcacgcccgaaggcctcgccccctggccncgtcgtcgtccccg

SEQ ID NO: 6692 - DNA, 574 bp, Homo sapiens
  misc_feature: GYAE6OF01BQ2VM.23.71.G05.1.454.CMB.1.raw
  modified_base (229)..(229): a, c, t, g, unknown or other
  misc_feature (229)..(229): n is a, c, g, or t
  modified_base (364)..(364): a, c, t, g, unknown or other
  misc_feature (364)..(364): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttatatggtctcgtgtaccaatacctccaggacaaacgcccccaaatcatacttatgaggcactagcggcctgagggtttctagtcgcttctctggctcagtctggacacgacgcctccngaccatctctcgcctcacgcctgacgacgacggtctagtatttattagttcgctcgtctctatatgtacagtaatagttacgttacgtttaggacgggttaccggggacgggggtaacctagggtacgtaccggttacggtacggtaccacggcccgaaggcccgttaccgtcccccgtcggtccctaccgttccgttccggttcccccg

SEQ ID NO: 6693 - DNA, 568 bp, Homo sapiens
  misc_feature: GYAE6OF01CBLRS.23.71.G05.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaanatggtctcgtggtaccaatacctccaggacaaacgccccaaatcatacttatgaggcacgtaagcgcctcgtagggttctagtcgtcttctctcggctaccgaagtctggcaacgacggtcctccctgaccatcctctcggcctccagcctgacgacgagctgtattattatgctgctacattactgctaagtatagttagttacgtttggtacgggttcgggacggggacgtagggtcggtaccggtcggtacggtcgaccggcccgtaacggtccgtccggtcccctacggtacctaccgtccgttccgttacccccg

SEQ ID NO: 6694 - DNA, 559 bp, Homo sapiens
  misc_feature: GYAE6OF01A6SD6.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggacttttaatatggtctcgtggtaccaatacctccaggcaaacgcccccaaactcattactttatgaggcactaagccggcctcgtaggggtttctagtcgcttctctggctcaagtctggcaacacggccctcccgtgaccatcctcgtcggccctccacgcctgaccgacgaggctagtattattattgctgctcatatgcaagtatagttagttacgtttggagggttcgggacgggggtactaagggtcgaccggttggtacgtcgacggtcccgaaggcctccggcccccgttgacctacttcgtccgttcccc

SEQ ID NO: 6695 - DNA, 574 bp, Homo sapiens
  misc_feature: GYAE6OF01DD6W2.23.71.G05.1.454.CMB.1.raw
  modified_base (228)..(228): a, c, t, g, unknown or other
  misc_feature (228)..(228): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (427)..(427): a, c, t, g, unknown or other
  misc_feature (427)..(427): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaatatggtctcgtggtaccaatacctccaggcaaagccccaaactcatacttatgaggcactaagcggccctgtagggttcagtcgcttcnctggctccaagtctggacaacncggcctccctgaccatctctcggcctcacgcctgacgacgngctgactttatattgctcgctcatatgnagtatagtagttacgtttggaggttcgggacgggggtaacctaagggtacggtacccggtacggttaacgggtacacggtaccccgaaacggtcctaccggtccccccgttacgggtaccctaccgttccgttcggttacccccccg

SEQ ID NO: 6696 - DNA, 534 bp, Homo sapiens
  misc_feature: GYAE6OF01D4KMK.23.71.G05.1.454.CMB.1.raw
  modified_base (300)..(300): a, c, t, g, unknown or other
  misc_feature (300)..(300): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaatatggtctcgtggtaccaatacctccaggcaaagcccccaaatcatacttangaggcactaagcggcctcagggtttctagtcgcttctctggctccaagtctggcaacacggcctccctgaccatctctggcctccacgcctgacgacgagctgattatattgctgctnatatncagatagtagttacgtttgagggttcgggcgggggtacctagggtacgtaccggtcggtacggtcgacggcccgaaggcctcgccccctcggtccacttcctcgttccccg

SEQ ID NO: 6697 - DNA, 642 bp, Homo sapiens
  misc_feature: GYAE6OF01A86EY.23.71.G05.1.454.CMB.1.raw
  modified_base (309)..(309): a, c, t, g, unknown or other
  misc_feature (309)..(309): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgattggttgggtacttttaatatggtctcgtggtaccaatacctccaggacaaacgcccccaaatcatacttangaggcactaagcggtccctgtagggtttcagtcgcttctctggctcagtctggcaacgcggcctcctgaccatctctcggccctccgacgtcctggaccgacggacggcttagtactttattattcgacttcgtctacgtatagtcgacgtaagtagttagttaacgtttacgttttagggtacggggtttaccggggaccggggggtaaccgtaagggttccggtacccgggttacgggtaccgggtacgaaccgggtaccccggtaacgggtccccgttacccggtccccccggttacggttacctacccgtttcgttccggtttcccccg

SEQ ID NO: 6698 - DNA, 542 bp, Homo sapiens
  misc_feature: GYAE6OF01C42D7.23.71.G05.1.454.CMB.1.raw
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggactttaatatggtctcgtgtaccaatacctccaggcaaacgccccaaatcatacttangaggcactagcggcctgtagggttcagtcgcttctctgctcagtctggcaacacggcctcctgaccatctctcggccctccacgtcctagaccgacgaggtctagatttatattgctgcctcatatgcagtattagtattacgtttggacgggttcgggacgggggtaactagggtcgaccggtggtacggtcgacggacccgaaggtccctcgtcccccgtggtccactccgttccggtcccc

SEQ ID NO: 6699 - DNA, 541 bp, Homo sapiens
  misc_feature: GYAE6OF01BTWNT.23.71.G05.1.454.CMB.1.raw
  modified_base (359)..(359): a, c, t, g, unknown or other
  misc_feature (359)..(359): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggacttttaatatggtctcgtggtaccaatacctccaggcaaacgcccccaaatcatactttatgaggcactaagcggcctgagggtttcagtcgcttctctggctcaagtctggcaacncggcctcctgaccatctctcggcctccagcctgacgacgagctagattattattgctgctcatatgcagtactagttagttacgtttggagggttcggcgggggtacaagggtcgaccgtgtacggtacacggcccgaaggtcctacggtcccccgtggtacctacttccgtcgtacccccg

SEQ ID NO: 6700 - DNA, 520 bp, Homo sapiens
  misc_feature: GYAE6OF01COPJW.23.71.G05.1.454.CMB.1.raw
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (478)..(478): a, c, t, g, unknown or other
  misc_feature (478)..(478): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatactttangaggcactaagcgccctnagggtttcagtcgcttctctggctcaagtctggcaacacggcctccctgaccatctctggcctcagcctgacgacgagctgattattattgctgctcatatgacagatagtatactttgaggttcggcgggggacctaagggtgaccgtggtacggtnacggcccaaggcctcgcccccgtggtccactcgtcgtccccc

SEQ ID NO: 6701 - DNA, 548 bp, Homo sapiens
  misc_feature: GYAE6OF01BNCJZ.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaatatggtctcgtggtaccaatacctccaggcaaagcccccaaactcatactttatgaggcactaagcggccctcaggggtttctagtcgcttctctggctccaagtctggcaacacggccctccctgaccatctctcggccctccagcctgacgacgagctgattattattgctgctcatatgcagtatagttagttactttggaggttcgggcgggggtaccaagggtcgtaccggtcggtaggtcgacggcccgaacggcctccggtccccctcggtacctccttcgtccgttcccccg

SEQ ID NO: 6702 - DNA, 539 bp, Homo sapiens
  misc_feature: GYAE6OF01DGKMS.23.71.G05.1.454.CMB.1.raw
  modified_base (228)..(228): a, c, t, g, unknown or other
  misc_feature (228)..(228): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggtacttttaatatggtctcgtggtaccaatacctccaggcaaagccccaaactcatacttatgaggcactaagcgcctcagggtttctagtcgcttctctggctcaagtctggcaacgacggcctccctgacctatctctcggcctccacgcctgacgacgaggctgacttattattgctgctcatatgcagatagttagttactttggaggtttcgggacgggggtaacctaagggtcgtaccggtggtacggtcacggcccaaggctcgtcccctggtcctactcgttccgttaccccc

SEQ ID NO: 6703 - DNA, 588 bp, Homo sapiens
  misc_feature: GYAE6OF01C1P4I.23.71.G05.1.454.CMB.1.raw
  modified_base (304)..(304): a, c, t, g, unknown or other
  misc_feature (304)..(304): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggacaaacgcccccaaactcatacttangaggcactagcggcctcgtagggttctagtcgcttctctggctccaagtctggcaacacggccctccctgaccatctctcggccctccacgtcctgaccgacgaggctgtattattattgctgctcatatgacagtattagtagttacgtttggacgggtttcgggacggggggtaaccgtaagggtcggtacccggtcggtacgggtcgaacgggtccccgaaacgggtccctaccggtccccccgttacgggtacctacccgtcccgttccggttccccccg

SEQ ID NO: 6704 - DNA, 589 bp, Homo sapiens
  misc_feature: GYAE6OF01D6YUN.23.71.G05.1.454.CMB.1.raw
  modified_base (252)..(252): a, c, t, g, unknown or other
  misc_feature (252)..(252): n is a, c, g, or t
  modified_base (367)..(367): a, c, t, g, unknown or other
  misc_feature (367)..(367): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatggttggacttttaanatggtctcgtggtaccaatacctccaggcaaacgcccccaaatcatactttatggaggcactaagccggtaccctgtagggtttctagtcgcttctctggctcagtctggcaacncgcctcctgaccatctctgcctcacgcctgacgacgacggctgtattattattgctgctctatatgactagtagttagttagttacgtttggacgggttccggggacgggggtaacctaagggtcggtacccggttacgggtaacggtaccgacggtcccggaacggtccgtacccggtccccccgttacggtaccctacccgttccgtccggttccccccg

SEQ ID NO: 6705 - DNA, 549 bp, Homo sapiens
  misc_feature: GYAE6OF01DYJ2I.23.71.G05.1.454.CMB.1.raw
  modified_base (354)..(354): a, c, t, g, unknown or other
  misc_feature (354)..(354): n is a, c, g, or t
  modified_base (393)..(393): a, c, t, g, unknown or other
  misc_feature (393)..(393): n is a, c, g, or t
tcagacgcgagtatcacgaccggtgctcgatttagtgtcgtcgcaagagagaggggggggtcacaagaggcagcgctctcgggacgtctccgccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaatatggtctcgtggtaccaatacctccaggcaaagcccccaatcatacttatgaggcactagcggcctgagggtttcagtcgcttctctggctcaagtctggcaacncgcctcctgaccatctctcgcctccacgcctgacgacgngctgattatattgctgctcatatgacagtatagtagttacgtttggacgggttcgggacgggggacctaagggtcgtaccggtacggtacgggtacgcggtacccgaaacggtctaccggtcccccgtacggtccaccttccgtccgttacccccg

SEQ ID NO: 6706 - DNA, 528 bp, Homo sapiens
  misc_feature: GYAE6OF01DQH1P.23.71.G05.1.454.CMB.1.raw
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaanatggtctcgtggtaccaatacctccaggcaaagccccaaatcatacttangaggcactagcggcctgagggtttcagtcgcttctctggctcaagtctggcaacaccggcctccctgaccatcctctcggccctccacgcctgacgacgaggctgatttattattgctgctcatatgacagattagtagttactttggagggttcgggcgggggaacctaagggtcgtaccggtcgtaggtccaggcccaaggctcgccccgtgtcactctcgtccccg

SEQ ID NO: 6707 - DNA, 571 bp, Homo sapiens
  misc_feature: GYAE6OF01EJ2MV.23.71.G05.1.454.CMB.1.raw
  modified_base (441)..(441): a, c, t, g, unknown or other
  misc_feature (441)..(441): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatggttgggtacttttaatatggtctcgtggtaccaatacctccagcaaacgccccaaatcatacttatggagggcactaagccggccctcgtaggggtttctagtcgtcttctctggctccaagtctggacaacacggccctccctcgaccatctcgtcggcctccacgcctgacgacgaggtctgtatttattattgctgtctntatatgacagtatagtagttagtttggagggttcgggacgggggactaagggtcgaccggttcggtacggtcgacggcccgaaggtcctaccggtcccccgtacggtcctaccgttcgtccgttaccccc

SEQ ID NO: 6708 - DNA, 1029 bp, Homo sapiens
  misc_feature: GYAE6OF01AQBW8.23.71.G05.1.454.CMB.1.raw
tcagacgcgagtatcacgaccggtgctcgatttagtgtcgtcgcaagagagaggggggggtcacggaaggaggcagcgcttcgtccgggacgtcgtaccaccagtggccctgggctctgcttgctcctcactctcctcacgtcacggacacacgggtcctaggcccagtctcgccctgactcagcctcgcctccgtgtctcggtctccgtggacagtccgactcaccgtctcctggccacgtcgggaacccgcgtagtagtagttcggttaggggtactttttaagtacgtacgggttaccttacggtcgggttaacccaaacgttaccccgttaccccgaaggggtacccctaaaacccggtcccccccctaaaaactttcccaaacttttaaccgttttaacgttcgggaaaccggggtaccctaaaacccggttaaaaccggggtccccggggttaccccccgtttaccgggtaaaccgggggggttttttccctaaacgggtttccccgggtcccgtttttcccggttccggttacggggtaccccgtttacccgggtaaacgggtttccggttacggggtaccctaaaaccggttcccgggttaccccttccccgttacggaaacccccgttacttcccggttccgtaccggggtccccttacccggtaaccggtccccgttacgggaacccggtaccggtaacgggttccttacggtttaacttttaaccgtttagtttcggtacctttacggtaaccttttaagtccgttacgggtacccgtaaacgggttaaccgttaacggttttaaccgggtttaaccggtttttacggggggtaaccggggggttttaccggggaccggggggggtaaccgtaaaggggttaccgggttaaccccgggttacgggttaacgggttacccggacgggtaccccggtagggtcccggttaccccggtacccccggttaccgggttaccgtacccggtttcccgtttcccggtttcccccggtaccccccg

SEQ ID NO: 6709 - DNA, 568 bp, Homo sapiens
  misc_feature: GYAE6OF01CCDH2.23.71.G05.1.454.CMB.1.raw
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgccccaaatcatacttatgaggcactaagcggccctcgaggggtttcagtcgcttctctggctcaagtctggcaacncggcctcccngacctntctctcgccctcacgcctgacgacgngctgattattntgcttgctcatatgcaagtattagttagttactttggacgggttcgggaccgggggtactaagggtcgtaccggtcgtacgggtccaacggtccccgaagggtccctcccggtccccccgttcgggtaccctcccgttccgtccggttccccccg

SEQ ID NO: 6710 - DNA, 603 bp, Homo sapiens
  misc_feature: GYAE6OF01B9BMA.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcgtggacagtcgatcaccgtctcctgcactggaacccgcagtgatgttgggtacttttaatatggtctcgtggtaccaatacctccaggacaaacgccccaaatcatacttatgaggcactaagcgcctgagggtttctagtcgcttctcgtcggctacaagtctggcaacgacgcctcctcgaccattcctactcggccctaccgacgcccgtagaccgacgaggtctacgtaatttagttagttcgcgttcgcttacgattacgtgacctaaggtattaaggttagttacgttttggacgggtttccgggacgggggtaacctaagggtcggtaccggtcggtacggtccgacggcccgaacggccgttcccgtcccccgttacgggtccacgttcgtcccgttccccccg

SEQ ID NO: 6711 - DNA, 762 bp, Homo sapiens
  misc_feature: GYAE6OF01DSP8S.23.71.G05.1.454.CMB.1.raw
  modified_base (227)..(227): a, c, t, g, unknown or other
  misc_feature (227)..(227): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcactggaacccncagtgatgttggtacttttatatgtctcgtgtacaatacctccaggacaacgccccaaatcatacttagtgaggacacgtaacgccggcctcgtagggtttctagtcgcttctcgtcggtcctaccgtaagtcgtaggaccaaacgaccggtccctacccgtacggtaaccctacttcctccgtcggtccctcccgaacgtcccgtacgaccggtaacggtacggcgttacggttaaactttacgtttaacgttcgtccgtacggttaccttacctaagttacgtacggtacgaacggttaagtttaacgggtttaacggtttaacggttttacgggtaaccgggggtttcccgggggtaaccgggggggtaaaccgttaaacggggttaccgggtaacccgggtttacgggttaccgggttaaccggtaacccgggtaccccggtaaacgggttccccgttaccccgggttacccccccggttaccgggtttacccgtaaccccgtttccccgttcccggtttaaccccccccg

SEQ ID NO: 6712 - DNA, 624 bp, Homo sapiens
  misc_feature: GYAE6OF01BTB0B.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttagggacttttaatatggtctcgtggtaaccaatacctccaggcaaacgccccaaatcatacttatgaggcactaagcggcctacgtacgggtttctagtcgtcttctctcggcctacgtaagtcgtggaccaaaccgaccggtccccttacccgtcgacccacgttctcgtcggtccctccacgccctaggacgacgaggctagtattattatcgctgctcatatgcagtagtagttagttacgtttggaacgggttcggggacggggtaacgaagggtacgtaccggtacgggtacggtacgtaccggtaccccgaaacggttcccgtacccgggtcccccgttccgggtaccctaaccttcccgttcccggtttaaccccccg

SEQ ID NO: 6713 - DNA, 541 bp, Homo sapiens
  misc_feature: GYAE6OF01DZQ6M.23.71.G05.1.454.CMB.1.raw
  modified_base (229)..(229): a, c, t, g, unknown or other
  misc_feature (229)..(229): n is a, c, g, or t
  modified_base (391)..(391): a, c, t, g, unknown or other
  misc_feature (391)..(391): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttgggacttttaatatggtctcgtggtaccaatacctccaggcaaagcccccaaatcatacttatgaggcactaagcgaccctgagggtttcagtcgcttctctggctccaagtctggcaacacggcctccctgaccatctctgcctccagccngacgacgacggctgattatatgctgtctnatangcaagattagtagttacgtttggacggtttcgggacgggggtactaagggtcgtaccggtcggtaggtacacggcccaggcgtccgcccctacggtcctacgtccgtcgttaccccc

SEQ ID NO: 6714 - DNA, 533 bp, Homo sapiens
  misc_feature: GYAE6OF01AFFK9.23.71.G05.1.454.CMB.1.raw
  modified_base (253)..(253): a, c, t, g, unknown or other
  misc_feature (253)..(253): n is a, c, g, or t
  modified_base (306)..(306): a, c, t, g, unknown or other
  misc_feature (306)..(306): n is a, c, g, or t
  modified_base (367)..(367): a, c, t, g, unknown or other
  misc_feature (367)..(367): n is a, c, g, or t
  modified_base (437)..(437): a, c, t, g, unknown or other
  misc_feature (437)..(437): n is a, c, g, or t
  modified_base (520)..(520): a, c, t, g, unknown or other
  misc_feature (520)..(520): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgattgttgggtacttttaanatggtctcgtggtaccaatacctccaggcaaacgcccccaaatcatactttangaggcactaagccggccctcgagggtttctagtcgcttctctggctcgaagtctggcaacncggccctccctgaccatctctcggccctccagtcctgaccgacgagctagtattattattgctgctcatntgcagatagtagttacgtttgaggttcgggacggggtacagggtcgacggtcgtaggcagcccgaaggctcgccccgtgaccnctcgtcgtccccg

SEQ ID NO: 6715 - DNA, 630 bp, Homo sapiens
  misc_feature: GYAE6OF01C7EVB.23.71.G05.1.454.CMB.1.raw
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggtacttttaatatggtctcgtggtaccaatacctccaggcaaacgccccaaatcatactttatgaggcactaacgcgccctcgaggggtttcagtcgcttctctggctccaagtctggacaacaccggcctcctcgaccatctcttcggccttcccagtcctcgaacgacgaggcttgactttattacgttgacctcgcccttatagtcgtacgtacgtaagttaggtttaaggtttacgtttacggttaggggttaccggggttaccggggggaccgggtaacggtacgggtaccggtaaccgggttacgggtacgtaccggacccggtacccggacggttccgccccggtccccgtacgtaccttacccgtccgtttccccgtccccccg

SEQ ID NO: 6716 - DNA, 539 bp, Homo sapiens
  misc_feature: GYAE6OF01EIA5U.23.71.G05.1.454.CMB.1.raw
  modified_base (323)..(323): a, c, t, g, unknown or other
  misc_feature (323)..(323): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaactcatactttatgaggcactaagcggccctnagggtttctagtcgcttctctggctccaagtctggcaacacggcctccctgaccatctctcggccctccagcctgaccgacgaggctgattattattgctgctcatatgcagtatagtagttactttggagggttcgggcggggtacaagggtcgaccggtcggtaggtcacggcccgaaggcctcgcccccgttggtaccacttctcgtcccccg

SEQ ID NO: 6717 - DNA, 564 bp, Homo sapiens
  misc_feature: GYAE6OF01AIU2R.23.71.G05.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccgnagtgattggttgggtacttttaanatggtctcgtggtaccaataccctccaggcaaacgcccccaaatcatacttangaggcactagccgcctgtagggtttcagtcgcttctctgctcagtctgcacgcgcctccngacctntctctcgccctccncgcctgacgacgacggctagtattattattgctgctacatacgtgactagtatagttacgttacgttggtacgggttcgggacgggggtacctagggtaccgtaccggtcggtacggtacgacggcccgaaggtccgtaccgtcccccgtggtacctaccttccgtccgtaccccc

SEQ ID NO: 6718 - DNA, 743 bp, Homo sapiens
  misc_feature: GYAE6OF01EGVK9.23.71.G05.1.454.CMB.1.raw
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnagtgatggttaggtacttttaanatggtctcgtgtaccaatacctccaggcaaacgccccaaatcatacttangaggcactaagccggcctgtagggtttctagtcgcttctctcgcctacgtagtcgtacgaccaacgaccggtccctcccgtacgtacctactcctcgtccggtccctccgacgtcccgtggaaccgacggtacggtctaggttaacttttacgttagttccgtacgtcggtaccttacgtagttacgtacgaaccgtaaggttaacgttaagggtttaacgttttaccggttttacgggggttaaccgggggtttaccgggggggtaacccgggggtaaaccgtacggggtttacccgggtaaacccgggtttccggggtaacggttacccgggaacccgttaacccgggtaacccgggttccccgttaaccccccggttccccccggttaggttacccccgttacccgtttcccgttcccccgtttaaccccccccgg

SEQ ID NO: 6719 - DNA, 536 bp, Homo sapiens
  misc_feature: GYAE6OF01EW8Y4.23.71.G05.1.454.CMB.1.raw
  modified_base (520)..(520): a, c, t, g, unknown or other
  misc_feature (520)..(520): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaactcatactttatggagggcacgtaagccggcctcgaggggtttctagtcgcttctctggctcaagtctgcaacacgcctcctgaccatctctcgcctccagcctgacgacgaggctagtattattattgctgctcatatgcagtatagtagttactttggagggttcgggcgggggacagggtcgaccggtcggtagtcgacgcccgaggctccgcccctcggtaccncgttccgtcgttcccc

SEQ ID NO: 6720 - DNA, 623 bp, Homo sapiens
  misc_feature: GYAE6OF01DTC7K.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggtacttttaatatgtctcgtggtaccaatacctccaggccaaacgcccccaaactcactactttatggacgggcaacgtaacggcggtcccttacgtacggggtttctagtccgtcttccgtctcggtcctccaagtctcggacaacgaccggcctcccgtcgacctatcctcgtcggtccctccgacgtccctggaccgacggtaggtcttgtaactttattagttcgctcgcttacattagtcgactagtaagttagtacgttacgttttaggacgggttcgggacgggggtaactagggtcgaccggttcggtagtaccgacggtcccgaacggtccgtaccgtcccccgtacggtacctccgttcgtccgttcccccg

SEQ ID NO: 6721 - DNA, 908 bp, Homo sapiens
  misc_feature: GYAE6OF01BWQYH.23.71.G05.1.454.CMB.1.raw
tcagacgcgagtatcacgaccggtgctcgatttagtgtcgtcgcaagagagaggggggggtcacaagaggcagcgctcgtcgggacgtctccaccatggcctgggctctgctgctcctcactctcctcactcaggtacacagggtcctgggccctagtctgccctgactcagcctgcctcgtgtctgggtctctggacagtcgatcgaccgtctccgtgcacgtcgggaaccccgcaggttgacttggtttcggggtaactttttaagtacgttcgggttccttcggttacgggttaaccctaaacgttaccccttacccgaaggggtacctaaaaccggccccccctaaaaactcctaactttaaccgttttacggtacggtaacgggggtacctaaccgttaaaccgggcccgggtacccccgttacgggtaacggggggtttttacctaacgggtttccggtacttttaccgttccgttacgggtcctttaacccgtaaaggttccgtacgggacctaaaccggtaaccgggtccccttacccgtacggtaaccctacgttcccgttaccgttaccggggtaccccttaccgaccggtaccccgttaggtaacccggacccgtacgggtccttagtacgtttaacttacgtttacgaccgttacgtaccttaactacgttaacttacgaccgtaagtaacgtttaaggttaaccgtttacggtttacgggtacggggtttacccgggggtaaccggggggtaaccgtaaggggttccgggtaacccgggtttacgggttaaccgggtactaaccgggtaccccggtaacgggtcccgttaccccggtcccccggtttaccgggttacccgtacccgtttcccggttacccggtttacccccccgg

SEQ ID NO: 6722 - DNA, 538 bp, Homo sapiens
  misc_feature: GYAE6OF01A2HGA.23.71.G05.1.454.CMB.1.raw
  modified_base (304)..(304): a, c, t, g, unknown or other
  misc_feature (304)..(304): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaatcatactttangaggcactaagcgccctgagggtttctagtcgtcttctctggctccaagtctggcaacacggcctccctgaccatctctggcctccagcctgaccgacgaggctgtattattatgctgctcatatgacagtatagttagttactttgagggttcgggcggggtacaggtcggaccgtggtaggtcacggcccgaaggcctccgccccgtggtaccctactccgttcgtcccccg

SEQ ID NO: 6723 - DNA, 546 bp, Homo sapiens
  misc_feature: GYAE6OF01CBTYR.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatgttgggacttttaatatggtctcgtggtaccaatacctccaggcaaacgcccccaaactcatactttatgaggcactaagcggccctcgaggggtttctagtcgcttctctggctccaagtctgcaacaccggcctccctgaccatctctcggccctccacgcctagacgacgaggctgtattattattgctgctcatatgcagatagtagttactttggacgggttcgggcggggactagggtcgacggtcgtacggtcacggcccgaaggtctccggtccccgtcggtacaccttcgtcggtcccccg

SEQ ID NO: 6724 - DNA, 557 bp, Homo sapiens
  misc_feature: GYAE6OF01BG364.23.71.G05.1.454.CMB.1.raw
  modified_base (307)..(307): a, c, t, g, unknown or other
  misc_feature (307)..(307): n is a, c, g, or t
  modified_base (442)..(442): a, c, t, g, unknown or other
  misc_feature (442)..(442): n is a, c, g, or t
  modified_base (542)..(542): a, c, t, g, unknown or other
  misc_feature (542)..(542): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactggaaccccgcagtgatggttggtacttttaatatggtctcgtaggtaccaatacctccaggcaaacgcccccaaatcatacttangaggcactaagcggccctcgagggtttctagtcgcttctctggctccagtctggcaacgccggtcctccctagacccattctcgtcggccctcagccctgaccgacgacggctgatttattagttgacctgcctntatatgactagtatagtagttacgttggacgggttcgggacggggtacctaagggtcgaccggttgtacggtcacggtccaggtcctcgccccgtgtccncgtcgtccgtccccg

SEQ ID NO: 6725 - DNA, 517 bp, Homo sapiens
  misc_feature: GYAE6OF01EH3CL.23.71.G05.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccncagtgattggttgggacttttaatatggtctcgtggtaccaatacctccaggcaaacgcccccaaatcatacttangaggcactaagcgccctgagggtttctagtcgcttctcgtcggctccaagtctgcaacncggcctcccngaccatctctcgcctccacgtcctgaccgacgagtctagtatttattattcgctgcttcatntgcgatatagtattcgttgaggttcgggcggganaggtgacgtgagtnacggccagcncgtcccgtgcnctgtccgtcccg

SEQ ID NO: 6726 - DNA, 564 bp, Homo sapiens
  misc_feature: GYAE6OF01BXZ4K.23.71.G05.1.454.CMB.1.raw
  modified_base (230)..(230): a, c, t, g, unknown or other
  misc_feature (230)..(230): n is a, c, g, or t
  modified_base (371)..(371): a, c, t, g, unknown or other
  misc_feature (371)..(371): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttgggacttttaatatggtctcgtggtaccaatacctccaggcaaacgcccccaaatcatacttatgaggcactaagcggccctcgaggggtttctagtcgcttctcgtgctcaagtctgcaacacgcctccngaccatctctcgccctcacgcctgacgacgagctgtattattattgctgctctatatgctagtatagtagttacgtttggacgggttcgggacggggactaaggtcgtaaccggttggtacggtacacggacccgtaagggccgtaccggtccccccgttacggttacctaccttccgttccggttccccccg

SEQ ID NO: 6727 - DNA, 523 bp, Homo sapiens
  misc_feature: GYAE6OF01C3GX0.23.71.G05.1.454.CMB.1.raw
  modified_base (301)..(301): a, c, t, g, unknown or other
  misc_feature (301)..(301): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatactttangaggcactaagcggccctcgaggggtttctagtcgcttctctggctcaagtctggactaacacggcctccctgaccatctctggcctccagcctgacgacgaggctgattattattgctgctcatatgcagtatagtagtactttgaggttcggcgggggacaaggtcgtaccgtcggtaggtcaggcccaaggctcgccccctagccactctcgttccccg

SEQ ID NO: 6728 - DNA, 533 bp, Homo sapiens
  misc_feature: GYAE6OF01C9ALH.23.71.G05.1.454.CMB.1.raw
  modified_base (339)..(339): a, c, t, g, unknown or other
  misc_feature (339)..(339): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (515)..(515): a, c, t, g, unknown or other
  misc_feature (515)..(515): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttggtactttaatatggtctcgtgtaccaatacctccaggcaaacgcccccaaatcatacttatgaggcactaagcggcctcgtagggttcagtcgcttcnctggctcaagtctgcaacgcgcctcctgaccatctctcgcctccagtcctagaccgacgngctagattatatgctgctnatngcagatagtagttacttggtacggttcgggacggggacctaggtggtacccgtaggtacggtcacggcccgaaggcctccgtccccgtcgtacncctcgttccgtacccccg

SEQ ID NO: 6729 - DNA, 572 bp, Homo sapiens
  misc_feature: GYAE6OF01CICY2.23.71.G05.1.454.CMB.1.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (375)..(375): a, c, t, g, unknown or other
  misc_feature (375)..(375): n is a, c, g, or t
  modified_base (438)..(438): a, c, t, g, unknown or other
  misc_feature (438)..(438): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatggttggtacttttaanattggtctgtggtaccaatacctccaggacaaacgccccaaatcatactttatgaggcactaagccgcctgtagggtttctagtcgcttctctggctacaagtctggacaaccgacggccctccngacctatcgtctcggccctcacgcctagaccgacgacgctagtattattatgctgctcatatnacaagtatagttagttacgtttggtacgggttcgggacgggggtaacgtaagggtcggaccgtcggtacggtacgacggtcccgaaggccgtaccgtcccccgttacggtcctaccttccgtccgttacccccg

SEQ ID NO: 6730 - DNA, 648 bp, Homo sapiens
  misc_feature: GYAE6OF01CTFAK.23.71.G05.1.454.CMB.1.raw
  modified_base (318)..(318): a, c, t, g, unknown or other
  misc_feature (318)..(318): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttgggtacttttaatagttggtctcggtggtaaccaacgttacctccaggacaaaccgcccccaaactctaatactttanggaggcacgtaagccggccctacgtagggtttctaggtccgtctttctcgtggtcctacgtaagtcgtggaccaacgccggtccctccctgaccctatcctctcggccctccacgtcctacggaccgacggacgtcgtagtaactttattagttgtcctgtccttactatagtcgacaaggtattaggttagttacgtttggtacgggttccggggacgggggtaacctacgggtcgtaccggttcggtacggtacgtacggaccccgtaacgggcccgttacccggtcccccggttcggtaccctacgttcccgttcccggttaccccc

SEQ ID NO: 6731 - DNA, 588 bp, Homo sapiens
  misc_feature: GYAE6OF01ACC43.23.71.G05.1.454.CMB.1.raw
  modified_base (233)..(233): a, c, t, g, unknown or other
  misc_feature (233)..(233): n is a, c, g, or t
  modified_base (307)..(307): a, c, t, g, unknown or other
  misc_feature (307)..(307): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgattccaccgtctcctgcactcggaacccnagtgtatggttggtacttttaatatggtctcggtgtaccaactcctccaggacaacgccccaaatcatacttangaggcacgtaacgccgcctcgtacgggtttctagtccgtcttctcgtcggcctccaagtcctaggtaccaacgtaccggccctccctagacctatcctctcgccctcgacgtcctggaccgacgacggtctagtacttattattcgcgtcgcctacatactcgactaggtacttaggttacgttagtttggacgggttcggacgggtacgagtcggacgtacggtaggcacggacccgacggtactcccgtacccgtcgtacaccgttccgtccgtccccg

SEQ ID NO: 6732 - DNA, 755 bp, Homo sapiens
  misc_feature: GYAE6OF01B34EH.23.71.G05.1.454.CMB.1.raw
  modified_base (250)..(250): a, c, t, g, unknown or other
  misc_feature (250)..(250): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactcggaacccgcagtgattgttggacttttaanatggtctcgtggtaccaatacctccaggcaaacgcccccaaactcatactttatgaggcactaagccggccctcgtaggggtttctagtccgtcttctcgtcggcctcgaagtctggaccaaacgaccggccctcccgtgaaccctatcctccgtcggcccttccgacgtccgtcggacccggtaacggacggtccgttgtaacttttaagtttacgtttcggaccctttgtcccttacgtaactttaacgttcgaaccgtaaggttaacgtttaaaggtttaacggtttaccgtttttacgggggtaacgggggtttccccggggggaaccgggggggttaaaccccgttaaaggggggttccgggtaacccccggggttttaaccgggttaacgggttacccggtaaaccgggtacccccggtaaacgggtccccgttacccgggtacccccccgttcgggttaccccgtaccgttttcccggttcccggtttaccccccccg

SEQ ID NO: 6733 - DNA, 730 bp, Homo sapiens
  misc_feature: GYAE6OF01D7NRR.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcacgtcggaacccncagtgagttggttaggtaacttttaatagttggtctcggtaggtaccaactacctccaaggaccaaacgcccccaaatcaattactttagtggacggactacgtaacgtccggtacctacggtacgggttctacgtcgtcttcgtacgtcggtcctacgtaacgtcgtacggaccaaacgtccggtcccttcccgtacgacccttacgtcctacgtcgccctccgacgtccgtacgaccggacgacgtactagttaatttacttgttacgtccttacgtactactaagttactacggtactaaggtaacgtttaaggttaacggtttacggtttacgggtaaccgggggttccggggggaaccgggggttaaccgtaacggggtccggtaaccggttccgggttaacggtacccgaaccgggttacccgaacgggttccctacccccgggtccccgttacggtacccgtttacccgttccgtccccgtttaccccccg

SEQ ID NO: 6734 - DNA, 596 bp, Homo sapiens
  misc_feature: GYAE6OF01CSYHM.23.71.G05.1.454.CMB.1.raw
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggtacttttaatatggtctcgtggtaccaatacctccaggcaaacgccccaaactcatacttangaggcactagcgcctgagggttctagtcncttctctgctcaagtctggacaacncggtccctccctagacctatcctcgtcggccctccacgtcctagaccgacgagtctagtatttattattgctgctacatatgacaagtattagtagttacgtttgggaacgggttcggggacgggggtaaccgtaagggtcgtacccggtcggtaacgggtccgaacggtaccccgaacgggtccgtccccggtcccccgttacgggtacctaccgttccgttcccggttaccccccc

SEQ ID NO: 6735 - DNA, 564 bp, Homo sapiens
  misc_feature: GYAE6OF01B2MI3.23.71.G05.1.454.CMB.1.raw
  modified_base (230)..(230): a, c, t, g, unknown or other
  misc_feature (230)..(230): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnagtgatgttgggacttttaatatggtctcgtgtaccaatacctccagcaaacgcccccaaactcatacttangaggcactagcggcctcgtaggggttctagtcncttctctgctccaagtctggcaacncggcctcctgaccatctctcggcctccacgcctgacgacgaggctgtattattattgctgctacatatgcagtatagttagttacgtttggacgggttcgggacgggggtacctaagggtcgtaacccggtggtacggtacacggcccgaacgggccctaccggtcccccgttcggtacctccgttccgttccggttacccccc

SEQ ID NO: 6736 - DNA, 851 bp, Homo sapiens
  misc_feature: GYAE6OF01DE8YG.23.71.G05.1.454.CMB.1.raw
tcagacgcgagtatcacgaccggtgctcgatttagtgtcgtcgcaagagagaggaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttaggtacttttaatagtggtctcgtacggtaaccaactacctccaggacaaaccgcccccaaactctacttacttagtaggacgggacacgtaacggccggtacccgttagtacggggtttctacggtccgtcgtttcctcgtggtacccttacccgtaaggttccgttaggacccgtaaaccgtaccccgggtccccttaccccgtacgtaacccctacgttcccttccgttaccggtaccccttcccgtaacggtccccgtacgggtaaacccgggtaccggtaacgggttaccgtacgtttaacttttaacgttttacgtttcggtaccgtttcggtacccttacttaacgttaacgttacggtaccggtaaagtttaacgtttacggtttaacggttttaaccggttttagggggttacgggggtttacccggggggtaccgggggggtaaaccgtaaacgggggttaccggttaaccccggggtttacgggttaaccggggttaccggaacccggggttaccccgggtaaaccgggtcccgggtttaccccgggttaccccccggttaccgggtttaacccctcccggttttcccggtttcccccgg

SEQ ID NO: 6737 - DNA, 563 bp, Homo sapiens
  misc_feature: GYAE6OF01AMJRE.23.71.G05.1.454.CMB.1.raw
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaanatggtctcgtggtaccaatacctccaggcaaacgcccccaaatcatacttangaggcactaagcgcctgagggtttcagtcgcttctctggctcaagtctgcaacacggcctccctgaccatcctctcggccctccagcctgacgacgacggctgattattattgctgctcatatgcagatagtagttactttggacggttcgggacggggtacctagggtcgtaccggtcggtacggtcctaacggccccgtaagggtcccttaccggtaccccccgttcggtaccctaccgttccgtcccggttaccccccg

SEQ ID NO: 6738 - DNA, 525 bp, Homo sapiens
  misc_feature: GYAE6OF01DE6J6.23.71.G05.1.454.CMB.1.raw
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgccccaaactcatactttatgaggcactaacgcggcctnagggtttctagtcncttctctggctcagtctgacaacacgcctccctgaccatctctcggcctcncgctgacgcgagctgattatnttgctgctcatngacagtatgtagtatttggaggttacgggcggggtacaggtcgtacggtcgtaggtacgacgccgacgcgtccgtccccgtcggtactacctcgtcgtaccccc

SEQ ID NO: 6739 - DNA, 617 bp, Homo sapiens
  misc_feature: GYAE6OF01B3KV9.23.71.G05.1.454.CMB.1.raw
  modified_base (305)..(305): a, c, t, g, unknown or other
  misc_feature (305)..(305): n is a, c, g, or t
tcagacgcgagtatcacgaccggtgctcgatttagtgtcgtcgcaagagagagggggggggtcacaagaggcagcgctctcgggacgtctcccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggtacttttaatatggtctcgtggtaccaatacctccagacaacgacccccaatcatacttangaggcactacgcggcctgtagggttctagtctcttctctggctaccgagtcctggacaacgacggccctccctgacctatctcgtcggccctccgacgtcctggaccgacgaggtctagtaatttattattcgcctttgccttacattagtcgacgtaagtaacgttaggttaacgttacgttttgggacgggtttccggggaccgggggtactaaggggtcgaccggttcggtacgggtacaccgggtacccgaaggtcccgttaccggtccccccgtaggtaccctaccgtcccgttcccggttaccccc

SEQ ID NO: 6740 - DNA, 849 bp, Homo sapiens
  misc_feature: GYAE6OF01ESQMK.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttggacttttaatatggtctcgtgtaccaatacctccaggacaaacgccccaaatcaatactttatgaggctacgtaacgccggtccctcgtaggggttttctagtccgtcttccgtcgtcggtcctaccgaacgttccgtacgggaccaaaccgtacccgggtccccttccccgtacggtaacccctaacgttcccgttccgttaccggggtcccccttaccccgaaccggttccccgtacgggtaaccccgggtaaacccggtaacggggtacctttacggttaaacttttaacgttttaacgtttcggtacctttacggtaccctttacgtaacgttacgttcggtaccgtaagttaacgttaagggtttaacggttttaacggttttggggtaaccggggggtttacccggggggtaacccggggggggtaaacccgtaaacgggggttacccgggtaaacccgggtttaccggggttaaaccggggttacccgaaccgggtaaccccccggtaaaaggggttcccccttaccccggggttaccccccccggttaccgggttaccccttaacccggtttcccggtttcccccggtttaaccccccccg

SEQ ID NO: 6741 - DNA, 610 bp, Homo sapiens
  misc_feature: GYAE6OF01CV93O.23.71.G05.1.454.CMB.1.raw
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacaggtcgatcaccgtctcctgcactcggaacccnagtgatgttggacttttaatatggtctcgtgtaccaatacctccagcaaacgccccaatcatacttangaggcactaagcggccctgtaggggtttctagtcgtcttctctcggctcaagtctggcaacncggcctcctgaccntctctcggcctccacgcctgacgacgaggctagtatttatagttgctcgtccttcattatgactaagtaagttaagttagttacgttttggaacggggtttccggggacggggggtaaccgtaacgggtcggtaaccggttacggtacgggtaccaccggtacccgaaacgggtcccgttccgggtccccccgttacggttacccgtaccttcccgttcccggtttacccccccg

SEQ ID NO: 6742 - DNA, 547 bp, Homo sapiens
  misc_feature: GYAE6OF01AWTFT.23.71.G05.1.454.CMB.1.raw
  modified_base (229)..(229): a, c, t, g, unknown or other
  misc_feature (229)..(229): n is a, c, g, or t
  modified_base (528)..(528): a, c, t, g, unknown or other
  misc_feature (528)..(528): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttgggacttttaatatggtctcgtggtaccaatacctccaggcaaacgcccccaaaatcatactttatgaggcactaagcggcctgagggtttctagtcgcttctctggctccaagtctggcaacgacggcctccctgaccatctctcggcctcgacgcctgacgacgaggctgattattattgctgctcatatgcagtatagtagttctttaggagggttcgggacgggggtacagggtcgaccggttcgtaggtcgacggcccgaaggtctccgtcccctcgggtaccnccgttcgtccgttcccccg

SEQ ID NO: 6743 - DNA, 562 bp, Homo sapiens
  misc_feature: GYAE6OF01DG2PH.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagccccaatcatacttatgaggcactaagcgcctgtagggttctagtcgcttctctggctcaagtctggcaacacggcctccctgaccatctctcggcctccagcctgacgacgagctgattattattcgctgctcatatgacagatagtagtacgtttgtagggttcgggacggggggtaccgtaagggtcggtaccggtcggtaacgggtcgacggtcccgaaacgggtcctaccggtccccccgttaccggtacctaccgtccgttccgttacccccg

SEQ ID NO: 6744 - DNA, 619 bp, Homo sapiens
  misc_feature: GYAE6OF01B01A1.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgattggttgggtacttttaatatggtctcgtggtaccaatacctccaggacaaactcccccaaactctatactttatgaggcactaagcggccctcgtagggtttctacgtcgtcttctcgtcggcctcaagtctggcaacgaccggcctccctcgacctactcctcgtcggccctccacgcctgaccggacgagctagtatttattagttgctgctctatagtcgtctaacgtagttagtttaacgttacgttttagggacggggtttaccggggaccgggggtaacgaacgggttggtacccgggttggtacggtacgaccggtaccccggaggtccgtcccggtccccgtccggtacctccgttccgtcccggttccccccg

SEQ ID NO: 6745 - DNA, 545 bp, Homo sapiens
  misc_feature: GYAE6OF01BL9SO.23.71.G05.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
  modified_base (425)..(425): a, c, t, g, unknown or other
  misc_feature (425)..(425): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaatatggtctcgtggtaccaatacctccaggacaaacgcccccaatcatacttangaggcatagccggccctgtaggggtttctagtcgcttctctggctcaagtctggcaacacggccctccctgaccatctctcggccctcacgcctgacgacgaggctgtattattatgctgctnatatgcagtatagttagttacgtttggagggttcgggacgggggtactagggtcgtaccggtgtacggtcacggcccgagtccgtccgtcccccgtcggtacaccttcgtccgtcccccg

SEQ ID NO: 6746 - DNA, 885 bp, Homo sapiens
  misc_feature: GYAE6OF01CIGM5.23.71.G05.1.454.CMB.1.raw
  modified_base (233)..(233): a, c, t, g, unknown or other
  misc_feature (233)..(233): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgccacgtcggaaccccgnagtgagttggttacgggtaactttttaaagtagttcggttccgttacggttacggtaaaccctaaacgtttaccccgttaccccgaacgggtaaccccgaaaaacccggtacccccccctaaaaactttaccctaaacgttttaaccgtttttaacgtacgggtaacggggtaaccctaaaccgttaaaccgggtcccgggtaccccgtttacgggttaacgggggttttaccttacgggttacccggtccttttccgttccgttacggtacccttacccgtaaacggtttccgttacgggaaccctaaaccggtacccgggtaccccttaccccgtacgtaaccccgtaacgttcccgtcgtccgggtaccccttacccgaacggtccccgtacggaacccgggtaccggtacgggtacctttaggttaaacttttacgtttaacggtttcgtacccgttacggttaccttacgtaattacgtacgaaccgtaagttaacgttacggttaacgttacgtttacgggtacgggtttccggggaacggggtaacctaagggtccggaccggttagtaccgggtcaaccggtacccgaacggtcccgttcccggtccccggttagtacccgtacttcccggtccgttacccccg

SEQ ID NO: 6747 - DNA, 633 bp, Homo sapiens
  misc_feature: GYAE6OF01CR5LI.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccncagtgattgttgggtacttttaatatggtctcgtgtaccaataccctccaggacaaacgcccccaaactcatacttatgaggcactaagcgcctcgtagggtttcagtcgtcttctctgctcagtctggcacacggccctccgtgacctatcctctcggtccctccgacgtcccgtgaaccgacgacgtcgtagtactttattagttcgcgttgcctcaggtacgactaagtaattaaggttacgttacgtttagggtacgggttacggggacgggggtaaccgaagggttccggaccggtacggtacgggttccgaacggaccccgtaaagggcccttacccgggtacccccccgttcgggttaccctaccgttaccccggtttccgtcccccgtaacccccg

SEQ ID NO: 6748 - DNA, 574 bp, Homo sapiens
  misc_feature: GYAE6OF01EOLYP.23.71.G05.1.454.CMB.1.raw
  modified_base (305)..(305): a, c, t, g, unknown or other
  misc_feature (305)..(305): n is a, c, g, or t
  modified_base (361)..(361): a, c, t, g, unknown or other
  misc_feature (361)..(361): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgattggttgggacttttaatatggtctcgtgtaccaatacctccaggacaaacgcccccaaatcatacttangaggcactagccgcctgtagggttctagtcgcttctctggctccaagtctgcaacncgcctcctgaccatctcgtcgcctccagcctagacgacgacgctgatttatattgctgctactatatgacaagtattaggttagttacgtttgggacgggttcggggaccgggggtaactaacgggttcggaacccggttggtacggtcgaacggtcccgtaacgggccttcccggcccccttcgggtaccctacgttccgtccgttaccccc

SEQ ID NO: 6749 - DNA, 957 bp, Homo sapiens
  misc_feature: GYAE6OF01AOR1V.23.71.G05.1.454.CMB.1.raw
  modified_base (140)..(140): a, c, t, g, unknown or other
  misc_feature (140)..(140): n is a, c, g, or t
  modified_base (243)..(243): a, c, t, g, unknown or other
  misc_feature (243)..(243): n is a, c, g, or t
tcagacgcgagtatcacgaccggtgctcgatttagtgtcgtcgcaagagagagggggggtcgacaagaggcagcgctctcgggacgtctccaccatggcctgggctctgctgctcctcactctcctcactcaggaccacncgggttcctgggtcccagtcctgcccctagactcagcctgccctcgtgtctgggtctcctggactagtcatccaccgtctcctgacctactcggaaccccgtnaggttcgtagtcggttttggggaaacccttttttaatacgttcgggttcttaccggttcggttaaaccgtaaacttaacccttccccggaagtaccgaaaaccggtaccccccctaaaacgttccctaaacttaacgtttttaacgtaccggacggggtaccgtaaacctaaacggtccccgggtaccccttccggttaaacgggggttttttccaaacggtttccgggtacccttttccggttaccgttcgggtaacccttacccgtaaacgggtccgtttacgggacccaaacccgtacgggtcccctttcccccggtactaacccgtacttccgtttaccgtccgggttcccgtacccgtaaccggtcccgttaccggtaaccgggacccggtaacggttcctaaacggttagtttaacctttcggtttaaccaccgttacggttccttacgtaacgtttccttaacggtacccgtaacggtttaattacggggtttaaacgtttaccggtttaacggggtttcccggggttacgggggtaacccggggggtaaaccgtaacggggttccggtaaacccgggtttacgggtaccgggttacccgtaaccggtaccccggggttaaaccggtacccggtttaaccccggttccccccggttaacggggttccccgttaaaccccttggggttttaacccccccttccccggg

SEQ ID NO: 6750 - DNA, 602 bp, Homo sapiens
  misc_feature: GYAE6OF01ALSWZ.23.71.G05.1.454.CMB.1.raw
  modified_base (332)..(332): a, c, t, g, unknown or other
  misc_feature (332)..(332): n is a, c, g, or t
  modified_base (458)..(458): a, c, t, g, unknown or other
  misc_feature (458)..(458): n is a, c, g, or t
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
  modified_base (571)..(571): a, c, t, g, unknown or other
  misc_feature (571)..(571): n is a, c, g, or t
tcagacgcgagtatcacgaccggtgctcgatttagtgtcgtcgcaagagagaggggggggtcgacgaagagtcagcgctctcgggacgtctccaccatggcctgggctctgctgctcctcactctcctcacctcaggacctacagggtcctcgggcccagtctgcccctgactcagcctgcctcgtgtctgggtctcctggactagtcgatccaccgtctcctgacactcggaacccgccagtcatgtttcggggaactttttaatacttggtcttcggtcggtacctaataccctcccaggtcaaacgcccccaaacgtccatacctttangacggtcactaagccggtccctcgtaagggtttctacggtcgtcttctctcgctcctaagtctcgacaactaccggcccttccctggtacccagttcctcgtcgccctccacgcctgaccgtacgngtactcgtattacgtattcgtctgcctcatacntacgatatacgtagttacgttntacgggtcggacggggtacaaggtgacccgtggtacgttcgacgtacccgacggtacncgtccccgtcgtacgtctcggtcttcccccg

SEQ ID NO: 6751 - DNA, 551 bp, Homo sapiens
  misc_feature: GYAE6OF01EPYBL.23.71.G05.1.454.CMB.1.raw
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagccccaaatcatactttangaggcactaagcggccctgagggtttcagtcgcttctctggctcaagtctggcaacncggcctccctgaccatctctggcctccagcctgacgacgaggctagtattattattgactgctctatatgcagatagttagttacgtttggagggttccgggagggggtaccaagggtcgacccggttcgtacggtcgacggcccgaaagggtcctcccggcccctcggtacccacgttccgtcgttcccccg

SEQ ID NO: 6752 - DNA, 887 bp, Homo sapiens
  misc_feature: GYAE6OF01AVMCD.23.71.G05.1.454.CMB.1.raw
  modified_base (559)..(559): a, c, t, g, unknown or other
  misc_feature (559)..(559): n is a, c, g, or t
tcagacgcgagtatcacgaccggtgctcgatttagtgtcgtcgcaagagagagggggggtcgacaagaggcgagcgctctcgggacgtctccaccatggcctgggctctgctgctcctcactctcctcactcaggacacagggtccgtcgggcccagtctcgccctagactcacgccctcgcccttccgtgtcgttcgggtcctcccgtagggactagtcgactccgacccgttcctcctgccacgtaccgggaaccccgctaggtgacgttcggttttaggggttaaccttttttaaagttacggttggttccgttacggttacggttaaacctaaaccgttacccgtacccgaacgggtaacccaaaaccgtaccccccctaaaacttaccttaactttaaccgttttagacgggtaacgggacctaaacgtaacggtcccggtaccccgttaggttacggggtttactacggttccgtcctttcgttccgtcggtacctacctaaggttcctacggaaccaacccggtaccggtccccttaccccgtagtaacccnctccgttccgtaccggcccctacgactcccgtaggacccgacggtacggtccttagtaatttacgttattccgggcctttcgaccttacctaagttccggtataccgtaagttacgttaacggtttaccgttaacgggttttcggggttaaccgggggttacggggtacccggggggtaaactaaccgggggttccggggttaaacccggttacgggttacccgggttaacggaacccgttacccccggggaacggttacccccgttccccgggtccccccggtttaaggttcccctccggtttaaccgggtttccccgggttacccc

SEQ ID NO: 6753 - DNA, 548 bp, Homo sapiens
  misc_feature: GYAE6OF01CIHSA.23.71.G05.1.454.CMB.1.raw
  modified_base (230)..(230): a, c, t, g, unknown or other
  misc_feature (230)..(230): n is a, c, g, or t
  modified_base (370)..(370): a, c, t, g, unknown or other
  misc_feature (370)..(370): n is a, c, g, or t
  modified_base (442)..(442): a, c, t, g, unknown or other
  misc_feature (442)..(442): n is a, c, g, or t
  modified_base (531)..(531): a, c, t, g, unknown or other
  misc_feature (531)..(531): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggtacttttaatatggtctcgtggtaccaatacctccaggcaaacgcccccaaatcaatacttatggaggcaactaagccggacctcgtaggggtttctagtcgcttctctggctcaagtctggacaacncggccctcctgacctatctctcggcctaccagcctgaacgacgaggctagtattattattgctgctcatatnactagatagtagttactttggcgggttacggcggggtacaggtcgtacgtcggtacgtcacgccgaggctccgtccccgtacggtaccncttccgtcgttaccccc

SEQ ID NO: 6754 - DNA, 704 bp, Homo sapiens
  misc_feature: GYAE6OF01C466S.23.71.G05.1.454.CMB.1.raw
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
tcagacgcgagtatcacgaccggtgctcgatttagtgtcgtcgcaagagagaggggggggatcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcactcggaacccnagtgatggttggtacttttaanagttggtctcggttcgtaacctaactacctccgaggaccaaacgacccccaaactctaacttactttagtgacgggtacaacgtaacgccgtcccgttacgtacggggtttctagtccgtcttctctcggtcctacctaagtcgtcggacaaccgtacggtccctacccgtgaaccctactccgttccgtcgccctaccgacgtcccgtacgaccggtaacggacgggtccttaaggtacttttaacgtttaacgttcggtccgttaggtacccttagtaacttagtcgtaacgtagttaaagttagttaacggtttcgtttaggggacgggtttaccggggacgggggtaaaccgtaaggggtccgtaaccgggttacgggtaacggtccgaaccggtacccggaaggtccccgttccgtacccccgtgtaacctcgttccgttaccccg

SEQ ID NO: 6755 - DNA, 661 bp, Homo sapiens
  misc_feature: GYAE6OF01D32G3.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaaccccgcagtgagtgttgggtacttttaatatggtctcgtggtaccaataccctccaggaccaaacgcccccaaactcatacttatggaggcactaagcgccctcgtagggttctagtcgcttctcgtcgctctaagtcgtggccaacgaccggccctccctcgacctatcctcgtcgccctccacgtcctaggacgtacgaggtctagtatttagttattcgccttgtaccttactaattagtcgacgaagtagttaacgttaggtttacgtttgggtaaccggggttccgggggaccggggggtaaccgtaaggggttccgggtaaccggttaccgggttaacggtccgaaccgggtccccgaaaccgggtccgttaccccggtacccccgttacggttacccctaccgtttcccgttccccggttccccccg

SEQ ID NO: 6756 - DNA, 647 bp, Homo sapiens
  misc_feature: GYAE6OF01BXPJ5.23.71.G05.1.454.CMB.1.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnagtgatggttggtacttttaatatggtctcgtgtaccaactacctccaggacaacgccccaatctatacttagngaggcacgtagccggcctcgtacgggtttctagtcgtcttctcgtcggcctcgtaagtcgtaggaccaaccgaccggtccctacccgtacgaccctattcctcgtccggtccctcccgacggtccgtacggaccggacggacggtccttaggttaactttaagtttattcgtccttcgtcttactatacgtgaacgtaagtagttagttagtttacggtttaggacggggttcgggacgggggtacgtaacgggtcggtaccggttggtacggtcgaccggtccgaacggtccgtcccggtcccccgttcggtaccctaccgttccgtcccggttccccccg

SEQ ID NO: 6757 - DNA, 536 bp, Homo sapiens
  misc_feature: GYAE6OF01DTWFI.23.71.G05.1.454.CMB.1.raw
  modified_base (308)..(308): a, c, t, g, unknown or other
  misc_feature (308)..(308): n is a, c, g, or t
  modified_base (365)..(365): a, c, t, g, unknown or other
  misc_feature (365)..(365): n is a, c, g, or t
  modified_base (432)..(432): a, c, t, g, unknown or other
  misc_feature (432)..(432): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttgggtacttttaatatggtctcgtggtaccaatacctcccaggccaaacgcccccaaatcatacttangaggcactaagcgccctgtagggtttctagtcgcttctctggctcagtctggcaacncggccctccgtgacctatctctcgcctccacgcctagacgacgagctgatttatattgctgctcatntgcagatagtagtatttggaggttcgggacggggtacaaggtcgaccggtcgtaggtcagcccgaaggtcctccgtcccctcggacctcgtccgtcgtaccccc

SEQ ID NO: 6758 - DNA, 599 bp, Homo sapiens
  misc_feature: GYAE6OF01BXVXT.23.71.G05.1.454.CMB.1.raw
  modified_base (314)..(314): a, c, t, g, unknown or other
  misc_feature (314)..(314): n is a, c, g, or t
  modified_base (460)..(460): a, c, t, g, unknown or other
  misc_feature (460)..(460): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgattgttgggtaacttttaatagtggtctcgtaggtaccaactaccctccaggacaaacgcccccaaactcatactttangaggcactaagcgtccctgtaggggtttctagtcgcttcgtctcggctacgagtctggaccaacgacggccctaccctgaccacttcctctcggccctccgagccgtaggacgacgaggtcctagtattattagttcgctcgctanattatcgacaagtattagttagttacggtttaggcgggttacgggacgggggtacctaagggtcgaaccgggttcgtacgggtacgacgtacccgacggtcctccgtcccccgtcggtacctcctcgttccgtcccccg

SEQ ID NO: 6759 - DNA, 736 bp, Homo sapiens
  misc_feature: GYAE6OF01E3T39.23.71.G05.1.454.CMB.1.raw
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggacagtcgatccaccgtctcctgcactggaacccgntagtgtagttggttaggtacttttaangtcgtctcgtacgtaaccaactacctaccaagacaaaccgacccctaaatcaattacttagaggacgtacacggtacgtccgtccgttagtacggttctacgtcgtcttcgtccgtacggtacctacgtaacgtccgtacgaaccgtaaccgtcccgtcccttccgacgacctactccgtccgaccgtcctacccgagtacccgtaggtaaccggtacgtacggttcttagttaaacgtttactacgtcgtaccttacgtaccttaagtagttacgtacgtaacgtaaggttacggttaacgggtttacggttaacgggttcggggtaacccgggtaccggggaccggttaaccgtacggtaccggtaaccggttacggtcggaccccgtaaacccggtcccggtaaccgttcccccgttcccccggtacccggtttacctaccccgttaccccgttcccgttacccccgttacccccg

SEQ ID NO: 6760 - DNA, 527 bp, Homo sapiens
  misc_feature: GYAE6OF01EO24B.23.71.G05.1.454.CMB.1.raw
  modified_base (231)..(231): a, c, t, g, unknown or other
  misc_feature (231)..(231): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgnagtgatggttggacttttaatatggtctcgtggtaccaatacctccaggcaaacgccccaaactcatacttatgaggcactaagcggcctcgaggggtttctagtcgcttctctggctcaagtctggcaacacggcctcctgaccatcctcgtcggcctccagcctgacgacgagctgattattattgctgctcatngnagactagtagttacttggaggttcgggacggggtacaagggtgtaccgtcgtagtcaggcccgaaggcctacgtcccctacgtcactctcgtacccc

SEQ ID NO: 6761 - DNA, 769 bp, Homo sapiens
  misc_feature: GYAE6OF01A8AIF.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtcctcgccctgactcacgcctcgcctccgtgtcgtgggtcctccgtggacagtcgactccaccgtctcctgcacgtcggacccgcagtgtagttggttacggttaacttttaatagtggtctcggtacggtaaccaactaccctccgaggacaaaccgaccccctaaactcaacttactttagtaggacggactaacgtaacggccggtaccctacgtacggggtttctacgtcgtcttcgtcgtcgcctaccgaagtcgtacggaccaaccgacggtccctcccgtacgacctacgtcctaccggtcgtaccctaccgtaccggtaccgttacggaacccggtacggtacggtcccgttagttaaacttttacgtttaacgttcggtaccgtttacggtaccttaccgtaacttaacgttcgaaccgttaacggttaaggtttaacgggtttaacgtttacggttttacggggtaacgggggtttccgggggaaccggggggtaacgtaacggggttccggtaacccgggttacgggttacggtaccgtaccggtacccgaacggtccgtcccgtaccccggttcggtacctccgttccgtcccgttacccccg

SEQ ID NO: 6762 - DNA, 522 bp, Homo sapiens
  misc_feature: GYAE6OF01BEZ4L.23.71.G05.1.454.CMB.1.raw
  modified_base (424)..(424): a, c, t, g, unknown or other
  misc_feature (424)..(424): n is a, c, g, or t
  modified_base (509)..(509): a, c, t, g, unknown or other
  misc_feature (509)..(509): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaatcatactttatgaggcactaagcgccctgagggtttctagtcgcttctctggctccaagtctgcaacacggccctcctgaccatctctcgcctccagcctgacgcgagctagtatttattatgcttgctanattatcgctagattagttagttctttggaggttccgggacggggtacaggtcgaccgtgtaggtcacgccagcctcgcccctgcnctcgtcgtccccg

SEQ ID NO: 6763 - DNA, 632 bp, Homo sapiens
  misc_feature: GYAE6OF01AMI3P.23.71.G05.1.454.CMB.1.raw
  modified_base (232)..(232): a, c, t, g, unknown or other
  misc_feature (232)..(232): n is a, c, g, or t
  modified_base (312)..(312): a, c, t, g, unknown or other
  misc_feature (312)..(312): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatccaccgtctcctgcacgtcggaacccgnagtgattggttagggtacttttaatagtggtctcggtggtaccaatccctccaggcaaacgcccccaaatcatactttangacggcactaacgccggcctcgtagggtttctacgtcgtcttctcgtgctacagtctaggcacncggtccctccgtanacctattctcgtcggccctccgacgtcccgtagaccgacgtaggccttagtactttattagttcgcgttcgccttatatctcgacgtagtacgttaggtttagttacgtttgggtacgggttccggggaaccgggggtacgtaagggtccgtaaccggtcggtaacggtaccgaaccggtcccgaacgggtcccgtcccggtaccccccgttggtaccctccgttccgtcccggttcccccg

SEQ ID NO: 6764 - DNA, 570 bp, Homo sapiens
  misc_feature: GYAE6OF01B4QZE.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggtacttttaatatggtctgtggtacaatacctccaggacaacgccccaaatcatacttatgaggcacgtaagccggcctgtagggttctagtcgtcttctcgtgctcaagtctgaccaacgacggtcctccctagacctactctcgcgtcctacgacgcctagacgagaggtctagtattatatgctgtctacatatcgacagatagtagtactttggacgggttcgggacggggtactaagggtcgtaccggtcggttacggacccaggtaccccgaaggcccttacccggcccccgtaggtaccctaccttccgtccgttaccccccg

SEQ ID NO: 6765 - DNA, 649 bp, Homo sapiens
  misc_feature: GYAE6OF01BUJIQ.23.71.G05.1.454.CMB.1.raw
  modified_base (228)..(228): a, c, t, g, unknown or other
  misc_feature (228)..(228): n is a, c, g, or t
  modified_base (298)..(298): a, c, t, g, unknown or other
  misc_feature (298)..(298): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgattgttggacttttaatatggtctcgtgtaccaatacctccagcaacgccccaaactcatacttangaggcactaagccgtcctcgtagggtttctagtcgcttctcgtcggctccgaagttccgtaggaccaacgtaccggtccctccccgtagaaccctagttccttcgtcggtccctccgacgtccctaggaccggacggaggcttagtaactttattacgtttgaccttgtccttactatacgtgacgtaagtacgttaagggttacgttacgttttagggaacggggtttccgggacgggggtaaccgtaaggggtcgtaaccgggttcggtacggtacgaaccggcccgtaaagggtcccttaccgggtcccccttacgggttaccaccgttccgtcccggttaccccccg

SEQ ID NO: 6766 - DNA, 640 bp, Homo sapiens
  misc_feature: GYAE6OF01DKVI9.23.71.G05.1.454.CMB.1.raw
  modified_base (228)..(228): a, c, t, g, unknown or other
  misc_feature (228)..(228): n is a, c, g, or t
  modified_base (297)..(297): a, c, t, g, unknown or other
  misc_feature (297)..(297): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaatatggtctcgtggtaccaatcctccaggccaaagccccaatcatacttangaggcactaagcgcctgtagggttcagtcgcttctacgtggcctacaagtcgtaggacaacgccgtcctccgtacgacctattcctcgtcggcccttaccgacgtccgtagaccggacgtaacggtcttaggtactttacttaacgtttcgccgttgtaccttacgtaacttagttgaacctagttaacgttaggtttacgttacgttttcgggacggggtttccggggaacggggtaacccgtaagggttcgtacccggttaggtacggtaccgtacggaaccccgtagggtccctcccgggtccccgttacggtactacccgtccgttcggttaccccccg

SEQ ID NO: 6767 - DNA, 663 bp, Homo sapiens
  misc_feature: GYAE6OF01D0AUP.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatccaccgtctcctgcacgtcggaacccgcagtgagtggttaggtacttttaatagtggtctcggtacgtacctaactaccctccgaggaccaaaccgaccccccaaactctacttactttaagtggacggacaacgtaacgccggtaccctgtagggtttctaggtcgtcttcgtcgtcgtcctacctaagtcctacggaccaaccgtaccggtccctaccctgaccctattcctcgtccggccctaccgacgtccgtacggaccgaaggtcgactagtaattttattagttcgctacgtcttctattagtcgaactaagttataaggttagtttacgtttggggtacgggttccggggacggggtaaccagggttccgacggttcggacggttaccgacgtaccgaccggtcgcccggtcccccgttggtaccctccgttccgttcccggtcccccg

SEQ ID NO: 6768 - DNA, 753 bp, Homo sapiens
  misc_feature: GYAE6OF01DM762.23.71.G05.1.454.CMB.1.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactggacccnagtgatgttggtacttttaatntggtctcgtaggtaccaatacctccaggacaacgccccaactcattacttatggaggcactacgcggcctgtacgggtttcacgtcgtcttctcgtggcctactaagtctaggacaacgaccggtcctcccgtcgacctacttctcgttccggtaccctccgacgtcccgtggaaccggtaccggagtccgttagttaacttttactttagttcgtccgtcggtaccttacgtaattacgtacggtaacgtaacggttaacgtttaacgggtttaaccgtttaacgggtttttacgggtaacggggggtttacccgggggaaccgggggggggttaaccctaaacgggggtttaccgggtaccccggggtttacgggttaaccggggtaacccgaaccgggtacccccggtaaacggggttccccgttaccccgggttcccccccccgggttacggttaccccgtaacccgtttcccgggttcccccgttttaaccccccccg

SEQ ID NO: 6769 - DNA, 624 bp, Homo sapiens
  misc_feature: GYAE6OF01A7QKQ.23.71.G05.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (402)..(402): a, c, t, g, unknown or other
  misc_feature (402)..(402): n is a, c, g, or t
  modified_base (450)..(450): a, c, t, g, unknown or other
  misc_feature (450)..(450): n is a, c, g, or t
  modified_base (465)..(465): a, c, t, g, unknown or other
  misc_feature (465)..(465): n is a, c, g, or t
tcagacgcgagtatcacgaccggtgctcgatttagtgtcgtcgcaagagagagggggggtcgacaagaggcagcgctctcgggacgtctccaccatggcctgggctctgctgctcctcactctcctcactcaggacacagggtcctggcccagtctgccctgactcagcctgcctccgtgtctgggtctcctggacagtcgatcaccgtctctgacactggaaccccgnagttgattggttaggacttttaanatggtcctgtggtaccaatcctccaggcaaacgccccaaatcatactttangacggtcactaagccggtaccctgtaaggggtttcacgtcgcttcncgtggctaccaagtcgtggccaactacggcctccctgaacctgtccttccgngtccctccgagtccgtcgacgtaccgagtcctgtaattacttagttcncgtctctacattacngtccagtagttaacgtagttacgtttcggtaacgggttccgggtagggggtaaccctagggtacccggtaaccggttgggtaacggttacgacggtacccgaacgggtacccgtccgtcccccgtaccggtttcgacccgtttcgtcggttccccccgg

SEQ ID NO: 6770 - DNA, 608 bp, Homo sapiens
  misc_feature: GYAE6OF01EADB3.23.71.G05.1.454.CMB.1.raw
  modified_base (231)..(231): a, c, t, g, unknown or other
  misc_feature (231)..(231): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccnaggtgattggttggtacttttaatatggtctcgtgtaccaatacctccagcaaacgccccaactcattacttatgacggcactaacgccggtccctcgtagggtttctagtcgtcttcncgtcggctcgagtctggcaacncggcctcctgaccntctctcgcctcacgcctgacgacgtcgntgattattactnctgctctatactgctaagtatagttacgttacgtttggtacgggttaccgggacggggggtaaccctaaggggtccgtaaccgggttacggtacggttacgaaccggtccccggtaacggtcccgttacccgtccccccggttacgggttacccgtaccgttcccgtccgtttacccccccg

SEQ ID NO: 6771 - DNA, 613 bp, Homo sapiens
  misc_feature: GYAE6OF01DHYUX.23.71.G05.1.454.CMB.1.raw
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggccccagtctgccctgactcagcctgcctcgtgtctgggtctcctggacagtcgatcaccgtctcctgcactcggaacccgnagtgatggttggtactttaatatggtctcgtggtaccaatacctccagcaaacgccccaaatcatacttangaggcactagcggcctgtagggttcagtcgtcttcncgtggcctaccgtaagtcctggacaaccgaccggtccctccctagaccctattccgtcgtcggccctccgacgtcctgaccggacgaggtctagtactttattatttcggactcgtccttcgtaattagtcgactagtaacgttaggttacgtttacgtttgggtacgggttcggggaccgggggtaaccgtaaggtcggtaccggtggtacggtacgacggcccgaaggtccctccgtcccccgtacggtcctaccgtccgttccgttccccccg

SEQ ID NO: 6772 - DNA, 537 bp, Homo sapiens
  misc_feature: GYAE6OF01BVH2W.23.71.G05.1.454.CMB.1.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctccaggcaaacgcccccaaatcatactttangaggcactaagcggccctgagggtttctagtcgcttctctggctcaagtctggcaacncgcctcctgaccatctctggcctccagcctgacgacgaggctgattattattgctgctcatatgcagtatagtagttactttggagggttcgggacgggggacctaagggtcgaccggtcggtacggtcacggcccgaaggcctcggcccccgtcggtaccacgttctccgttcccc

SEQ ID NO: 6773 - DNA, 695 bp, Homo sapiens
  misc_feature: GYAE6OF01AFEUP.23.71.G05.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcactcggaacccnagtgatggttggtacttttanatggtctcgtggtaccaatacctccaggacaacgccccaatcatacttangaggcactagccgtcctgtagggtttctagtcgtcttctcgtcgtctccgaagtcgtacggaccaaccnccggtcccttcccgtacgaccctactcgtacctcgggcccttaccgacgtcccgtacggaccggtaccggacggtaccttagttaacgtttaacgtttacgtttccgggtacttccggtaccttaccggtaatttaacgtcggtacctaacgggttattaacggttttacgttacggttttggggtaccggggttaccggggtaaccggggggtaaccgtagggttaccgggtaccggttacgggttacggtacggaccggtacccgtaacgggccttcccggtcccccgttacggtacctacccgttccgtttcccgtaccccccg

SEQ ID NO: 6774 - DNA, 580 bp, Homo sapiens
  misc_feature: GYAE6OF01ALW7F.23.71.G05.1.454.CMB.1.raw
  modified_base (367)..(367): a, c, t, g, unknown or other
  misc_feature (367)..(367): n is a, c, g, or t
  modified_base (429)..(429): a, c, t, g, unknown or other
  misc_feature (429)..(429): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaactcatactttatgaggcactaagccggccctcgaggggtttctagtcgtcttctctggctccaagtctggcaacncgcctccctgaccatctctcggcctccacgcctgacgacgaggctgatcattatgactgctnatatgcagtatagttacgttactttggacgggttccgggcgggggtaaccgtaaggggtcgtacccggttcgggtaacggttcgacggtaccccgtaaggtcccgtacccggtaccccccgtccgggtccgtaccgttcccgttacccggg

SEQ ID NO: 6775 - DNA, 546 bp, Homo sapiens
  misc_feature: GYAE6OF01BD48O.23.71.G05.1.454.CMB.1.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
  modified_base (533)..(533): a, c, t, g, unknown or other
  misc_feature (533)..(533): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttggacttttaatatggtctcgtggtaccaatacctccaggcaaacgcccccaaatcatacttangaggcactaagccgcctgagggtttctagtcgcttctctcggctaccaagttctggaccaaacgccggtccctccctgacctagtcctcgtcggccctcacgtcctgacgcgagctgtacttatnttgctgctcattacngactagattagttagtactttggacgggttcgggacggggaccagggtccgacgttcggacgtcacgccgaggtcctacggtcccctggtacncgtcgtcgtcccc

SEQ ID NO: 6776 - DNA, 719 bp, Homo sapiens
  misc_feature: GYAE6OF01A4GBN.23.71.G05.1.454.CMB.1.raw
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (595)..(595): a, c, t, g, unknown or other
  misc_feature (595)..(595): n is a, c, g, or t
  modified_base (671)..(671): a, c, t, g, unknown or other
  misc_feature (671)..(671): n is a, c, g, or t
tcagacgcgagtatcacgaccggtgctcgatttagtgtcgtcgcaagagagaggggggggggtcacaagaggcagcactctcgggacgtctccaccatggcctgggctctgctgctcctcacctctcctcactcgacgacacggtacgggttccggtccgggacctacgtcgtccgtcccgtagtacctcacgtccgtccgtcccgttcggttcgttcggttcgggtcctccgtacgggacgtacgtacgtactccgtacccgttcctcgtcgcctacggtaccggacccgacgtaggtagtagtttggttacggtttaactttaagtcggttgtccgttcggtacgtaaacctacgtaccctaccgacggtaacaaccccgaacccctaactctactttacttagacgggacgtactaacgtacggcccgtacctacgggttcggtttactacggtcctcgttcctcggtacgtcctaacgtagtcgtacgaactaaccgacccgtccctaccgtacgtacctactccgtacgtccgccctacgctccgacggaccgacgcgtacgtntttaattntntgtctctatctaatcncgagtattacgtagttaacgttggttacgggacggggtcgggaacgggtactgggtaccgtacggttggacgtacncggaccgtgtccttccccggtccgtcgtacctcttccgtcccgtcccc

SEQ ID NO: 6777 - DNA, 590 bp, Homo sapiens
  misc_feature: GYAE6OF01D790C.23.71.G05.1.454.CMB.1.raw
  modified_base (228)..(228): a, c, t, g, unknown or other
  misc_feature (228)..(228): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggtacttttaatatggtctcgtggtaccaatacctccaggcaaacgccccaaactcatacttatgaggcacgtaagccggccctcgtagggtttctagtcgtcttctcgtggctccaagtctggcaacgcgcctcctgaccatctctcgcctccacgtcctgacgacgaggtctgtaacttattattgctgtctctatagtgactagtataggttagttacgtttggtacgggttccggggaccgggggtaacctaagggtcggaacccggttcggtacggtacgacggtacccgaaggtcccgtcccggtcccccgttcgggtaccctaccgttccgtcccggttccccccg

SEQ ID NO: 6778 - DNA, 673 bp, Homo sapiens
  misc_feature: GYAE6OF01AHGXK.23.71.G05.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (385)..(385): a, c, t, g, unknown or other
  misc_feature (385)..(385): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgattggttagggtacttttaatatggtctcggtggtaccaatacctccaggcaaacgcccccaaatcatacttangaggcactaagcggccctgagggtttctagtcgcttctctcggcctcaagtctggccaacacggccctccctgacctntctctcggccctccacgtcctaggaccgtacggacggtcctaggtaactttatttcgttacgccgttagccttactaattagtcggaccgtaagtacgtttaacggtttaacggtttacgttttacggggtacggggtttccgggggtaaccggggggtaaccctaaggggttccggtaacccgggttacggttacgggtacccgaacggtccccggtaaacgggtcccttacccgggtccccccgttacgggtaccctacccgtttccgttcccggttaaccccccc

SEQ ID NO: 6779 - DNA, 640 bp, Homo sapiens
  misc_feature: GYAE6OF01EEAFP.23.71.G05.1.454.CMB.1.raw
  modified_base (312)..(312): a, c, t, g, unknown or other
  misc_feature (312)..(312): n is a, c, g, or t
  modified_base (380)..(380): a, c, t, g, unknown or other
  misc_feature (380)..(380): n is a, c, g, or t
  modified_base (451)..(451): a, c, t, g, unknown or other
  misc_feature (451)..(451): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgagttggttaggtacttttaatatggtctcgtacggtacctaatacctccaggacaaacgccccaaatcatacttangaggcacgtacgccgcctgtagggtttcagtcgtcttctctggctcgagtctgacaacgcgcctcccngaccatctcgtcggccctaccacgtcctggaacgacgaggtctagtaactttattagttcgcttgtacctntaatgtagacgtagtaagttacggttagtttatttgggacggggtttaccggggacggggtaaccgtaaaggggttccgtaacccgggttcggttacgggtacccgaacggtaccccggaagggtccccgttaccccgggtcccccgttaaccggtacctcccgtttccgttccccggttaaccccccc

SEQ ID NO: 6780 - DNA, 551 bp, Homo sapiens
  misc_feature: GYAE6OF01ASX0K.23.71.G05.1.454.CMB.1.raw
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctccaggcaaacgcccccaaatcatactttangaggcactaagcggccctgaggggtttcagtcgcttctctggctccaagtctggcaacncggcctcctgacctatctctcggcctccacgcctgacgacgagctgattattattgctgctcatatgcagtatagtagttacgtttggacgggttcgggacgggggtacctagggtcgtaccggtcggtacggtcgacggcccgaaggtcctccggtcccctcggtaccacttccgttccggtcccccg

SEQ ID NO: 6781 - DNA, 648 bp, Homo sapiens
  misc_feature: GYAE6OF01CWCM3.23.71.G05.1.454.CMB.1.raw
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
  modified_base (304)..(304): a, c, t, g, unknown or other
  misc_feature (304)..(304): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgccactggaacccnagtgatggttggtacttttaanatggtctcgtgtaccatacctccaggacaaacgccccaatctatactttangaggcactaacgcggcctcgtagggtttctagtcgtcttcgtctggtctaccgtaagtctacggacaacgaccggtccctcccgtagacctactcctcgtcggccctccgacgtccctaggaaccgtacgtacggtcttaggtacttttaagttagttcgtcttcgtaccttcattagtcgacgtaagtaattaggttagttacgtttggacgggtttcggggaccgggggtaacgaagggtccggtaaccggttcggtaacgggtacgaacgggtcccgaacgggtccgtacccgtccccccgtttacgggacccttaccgttccgttcccggttaccccccg

SEQ ID NO: 6782 - DNA, 512 bp, Homo sapiens
  misc_feature: GYAE6OF01CW9WQ.23.71.G05.1.454.CMB.1.raw
  modified_base (301)..(301): a, c, t, g, unknown or other
  misc_feature (301)..(301): n is a, c, g, or t
  modified_base (416)..(416): a, c, t, g, unknown or other
  misc_feature (416)..(416): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttangaggcactaagcggcctcagggtttcagtcgcttctctgctcaagtctggcaacacggcctcctgaccatctctggcctccacgcctgacgcgaggctgatttatattgctgctnatatgcagatagtatactttgaggttcgggcggggaccaagggtcgaccgtcggtagtcaggcccaaggctcggcccctggtcactcgtcgtcccc

SEQ ID NO: 6783 - DNA, 604 bp, Homo sapiens
  misc_feature: GYAE6OF01AJXGF.23.71.G05.1.454.CMB.1.raw
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccgcagtgatggttgggtacttttaatatggtctcgtggtaccaatacctcccaggcaaacgcccccaaactcatactttangagggcactaagcggccctgagggtttctagtcncttctctggctccagtctggcacncgccctccgtgaccatcctctcggccctccagtcctcgacgacgacggctgtatttatagttgcttgcttcatatgacgtagtagttaaggttagttactttgggtaacggggtttccgggacggggggtaaccaggggttaccggtaccggttacgggttacggttccgacggtcccggtaacggtccgtccggtccccccgtgggtacccaccttccgttcccgttccccccgg

SEQ ID NO: 6784 - DNA, 546 bp, Homo sapiens
  misc_feature: GYAE6OF01DDGS7.23.71.G05.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
  modified_base (428)..(428): a, c, t, g, unknown or other
  misc_feature (428)..(428): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggacttttaanatggtctcgtggtaaccaatacctccaggcaaagccccaaatcatactttangaggcactaagcgccctgagggtttcagtcgcttctcgtgcnctaagtctggacaacacggcctcctgaccngtctctgccctcgacgcctgacgacgagctagtattattagttgctgctacatntgcaagtatagttagtacgtttgacgggttcgggcgggggaactagggtcggacgttacggtaggtcgacggcccgaaggccttcgcccccgttcggacctacgtccgtcggtccccg

SEQ ID NO: 6785 - DNA, 689 bp, Homo sapiens
  misc_feature: GYAE6OF01BO1IM.23.71.G05.1.454.CMB.1.raw
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (527)..(527): a, c, t, g, unknown or other
  misc_feature (527)..(527): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctcgggtctcctggactagtcgatccaccgtctcctgcacgtcggaaccgnagtgatggttacggtaactttaangtggtctcggtacgtaacctaataccctaccaggtaccaaacgtccccctaaatctattacttagagaggaccaactaacggccgtcctagtacgggtttctacggtcctcttactcgtacggtcctacgtaagtcgtacggaacctaaaccgtccggtccccttacccgtacgtaaccctacgttccgtccgtcggtaccctacgacgtcccgtaggaccgtacggacgtcctagttaatttacgttagtcgtctgaccttacattacngactaagtagttagttacgttagtttcgggacgggttccggggaacggggttaaccaggggttaccgtacccgggttagtacgggtacccgacggtacccgaacgggtcccgtaccccggtcccgtccggttaccgacctttcccggtccccttacccccgg

SEQ ID NO: 6786 - DNA, 575 bp, Homo sapiens
  misc_feature: GYAE6OF01AW6T8.23.71.G05.1.454.CMB.1.raw
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (442)..(442): a, c, t, g, unknown or other
  misc_feature (442)..(442): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggaacagggtcctgggcccagtctgccctgactcagcctgcctccgtgtctgggtctcctggacagtcgatcaccgtctcctgcactggaacccgcagtgatgttggacttttanatgtctcgtggtaccaatacctcccaggaccaagcccccaaactcatactttagngaggcactagcgccctnagggtttcagtcgcttctctggctccgaagtctggccaacgacggcctccctgaccatcctcgtcggccctccgagccctgaccgacgaggcctagtactttatacttgctgctacgattacngacagtaatcgtagttactttggaggttccgggacggggtaactagggcgtaccgtcggtacggtccaggccctaggtcctccggtccccccgttcgggtacccaccgttccttcccggttccccctaccccg

SEQ ID NO: 6787 - DNA, 724 bp, Homo sapiens
  misc_feature: GYAE6OF01BPHFE.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccgtctcctgcacgtcggaacccnagtgagttggttaggtacttttaagtagtggtcgtcggtacgtaacctaactaccctaccgaggaccaaaccgaccccctaaaactctaattactttagaggacggactaacgtaacgccggtaccctacgtacggggtttctacggtcgtaccttcgtcgtcggtcctacgtaagtcgtacggacctaaccgaccggtaccctccgtacgaacctacttcctcgtacggtccctacgacgtccgtacggaacggtacggacgtacgtagttaactttagttacgttcgcttcgtacttacgtaattagtcgaacgtaacgtagttaggttacgtttaccgtttagggaccgggttaccggggacggggtaaacgtacgggttaccggtaacccggttaggtaaccggtccgaaccggtcccgtaaccgggtcccgtacccccggtccccggttacgtaccgttacccgttccggttccccgttaccccccg

SEQ ID NO: 6788 - DNA, 740 bp, Homo sapiens
  misc_feature: GYAE6OF01CCS8M.23.71.G05.1.454.CMB.1.raw
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
  modified_base (302)..(302): a, c, t, g, unknown or other
  misc_feature (302)..(302): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgnagtgatggtggtacttttaanatggtctcgtggtaccaatacctccagactaacgcccccaatcatacttanggaggcactacgcggcctgtagggttctagtcgtcttcgtcgtggtcctaccgaagttcagggaccaaccgtaccggtcctcccgtgacccatccttacgtcggccctccgacgtccgtaggaccgtaacgacggtccttaggtaactttaattacgtttcgaccgttcgtacctttcctaatttaagggttcgtaaccgtaagggttaacgtttaacggtttaacggtttacggtttttacgggtaacggggggttttcccgggggaacccggggggttaaaccgtaacgggggttccgtaacccgggttaccggggttaaccgggtcccgtaaaccgggtacccccgttaacggggtcccgtttaccccggtcccccccgggtttaccggttacccgttaacccgtttccccggttacccggtttcccccccccgg

SEQ ID NO: 6789 - DNA, 767 bp, Homo sapiens
  misc_feature: GYAE6OF01BPHXX.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaaccccgcagtgagttggttggggtaactttttaatagttggttcttcggttacggtaaccctaacttaccctacccgaagggaccaaaaccggacccccctaaaactctaactttaaccttttagtaggaacgggacctaaccgtaaacggccggtaccccgttacgtacggggttttactacggttccgtccgtttcctcgtcggtaccttaccgtaaagttccgtacggaccaaaccgtaccggtccccttacccgtacggaaccctacgttcccgttaccgttccggaccccttcccgaacggtccccgtacgggaaccggaccggtacggtccttaggttaacttttagtttaacgttcgtcttcgccttacgaattagtcgactaagtacgttaagttacgttacgtttgggtacgggttccggggaacggggtaccgtaacgggttccgtaaccgggttcggtacgggtacgaccggtacccggaacggtcccgtcccgtcccccgttacgtaccgtaccttccgtccgttcccccg

SEQ ID NO: 6790 - DNA, 576 bp, Homo sapiens
  misc_feature: GYAE6OF01D6NBY.23.71.G05.1.454.CMB.1.raw
  modified_base (357)..(357): a, c, t, g, unknown or other
  misc_feature (357)..(357): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggacttttaatatggtctcgtgtaccatacctccagcaaacgcccccaaactcatacttatgaggcactaagccgcctgtagggtttctagtcgcttctctggctcaagtctgcaacncgcctcctgacctatcctctcggccctccgacgcctgacgacgaggctgtattatttattgctgctctatatcgacgtagtattagttaagttacgtttggacgggttcggggaccgggggtactaagggtcgtaccggttcggtacggtacgacggtccccgaaggtcccgtaccggtccccccgttaggtaccctaccttccgttccggtccccccg

SEQ ID NO: 6791 - DNA, 813 bp, Homo sapiens
  misc_feature: GYAE6OF01D3L4W.23.71.G05.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctcgccctgactcagcctgccctcgtgtctggtctcctggacngtcgatcaccgtctcctgcacgtcggaacccgnagtgtagttggtttcggtaactttttaatagttcggttccttcggtacggtaacccaaattacccctacccgaaggaccaaaaccgacccccctaaaacttctaactttactttagtacggacggactaaccggtaacgcccggtacccttacggttacggggttttcctacggtccgtcctttctccgttcggaccttaccgaacgttccgtcggacccaaaccgtaccgtcccttacccgtacgaacccttacgttccttccggtcccggtacccttacccgacggtcccgttaacggaaccggtacccgtaacggtcttacgttaattttacgtttaacgttcgtaccttcgtaccttacgtaagttacgtcggacgttaaggttacgttaaggttttacggtttacgttttggggtaccgggggtttaccggggaaccgggggttaaacctacgggggtaccggttaaccccgggtagggttaccggtaccggaaccggtaccccggtacgggtccccgttaccccggcccccgttacggttaccctacccgtttccgttcccccggttacccccg

SEQ ID NO: 6792 - DNA, 529 bp, Homo sapiens
  misc_feature: GYAE6OF01DI777.23.71.G05.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (315)..(315): a, c, t, g, unknown or other
  misc_feature (315)..(315): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggactttttaanatggtctgtggtacaatacctccaggcaaacgccccaaatcatacttatgaggcactaagcgcctnagggtttctagtcgcttctctcggctccaagtctggcaacacggcctcctgaccatctctcgcctcacgcctgacgacgacgctgtattattattgctgctcatatgcgagatagttagtactttggagttcgggacggggtacgaggtgtaccgtcgtacgtgacggccgaacggtctcggtccccctacgtcctactccgtcgttacccccg

SEQ ID NO: 6793 - DNA, 655 bp, Homo sapiens
  misc_feature: GYAE6OF01CR87X.23.71.G05.1.454.CMB.1.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccncagtgatgtggtacttttaatatgtctcgtgtaccaatacctccgagacaaacgccccaaactcaactacttangacggacacgtaacggccggtcctagtacggggtttctagtcgtcttctcgtcgacctacgtaagtccgtggacctaaacgccggtcccctacccgtacgaccctattcctccgtcggtaccctccgacgtccgtacggaacggacgtaggtctagtatttattacgttgctgctatagttatgaactaagtattaggttagtttacgttagggtacgggttccggggacggggtaaccgtaagggtccggtaccggttacgggtacggtacgtaacggccccggtaaaggtcccgttacccggtcccccggttacggttaccctaccgttcccgttaccgttacccccc

SEQ ID NO: 6794 - DNA, 749 bp, Homo sapiens
  misc_feature: GYAE6OF01B7BUT.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcactcggaacccnagtgatgttaggtacttttaatatggtctcgtggtaaccaatcctccaggaccaaacgccccaaatcaattacttatggacggacacgtaacgcggccctgtacggggtttctaggtccgtcttctcgtcggtcctaccgtaacggttcctacgggaccaaaccgtaccggtcccttccccgtacgaaccctactccttaccgtcgtccctaccgtacgcccgtagaaccggaacggacggtccttaggttaacttttaacgtttacgtttacggtcgttaccggtacctttacgtaacttacgtacgtaacgtaacggttaacggttaacgggtttaagtttaccggttttagggttaacgggggtttccggggaaccgggggggtaacccgtaaaggggttccggtaaccgggttacggttacgggttacccgaacggtaccccggaacgggtcccgtaccccggtcccccggttaccggttacccttaccgttcccgtttcccggttaccccccg

SEQ ID NO: 6795 - DNA, 720 bp, Homo sapiens
  misc_feature: GYAE6OF01DQ36L.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatggttgggtactttaatatggtctcgtggtaccaataccctccaggaccaaacgcccccaaactctatactttatggacggcactagcggcctcgtagggtttctagtcgcttctcgtcgcctctaagtctggacaaccgaccggtccctcccgtgacctattcctcgtcggtccctccgacgtccgtcggacgacggacggtcgtcgtaatttactttagttcgtctgtcctacgtactagtacgctaaggtaatttaacggtttacggttacggttttacgggtacggggtttcccgggggaaccgggggggttaaccccgtaaaggggttcccggtaacccggggtttaccgggttaacggggttaccccgaaccggggtaacccccgaacggggtcccccttaccccggggtacccccccggtttacccggggttaccccttaaccccggtttcccgttaccccgggttttccccccccgg

SEQ ID NO: 6796 - DNA, 741 bp, Homo sapiens
  misc_feature: GYAE6OF01A8FWC.23.71.G05.1.454.CMB.1.raw
  modified_base (233)..(233): a, c, t, g, unknown or other
  misc_feature (233)..(233): n is a, c, g, or t
  modified_base (315)..(315): a, c, t, g, unknown or other
  misc_feature (315)..(315): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctcgccctgactcagcctgcctccgtgtcgtgggtctccgtggacagtcgatcaccgtctcctgcacgtggacccntagtgactggttggtactttaatatcggtctcgtggtaccaactacctccgaggacaaccgaccccaaactctattacttancggtacggctacgtacgccggtcctacggtacgggttctagtcgtcttctcgtcggtcctacgtaacgtcgtacgacaaaccgtccggtcccctccgtacgtaacctacgttccgttaccgtaccggtccctaccgaccgtacccgtaacggacccgtaacgggacgttacgttacggttaactttagtttaccgtcggttacctgtcctaacgtattacgtacgcgtaaagtagttaacgttaggtttaccgtttaggggtaccggggttaccggggtaaccgggggtaactaacggggttccggaacccggggtttacggtaccgggtacccgacccgggtaaccggtaccgggttccccgttacccgggtaccccccttacgggttacccctaccggtttcccgttccccgttaaaccccccg

SEQ ID NO: 6797 - DNA, 575 bp, Homo sapiens
  misc_feature: GYAE6OF01BJNN5.23.71.G05.1.454.CMB.1.raw
  modified_base (307)..(307): a, c, t, g, unknown or other
  misc_feature (307)..(307): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttgggtacttttaatatggtctcgtggtaccaatacctcccaggacaaacgcccccaaatcatactttangaggcacaagcgcctcgagggtttcagtcgcttctctgctccagtctggcacacggtccctcctgaccatctcgtcggcctccgagccctggaccacggaggctagaatttattacgttcgcttgcctctagttatcgactagtacgttagttagtttacgtttggacgggttaccggggacgggggtaacctagggtcgaccggttggtacggtcacggcccgaaggtcctaccggtccccgtacggtcaccgttcttccgtacccc

SEQ ID NO: 6798 - DNA, 830 bp, Homo sapiens
  misc_feature: GYAE6OF01A1YKF.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctcgcctccgtgtctgggtctcctggacagtcgatccaccgtctcctgcacgtcggaacccgcagtgagttggttacgggtaactttttaaatagttcgggttccttcgggttacggttaacctaaacttaccccgtacccgaagggaccctaaaaccggccccccctaaaaaccttcctaactttaaccttttaagtacggaacggggacctaaaccgtaacggcccgggtaccccttacgggtaacgggggttttctacggttccgtcctttccgttccgttcggccttacctaaggtcttacggacctaaccgtaccgggtccccttacccgcgtaaaccctctccgtacgtccgggtcccttacccgacgtcccgtcgaaccggaccggacggtctacggttatttacgtttacgttcggtccttacgtctcgtacttacgtcgtacgtaacgtaacgttacgtttacgttacggtttacgggtacgggggttaccgggggtaaccggggggtaacccgtaacggggttccgggtaacccggtttacggggtaaccgggttacccgaaccgggaaccccggtaaccgggttcccggtaccccggttccccccggtacggttaccctaccgttccccgtttccccggttacccccg

SEQ ID NO: 6799 - DNA, 847 bp, Homo sapiens
  misc_feature: GYAE6OF01CDM25.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagtcctgcctccgtgtcctgggtctcctggacagtcgactcaccgtctcctgcctacgtcggaacccgcagttgagtggttagggtaacttttaatatggttctacggtaggtaaccaaattacccgtccgaaggaccaaaaccgtacccccctaaaactcctaacgttacctttaagtcggaacgggtccaacgtaacgccggcccttacgtacggggtttctagtccgtctttccgtcgtcggtccttacccgaaagttccgtacggtaccgaaaccgtcccggtacccttcccccgtaagtaccctaacgttccgtccgttcgggtacccctccgtaccggcccgttacgaaccggtaccggacggtaccgttaaacgtagttttaactttaggtttacgtccgttacgtaccctttaacgtaacttaaaccgttggaaccctaaaggtaacgtttaacgggtttaacgtttaaccggtttttacggggacggggtttacccgggggtaaccggggggttaaacccgtaacggggtacccggttaacccggggttacgggtttaaccggggttacccgtaaccggtaacccccggtaacggggtaccccgttacccgggtccccccgttaccggtcccgtttaaccccgttccggtttaccccggtttacccccccg

SEQ ID NO: 6800 - DNA, 649 bp, Homo sapiens
  misc_feature: GYAE6OF01CYBYP.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatcaccgtctctgcacgtcggaacccgnagtgatggttagggtaacttttaatatggtctcgtgtaccaatacctccgaggacaacgaccccaaatcatacttatgagcactaacgccgacctcgtagggttctagtcgtctctcgtgtcctacgtagtctacggacaaccgccgtccctcctacgacctatctcgtcgccctacgacgtcctggaccgacggtagtcgtagtaacttagtttagtctcgtctacctactatagtacgtacgtaagtacgttaaggtttacgttaacggtttcgggtaacggggtttaccggggacgggggtaactaacggggtccgtaaccggttacgggtacggtaccgaaccggacccggtaacggtccgttccccggtcccccggttacggtacctaacccttcccgtcccgttaccccccg

SEQ ID NO: 6801 - DNA, 961 bp, Homo sapiens
  misc_feature: GYAE6OF01AUXDH.23.71.G05.1.454.CMB.1.raw
  modified_base (200)..(200): a, c, t, g, unknown or other
  misc_feature (200)..(200): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacactagggtcctgggcccagtctgccctgactcagcctgcctccgtgtctgggtctcctggacngtcgatcaccgtctcctgcacgtcggaacccgcaggtgagttggtttacggggtaactttttaagtagttcgggttcctacggttacgggtaaccctaaacttaaccccgtcccgaagggtacccaaaaccggtaccccccccaaaaacttaccctaactttaaacttttaacgtacgggtaacgggggtacctaaccgttaaacgggtcccgggtacccctttacgggttaacggggggtttttaccctaaggttcccggttcccttttacccgttcggtttcccggtaccgttacctaaacgggtttccgtacggggtacccctaaaaccggtaccccggggttccccctttaaccccgtacgggaaccccttaacgtttcccgtttacccggttaccggggttcccccttacccgaccggtaccccgttacgggaacccgggtaacccgggtacggtaccgttacgggttaactttaacgttttaacgtttacggttaccgttcggtacccttaccttaagtttacgttacggtaccctaaggttaacgtttaacgggtttaacggtttaccggttttaacgggtaccgggggtttacccgggggtaacggggggtaaccgtaaacgggttccgggtaaccgggtttaaccgggtcgggtacccgacgggtaacccccgtaacggggtacccttcccgggtaacccccccggttggtacccgttacccggttcccggtttaacccgggttccccccgg

SEQ ID NO: 6802 - DNA, 589 bp, Homo sapiens
  misc_feature: GYAE6OF01E2N27.23.71.G05.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (439)..(439): a, c, t, g, unknown or other
  misc_feature (439)..(439): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccgtctcctgcactggaacccgcagtgattggttggacttttaatatggtctcgtggtaccaatacctccaggcaaacgcccccaaatcatacttangaggcactaagcggcctcgagggtttctagtcgcttctctggcctcagtcnggcaacncggcctccctgaccatcctcgtcgccctccacgcctacgacgacgaaggctagtattattattcgctgtctctaatntcgctaagtataggtagtttacgtttggtacgggttcggggaccgggggtactaagggtcgacccggttacggtacggttacaccggtcccgaaggtccctacccggtcccccgttacggtccctacccgttcccgtccgtttacccccc

SEQ ID NO: 6803 - DNA, 574 bp, Homo sapiens
  misc_feature: GYAE6OF01BENLX.23.71.G05.1.454.CMB.1.raw
  modified_base (228)..(228): a, c, t, g, unknown or other
  misc_feature (228)..(228): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
  modified_base (435)..(435): a, c, t, g, unknown or other
  misc_feature (435)..(435): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttggtacttttaatatggtctcgtgtaccaatcctccagacaacgccccaaatcatacttanggaggcactagccggtcctcgtaggggtttctagtcgcttcgtctcggctcaagtctggactaacncggcctcctgacctatcctctcggccctccgacgccgtgacgacgacggctagtattattagtgctgctanatatcgacagtacgtagtagttactttagggagggttacgggaccgggggtaacaacgggtcgtaaccgggtgtacggtccgacggccccggaggtcccgtccggtcccccgtggtacctccgttccgttccgtccccc

SEQ ID NO: 6804 - DNA, 541 bp, Homo sapiens
  misc_feature: GYAE6OF01BXXYR.23.71.G05.1.454.CMB.1.raw
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (448)..(448): a, c, t, g, unknown or other
  misc_feature (448)..(448): n is a, c, g, or t
tcagacgcgagtatcacgaccggtgctcgatttagtgtcgtcgcaagagagaggggggggtcacaagaggcagcgctctcgggacgtccccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctcccaggcaaagcccccaaatcatactttangagggcactaagcggcctcagggtttcagtcgcttctctggctccaagtctggcaacgacgcctccctgaccatctctcggcctccagcctgacgacgaggctgattattatgctgctnatntgcagattagtagttactttggnggttcgggacgggggaccaagggtcgaccgtcggtaggtcaggcccgaaggcctcggcccccttggtcctacgtccttccgttcccctccccg

SEQ ID NO: 6805 - DNA, 752 bp, Homo sapiens
  misc_feature: GYAE6OF01C8QRX.23.71.G05.1.454.CMB.1.raw
  modified_base (537)..(537): a, c, t, g, unknown or other
  misc_feature (537)..(537): n is a, c, g, or t
tcagacgcgagtatcacgaccggtgctcgatttagtgtcgtcgcaagagagaggggggggtcacaagaggcagcgctctcgggacgtctccaccatggcctggctctgctgctcctcactctcctcactcaggacacagggtcctgggcccagtctgccctgactcagcctgcctccgtgtctgggtctccgtggacagtcgatccaccgtctcctgccacgtcggaacccgcagtgtattggttcgggtactttaatacgtggtctcggtaggtaacctaatacctccgaagacaaacgcccccaaatcacttactttagtcggacggacaacgtaacggccggtaccctagtacgggtttcacggtccgtctttcgctcggcctacgaagttccgtcggaacctaccgaccggtccctcccgtacgaccctattccgtccgtcggcccttacccgacggtcctacggaaccgacggtacggtaccgtaaggttactttaagtttacgttacggtcctacggtccttactaagttnttacggaactaaggtacgtttaaaggttacggtttaccgtttagggtaaccggggtttccgggggaacccggggggtaaacccgttaaaggggtccggttaaacccgggtcgggttaaccgggtaccgtaaccgggtaccccggaaacggtcccggtacccggtccccggttaaccggttcccgtaacccttcccggttcccgttaacccccccg

SEQ ID NO: 6806 - DNA, 584 bp, Homo sapiens
  misc_feature: GYAE6OF01CDO8F.23.71.G05.1.454.CMB.1.raw
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (438)..(438): a, c, t, g, unknown or other
  misc_feature (438)..(438): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgccctccgtgtctgggtctcctggacagtcgatcaccgtctcctgcactggaacccnagtnatgttgggtacttttaanatggtctcgtgtaccaatacctcccaggacaaacgcccccaaaatcatactttangaggcactaagccgtcctgagggtttctagtcgtcttcgtctggctaccaagtctggacaacgcggccttcccngacctacgtctcgtacgcctccgagccgtagacgtacgaggctagtattagttatcgntcgacttcgatagtgactagacttagttagttaacttggaaggttcgggaccggggtaacctagggtacgaccggtaggttacgacgtacggcccgaggtacccgttcgaccccccgtggtaccacgttccgtcggttaacccccc

SEQ ID NO: 6807 - DNA, 747 bp, Homo sapiens
  misc_feature: GYAE6OF01B6Q7G.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttgggtacttttaatatggtctcgtaggtaccaataccctccaggacaaacgcccccaaactcatactttatgacggcactaaggccggccctcgtagggtttctaggtcctcttcctcgtcggtcctaccaagttcctacggaccaaccgaccggtccccttacccgtcgaaccctacttccttccgtacggtccctaccgacgtcccgtaggaccgacggacggtcctagtactttacttagttcggcttgtccttacatttacgtcggaaccgtaaggttaagtttaacgggttacgttttaaccggttttggggtaacggggggttttcccggggggaaccgggggggtaacccgttaaacgggggttccgggtaacccgggtttaccgggttacgggttaccggaacccgggtacccccgtaaagggggtccccttaccccggggtcccccccggttacgggttacccgtaccccgtttcccgttccccggtttacccccccc

SEQ ID NO: 6808 - DNA, 680 bp, Homo sapiens
  misc_feature: GYAE6OF01BH3G9.23.71.G05.1.454.CMB.1.raw
  modified_base (259)..(259): a, c, t, g, unknown or other
  misc_feature (259)..(259): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcaagtgattggttaggggtaacttttaatntggttctcggtaggtaccaactaccctccgaggaccaaaacggacccccaaaactctaattaaccttttagcggaacggcctaacgtaagcccggtcccttacggtaagggtttctacggtccgtcttccttcgtcggtccttacctaaaggttccgtagggacccaaacgtcccggtccccttcccgtagaaccctaatccctcgttaccgggtacccttccgaccgtaccgttcggaaccggtaaccggcggtccttagtaactttacgttactgtactcgtctactattaaccgtgactagtacttagtaacgttcgttagggtacggttcggggacggggaactaggtcgtaccgtcgtacggtcgacgcccgaggtccctccggtccccgtgtaccgtactccgtccggttccccc

SEQ ID NO: 6809 - DNA, 656 bp, Homo sapiens
  misc_feature: GYAE6OF01D6DXX.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaaccccgnagtgatggttggacttttaatatggtctcgtgtaccaactacctccaggaccaaacgcccccaaactcattactttagtggagggctaactaacgccggcccttgtaggggtttctagtcgtcttctcgtcggctccgaagtcgtggaccaacgccggtccctcccgtgacctatccttcgtcgtccctccgacgtcctagaccggacgaggtacctagtaactttatttagttcgtcctgtccttactaatacgttgaccgtaagtaacgttaaggttaacgtttacggttttagggtacgggttccggggaccgggggtaacgtaacgggtcggtaccggtcggtacggtacgaccggtacccgaaggtcccgtacccggtcccccgttcggttaccctaccgttccgtcccgttaccccccg

SEQ ID NO: 6810 - DNA, 553 bp, Homo sapiens
  misc_feature: GYAE6OF01A990P.23.71.G05.1.454.CMB.1.raw
  modified_base (302)..(302): a, c, t, g, unknown or other
  misc_feature (302)..(302): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
  modified_base (538)..(538): a, c, t, g, unknown or other
  misc_feature (538)..(538): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggacttttaatatggtctcgtggtaccaatacctccaggcaaacgcccccaaatcatacttangaggcacgtaagccggccctcgaggggtttctagtccgtcttctcgtcggcctccgaagtctggacaaccgccggtccctccctgaccctatcctctcgcctccacgcctagacgacgnggctgtattattatgctgctnatatgctagatagtagttacttggacgggttcgggacggggacagggtcgacggtcgtcggtcacgccgaacggcctccgtcccccgtcggtaccnctccgtccgtacccc

SEQ ID NO: 6811 - DNA, 574 bp, Homo sapiens
  misc_feature: GYAE6OF01AQN6Z.23.71.G05.1.454.CMB.1.raw
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
  modified_base (439)..(439): a, c, t, g, unknown or other
  misc_feature (439)..(439): n is a, c, g, or t
  modified_base (443)..(444): a, c, t, g, unknown or other
  misc_feature (443)..(444): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaacccgnagtgatggttgggtacttttaanatggtctcgtggtaccaataccctccaggacaaacgcccccaaatcatacttangaggcacagcgcctgagggttctagtcncttctctgctccaagtctggacaacncggcctccgtgacctatctctcggtccctccgacgtcctgaccgacggaggtctagtattagttattgctagctnatannacagattagtagttactttgggacggttcgggacggggacaagggtcgacccggttaggtacggtcacggtcccgaacggtcccgtacccgtacccccgttcgtaccctcgttcccgtccgttacccccc

SEQ ID NO: 6812 - DNA, 758 bp, Homo sapiens
  misc_feature: GYAE6OF01A7H4Q.23.71.G05.1.454.CMB.1.raw
  modified_base (232)..(232): a, c, t, g, unknown or other
  misc_feature (232)..(232): n is a, c, g, or t
  modified_base (305)..(305): a, c, t, g, unknown or other
  misc_feature (305)..(305): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccgnagtgatggttgggtacttttaatatggtctcgtggtaccaatacctccagcaaacgccccaaatcatacttangacggcactagcgccctcgtaggggtttctagtcgtcttctcgtggctaccgaagttcgtggaccaaccgcggtcccctcccgtcgaccctacttcctccgtacggtcccctaccgtacggcccttacggaaccggtacggacggtaccgttagtactttaagtttaacgttcgtaccgtttggcccttagtaacttacgttacggacgtaacggttaatttaacgggttaacggttttaaccgtttttacgggggtaaccgggtttaccggggggtaccggggggggttaaaacccgtaaacggggttccgggtaaacccgggtttaccggggttaccggtaccggaaccgggtaccccggaaacggggtccccgttaccccggtcccccccgggtttaacgggttcccccgtaacccgtttccccggttccccggtttacccccccccggg

SEQ ID NO: 6813 - DNA, 759 bp, Homo sapiens
  misc_feature: GYAE6OF01DAOW6.23.71.G05.1.454.CMB.1.raw
  modified_base (118)..(118): a, c, t, g, unknown or other
  misc_feature (118)..(118): n is a, c, g, or t
  modified_base (192)..(192): a, c, t, g, unknown or other
  misc_feature (192)..(192): n is a, c, g, or t
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctnactctcctcactcaggacacagggtcctgggcccagtctgccctgactcagcctgcctcgtgtctgggtctccnggacagtcgatcaccgtctcctgccactggaacccgnagtgatgttggacttttaanatggtctcgtgtaccaataccnccaggcaaagccccaatcattacttangaggcactagcgcctgtagggttcagtccgtcttctcgtcgtctccgaagtctaggacctaacgaccggtccctcccgtagaaccctatccgttcgtcggcccttcccgaacggtcccttacggaccgaaccggtacgggtaccttaggtaactttttacgttaacgtttcggtaacccttcgggtaccctttacgtaacgttacgtttacggccgtaaaggtaacgtttaacgggtttacggttaaaccggtttttcgggtaaccggggtttaccggggaaccgggggggttaaaccctaaacgggggttccggttaaccccgggttacgggtaaccgggtttacccggaaccgggtacccccggtaaacggggtcccccttaccccgggttacccccccccggttagggtttaccccctaacccggttccccggtttacccggtttccccccccccggg

SEQ ID NO: 6814 - DNA, 782 bp, Homo sapiens
  misc_feature: GYAE6OF01DRAKS.23.71.G05.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtcctgccctgactcagcctgcctccgtgtctggtctcctggacagtcgatcaccgtctcctgcacgtggaacccgnagtgatggttggtactttaatagtggtctcgttagtaacctaatacctccaggaccaaacgaccccaaatctatactttagtgacgggctacgtaacggccgtccttacggtagggtttctacgtccgtacgttcctcgtcgtcctaccgtaagttccgtacggtaccaaccgtacccggtcccttacccctaggtaccctagtccttacgtccgggtaccctccctacgcccgttacggaccgaccggtacgtaccgttaggttaactttagtttacgttcgtaccgtggtaccttagtaacttagtacgtaaccgtaaggtaagtttaacggttaacgttttacggttacggggttaacggggtttacccggggggtaaccgggggtaaacccgttaacggggtaccggttaacccgggttaccgggttaaaccgggtaccggtaaaccggacccccgggttaaacgggtccccgttaccccgggttacccccccgttacgggttaccccgtttaaccccgtttccgttaacccccgggtttaccccccc

SEQ ID NO: 6815 - DNA, 650 bp, Homo sapiens
  misc_feature: GYAE6OF01AB543.23.71.G05.1.454.CMB.1.raw
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatccaccgtctcctgccactcggaacccnagtgagttggttggtacttttaatagtggtctcgtggtaccaataccctccgagccaaacgcccccaaatcattacttagngaggcacgtagccgtcctgtagggttctagtctcttctcgtgcctcagtcnggacaacgccgcctcccgtagacctattcctcgtcggtccctcgacgtccgtaggaccgtacgaggtcttagtaactttacgttacgttcgccttacggcctacgtaattacgtggaacctaagtagttacggttaacgtttacgtttagggacggggtttaccggggaccgggggtaactacggggttccgtaccgggttcggtacggtaccgaccggtcccgaacgggtcccgtaccccggtcccccgttaggtacccctacgttcccgttaccgttacccccccg

SEQ ID NO: 6816 - DNA, 711 bp, Homo sapiens
  misc_feature: GYAE6OF01AHPQI.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnagtgattggttgggtaactttttaagtagttggttccttcggtacggtaacccaacttaccctcccgaacggtaccaaaccgaccccccaaaacttcctaatttactttagaggacgggactaaccgtaacggcccggtcccgtacggtacggggttttactacggttccgtacttctcgtcggtccttacccgtaagtccgtacggaccaaccgtaccggtccctcccgtagaccctattcctccgtcggccctaccgacgtcccgtaggaccgtacggacggtcctagtaacttattagttcgcttcgtctcgtatacgtcgtacgtaatagtacggttacgttacgtttagggtacggggttacggggacggggtaacctagggtcgtacccgggtacggtacggtaccgaccggtacccgacggtcccgtacccggtcccccgtacggtaccctaccgttccgttcccggtccccc

SEQ ID NO: 6817 - DNA, 637 bp, Homo sapiens
  misc_feature: GYAE6OF01A49OB.23.71.G05.1.454.CMB.1.raw
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactcggaacccgnagtgattgttggtacttttaanatggtctcgtggtaccaatacctccaggacaaacgcccccaaactcattacttangaggacactaagcgcctcgaggggtttcagtcgtcttctcgtggctccaagtctggcaacgacgccctccctgaacctatcctcgtcggccctccgacgcctcgacggacgacggctaggtaattatttagttcgtcgtcgccttactatagtcgacctagtacgttaagttacgtttactttgggaacgggttccggggacgggggtaacctaagggttccggtaccgggtacggttacgggtcccgaacgggtaccccgtaagggtccctcccgggtcccccccgtttagggtacccctacccgttcccggttcccgttacccccccgg

SEQ ID NO: 6818 - DNA, 677 bp, Homo sapiens
  misc_feature: GYAE6OF01DHZB9.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtggaacccgnagtgatggttaggtacttttaatatggtctcgtagtaccaatacctccaggacaaacgacccccaaactcaattactttatggaggcaacgtaagcggcctcgtagggtttctagtcgcttctctggctccgaagtcgtagacaacgaccggccctcccgtagacccattcctcgtcggccctaccgacgtccgtgaaccgacgacggtcttaggtaactttaagttatttcgctagtccttactaacttagtacgactaaggtaattaaggttacgttacggttttacggacggggtttacggggaccggggggtaaaccgtaaggggtacgtacccgggttacgggtaacgggtaccgtaacggtaccccgtaaagggtccccttacccgggtaccccccgttacgggtacccttaacccggttcccgttcccggttaaccccccg

SEQ ID NO: 6819 - DNA, 791 bp, Homo sapiens
  misc_feature: GYAE6OF01BB3VW.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaaccccgcagtgattggttggggtaactttttaatagttggtcctcggtacggtaccaattaccctcccaggaccaaacgcccccaaaactctaattactttatggacggcactaaggccggccctcgaggggtttctagtcgtcttctcgtgctcaagtctggacaacgccggtccctacccgtcgaaccctattcctcgtccgggtcccttacccgacgtcccgtaggacggtaaccggtacggtccgttaagtaacttttacgtttaacgttcggtacccgtttcggaccttacctaagttacgtcgtacccgtaaaggttaacgtttaaggggtttaacggtttttaaccgtttacggggttaacggggggtttcccggggggaccgggggggtaaaccccgtaaaggggttccgggttaaacccggggttccggtttaaccggggtaacccgtacccggggtaaccccccgtaaagggggtacccccgttcccgggtaccccccccggtttacggggttaccccttaacccggtttcccgttcccccgggtttacccccccg

SEQ ID NO: 6820 - DNA, 707 bp, Homo sapiens
  misc_feature: GYAE6OF01CDS6J.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggacagtcgatcaccgtctcctgcacgtcggaacccgcagtgagttggttggtacttttaatagtggtctcggtggtaaccaacttaccctaccgaggaccaaaccgacccccctaaaactctaactttacctttaagtcggacggacctaacgtaacggcccggtaccctacggttacggggtttctacggttccgtccgtttctccgtcggtcctaccgaagttccgtacggaccgaaaccgccggtccctacccgtacgaacctacgttccttccgtccggtcccttcccgacggtccctaacggaccggacgtacggtccttagtaatttacgttattcgtactcgtacttactattcgtagactagtagtagtttacgttacgttaggtacgggttcgggacggggtaccgtaggtcggtaccggtacggtacggtacaccggtccgaaccggtcccgtcccggtcccccgtacggtacccttccttccgttcccgttaccccccg

SEQ ID NO: 6821 - DNA, 555 bp, Homo sapiens
  misc_feature: GYAE6OF01AYOON.23.71.G05.1.454.CMB.1.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaanatggtctcgtggtaccaataccctcccaggcaaacgcccccaaatcatactttangaggcactaagcggccctcgaggggtttcagtcgcttctctggctccaagtctggcaacncggcctcccngacccatctctcggccctccagcctgaccgacgaggctgtattattattgctgctnatangcagattagtatacgtttggagggttcgggacgggggtacagggtcgaccggtggtacggtcacggcccgaaggccttccgccccccgttacggtaccaccgttccgtccgttaccccccg

SEQ ID NO: 6822 - DNA, 768 bp, Homo sapiens
  misc_feature: GYAE6OF01CWXVR.23.71.G05.1.454.CMB.1.raw
  modified_base (234)..(234): a, c, t, g, unknown or other
  misc_feature (234)..(234): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgatccaccgtctcctgccacgtcggaacccgnagtgagttggttaggtaacttttaatagttggtcttcggtcggtaaccaacttaccctccgaggacaaaccgacccccaaactctaatttactttagtaggagggacctaacgtaacggccggtacccgttacgtacggggtttactacggtccgttctttcgttccgtcggtaccttacccgtaagttccgtacggaacctaaacccgaccgggtccccttacccgtacgaacccctacttccgttccgtaccgggtcccctaccgtaccggtcccgtacgggaacccgaccggtacggtaccgttaggttaacttttaacgtttacgttcgtccgttcgtaccgttactaagttacgtacgtacgtaggtaagttacggttagttacggtttcgggtacggggttaccgggggacgggggtaacgtacgggtaccggtaccggttcggtacggtacccgacggcccggtaacggtcccgtacccggtcccccgttacggtaccctaccgttcccgttccccgttaccccccg

SEQ ID NO: 6823 - DNA, 680 bp, Homo sapiens
  misc_feature: GYAE6OF01A8TWE.23.71.G05.1.454.CMB.1.raw
  modified_base (231)..(231): a, c, t, g, unknown or other
  misc_feature (231)..(231): n is a, c, g, or t
  modified_base (318)..(318): a, c, t, g, unknown or other
  misc_feature (318)..(318): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccgaccgtctcctgcactcggaacccnagtgagttggttgggtaacttttaatagtggtctcggtacggtaaccaactacctccaggaccaaacgcccccaaatcaatacttanggacggacacgtaacggccggcctgtacgggtttctacgtcgtcttctcgtacggctaccaagtctgacaacgacggccctccgtagaccatcgtctcggtccctcacgtcctacgacggtaacgacggtctaggtattacgttacttggacctgtcctataatacgtcgaactagtaacgttaagttacgttaaccggtttaggtaccgggggttacggggtaccgggggtaacctaaggggttccggtaaaccggttcgggtacggttaccgaaaccggtaccccggtaacgggtcccgttacccggtaccccccggtttcggtaaccccttaccgtttcccgttccccgttaccccccg

SEQ ID NO: 6824 - DNA, 692 bp, Homo sapiens
  misc_feature: GYAE6OF01B2F6G.23.71.G05.1.454.CMB.1.raw
  modified_base (302)..(302): a, c, t, g, unknown or other
  misc_feature (302)..(302): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgattgttggtacttttatatggtctcgtggtaccaactacctccagacaacgccccaactcatacttangaggacacgtaacgcgtcctagtagggttctagtccgtcttctcgtgcctacgaacgtctacggacaacgacgtcccttccctacgaacctacgttcctcgtcggtccctccgacgtccgtacgaccggacggacggtcttacgtaacttttacttagttcgtcgtacgtcctactacttacgtacgccgtaagtacgtttaacggtttaacgtttacggtttagggtaccgggggtttaccgggggaaccggggggtaacccgtaagggttcccggtaaccggggttcgggttaacgggtacccgaaccggtaccccggtaacgggtcccgttaccccggtcccccgttacggttaccctcccgtttcccgttcccggttaaccccccc

SEQ ID NO: 6825 - DNA, 645 bp, Homo sapiens
  misc_feature: GYAE6OF01D6CRX.23.71.G05.1.454.CMB.1.raw
  modified_base (230)..(230): a, c, t, g, unknown or other
  misc_feature (230)..(230): n is a, c, g, or t
  modified_base (473)..(473): a, c, t, g, unknown or other
  misc_feature (473)..(473): n is a, c, g, or t
  modified_base (489)..(489): a, c, t, g, unknown or other
  misc_feature (489)..(489): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggtacttttaatagtggtctcgtggtacctaataccctccaggacaaacgcccccaaatcatacttatgacggcacgtaagccggccctcgtaggggtttctacggtcgtcttcctcgtcggcctaccgaagtccgtacggaccaaccgaccggccctccgagtaccgaacctactcctccgtcggcccttaccgacgtccgtaggaccgacggacggtctagtatttacttntcgtctcgctacaatntcgactagtattacgttaagttacgttagggtacgggttaccggggaccgggggtaacgtaacgggtcggtaaccggtcggtacgggtaccaccggaccccgaagggtcccgtacccggtccccccgttagggtccctccgttcccggttccccgg

SEQ ID NO: 6826 - DNA, 656 bp, Homo sapiens
  misc_feature: GYAE6OF01B629T.23.71.G05.1.454.CMB.1.raw
  modified_base (302)..(302): a, c, t, g, unknown or other
  misc_feature (302)..(302): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttgggtacttttaatatggtctcgtggtaccatacctccaggcaacgccccaactcatacttangaggacactaagccgcctgtagggtttctagtcgtcttctcgtggtcctaccgtaagtccgtggacctaaaccgaccggtcccctaccctcggaaccctagttcccttcgtacggtccctccacgccgtacgaccggacgtacggtcctaggtaactttatttacgttcgaccgtgtccttactattaacgtcgacgtaggtaactagggtttagttacgtttagaccggggtttcgggaaccgggggtaccgtaagggtcgtaacccggttggtaacgggtcgaaccggcccgtaacggtccctccggtccccccggttcggttacccaccgttccgttccccgttacccccg

SEQ ID NO: 6827 - DNA, 777 bp, Homo sapiens
  misc_feature: GYAE6OF01CI0H8.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtccctgggcccagtctgccctgactcagcctgcctccgtgtctgggtctcctggacagtcgatcaccgtctcctgccacgtcggaacccgcaggtgagttgttgggtaactttttaatagttggtctcggtacgtaacctaaacgttaccctcccgaaggacctaaaccgacccccctaaactacctaactttaaccttttagtcggaacgggtacctaaccgtaacggcccggtaccccgttacggttaacggggtttccttacggtcgtacctttcgttccgtcggtaccctacctaaaggtcgtacggacctaaaccgacccggtccctacccgtacgtacctacttcctcgtccggtccctaccgcgtaccgtcggaaccgtacggaggtctagttaactttaacttcgttagtccgtactccgttataacgttacgtacgtacgtaaggttacttaaacgggttacgttttaacggtttcgggtaaccggggggtttccgggggaaccgggggtaacgttaacgggtaccggtaccgggttacggtaccgggtacgtaccggtacccgacggtcccgttccccgtaccccgttacggtaccctaccgttcccggttccggtcccccccg

SEQ ID NO: 6828 - DNA, 695 bp, Homo sapiens
  misc_feature: GYAE6OF01AIKID.23.71.G05.1.454.CMB.1.raw
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (532)..(532): a, c, t, g, unknown or other
  misc_feature (532)..(532): n is a, c, g, or t
  modified_base (545)..(545): a, c, t, g, unknown or other
  misc_feature (545)..(545): n is a, c, g, or t
  modified_base (622)..(622): a, c, t, g, unknown or other
  misc_feature (622)..(622): n is a, c, g, or t
  modified_base (635)..(635): a, c, t, g, unknown or other
  misc_feature (635)..(635): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctcgggtctcctggactagtcgactcaccgtcctcctgccacgtcggaacccgnagtgagtggttggtacttttaanagtggtctcgtcgtaacctactcctccagaaccaaccgaccccctaaactctaattacttagtcggacggtaccaacgtaacggcccggtcccttacggtacgggtttactacggtccgtacttccgtcgtaccgtctacccgtagtcgtacggacctaaaccgtcccggtcccttaccccgtacgtaccctacttccgtccgtcgaccctccgacggtcctacggtaaccgacggtagtacttgtaattacgttcgtcgcgtacgctactntagtcgataagtnttaacggttgttacggtttaggacggggttccgggaaggggtaccgagggttaccgggaccgttacggtcggtaccncggtaaccccggntaccccggttccccgtacccggttacggtacctaacccggtttcgtcccggttccccccg

SEQ ID NO: 6829 - DNA, 826 bp, Homo sapiens
  misc_feature: GYAE6OF01AXHIK.23.71.G05.1.454.CMB.1.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
tcagacgcgagtatcacgaccggtgctcgatttagtgtcgtcgcaagagagagggggggggtcacaagaggcagcgctcgtcgggacgtctccaccatggcctgggctctgctgctcctcactctcctcactcaggacacgacgggtcctcgggcccagtctcgccctgactcagcctgcctcgtgtcgtcggtctccgtgacngtcgatcaccgtctccgtgcacgtacggaacccncagtgattggttaggtaacttttaagtagtcggttctacggtacggtaaccaaacttaccctaccgaggaccaaaccgcccccctaaatactaattaaccgtttagacggaacgggtacctaacgtaaccggtcccggtacccgttacgggttacggggttttactacggttccggttacctttaccgttccggtacggtaccttaacccgtaaaggttcctacgggaaccctaaaccgtccggtacccctcccgtacgtaaaccctcgttacccgttccggtaccggacccgttacccgaccggtacccgttacgaaccgggtaaccggttaacggtaccgtttaaggtttaaacgttttaactttacggtttcggtaccgtttcggtaccttaacgtaactttaggtacgaccgtaaagttacgtttaaggtttaacgttcgtttaggggacggggttacggggaccgggtaacggtagggtccggtacggttacggtacggtacgaaccggtacccgtaacgggtcccgttccccggtaaccccgttcggtaaccgtcccgttccggttccccggtttacccccg

SEQ ID NO: 6830 - DNA, 879 bp, Homo sapiens
  misc_feature: GYAE6OF01BMUPR.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctgccctgactcagcctgcctccgtgtctgggtctcgtggacagtcgatcaccgtctcctgaccacgtacggaacccgctaggtgtagttggtttacgggttaactttttaagtagttcggttccttcggttacggtaaccctaaacttacccgtacccgaacggacctaaaacccgaccccctaaaactctaactttactttagtacggtacgggtacctaacgtaacggccggtaccccgttacggtacggggttttcctaacggttccgtctttccgtcgtcggtaccttaccgtaacgttcgtacggtaccgaacccgtaccgggtcccttacccgtacgtaccctacgttcccgtacgttccggtaccccttaccgaaccgtcccggtaacgggtaacccggtaccggtacggtacgttaacggttaacttttacgtttacgttcggtaccgttcgtacccgttactaaggttacgttacgtaccggtaaagtttacggtttaaaggtttaacggttttaacgggttagggttaaccgggggttccgggggtaacccggggggttaaccgtaacggggttacccgggtacccgggttaacggtaccgggttaacccgaccgggtaaaccccgtacgggtaaccccggtttcccccggtacccccgggtttacggttaccccgtaacccgtttcccggttcccccgggttaaccccccg

SEQ ID NO: 6831 - DNA, 610 bp, Homo sapiens
  misc_feature: GYAE6OF01D59QU.23.71.G05.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaaccccncagtgattggtttggtaactttttaatattggtctcgtggtaccaataccctccaggcaaacgcccccaaatcatacttatgaggcactagcgcctgagggtttctagtcgtcttctcgtggtcctacctaagtcgtggaccaaaccgccggccctccctagaccctatcctcgtcgccctccacgcctgacgacgagctgatttattattgctgctactatatcgactaagtactaggttaacgtttcgtttagggtacggggttccggggacgggggtaacctaagggttccggtaaccggttcggtacgggtccacggtacccgaacggtccgtccccggtccccgtcggtacctccgttcctcccggttacccccc

SEQ ID NO: 6832 - DNA, 957 bp, Homo sapiens
  misc_feature: GYAE6OF01EITNY.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcgggaaccccgcagtgagttggtttacggggtaactttttaaagtattggttccttcggttacggtaccctaaacttaccccttcccgaacggaccaaaaccgaccccccaaaacttcctaatttaaccgttttaacgtgggaacggggacctaacgttaaacggtcccggtccccgttacggtaacggggttttaccgtaacggttccgtccttttccgtccgtacggtccttacccgtaaggttccgtacgggacccaaaccgtaacccgggtccccttacccccgtacgtaaacccctactttcccgttaccgttccggtccccttacccgaccggtacccgttacggaaacccgggtaccggaacgggtcttaacggttaattttaacgtttagtttccggtaccgtttacggtcccttaacgtaacgttacgttacgggaaccttaaagggttaaacgttaacggttttaaacgttttaccggtttttacggggtaaaccgggggggttttacccggggggtaacccggggggggtaaacccggttaaagggggtttaccccgggaaaccccggggttttacgggttaaccgggggttaccccgaaacggggtacccccccgggtaaacggggttcccccggttaaccccggttaccccccccgggttaacccgggtttaaccccgttaccccggtttccccggttaccccccggtttaacccccccccgg

SEQ ID NO: 6833 - DNA, 644 bp, Homo sapiens
  misc_feature: GYAE6OF01EDKGB.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggacttttaatatggtctcgtggtaccaatacctccaggcaaacgcccccaaactcatacttatggaggcactaagcggccctacgaggggtttctaggtcgtcttctcgtggccttccgtaaagtcgtggaccaaacgacccggtccctcccgtgacccacttcctcgtcggccctccacggtccctaggaccgacggaggcttagtaatttatttagttcgcttcgtcttctaattagtgactaagtaagttacggttaagtttacgttttgggacgggtttccggggacggggggtaacctaagggttccgaccgggttcggtacgggtccgacggacccgtaacgggccttacccggtccccccgtggtacccctacgttcccgttcccggttccccccg

SEQ ID NO: 6834 - DNA, 873 bp, Homo sapiens
  misc_feature: GYAE6OF01ES5U2.23.71.G05.1.454.CMB.1.raw
  modified_base (259)..(259): a, c, t, g, unknown or other
  misc_feature (259)..(259): n is a, c, g, or t
tcagacgcgagtatcacgaccggtgctcgatttagtgtcgtcgcaagagagaggggggggggtcacaagaggcagcgctctcgggacgtctccaccatggcctgggctctgctgcctcctcactctcctcactcaggacacgagggtcctcgggcccagtcctcgccctgactcacgcctcgcctcgtgtcgtcgggtcctccgtggactaggtcgactccgtaccgttcctccgtgacctacggtaccggaaccccgntaaggttggtaggtttagggtttacgggttaaccttttttaaagtcggttcggttaccgttacggttaccggtaaaccctaaaccttaccccgtaccgaacggaacccgaaaacccgtacccccctaaaacttcctaaagtttaccgtttaggacgggaacggacctaaaccgtaaccgggtcccggtaccgttagggtttacggggttttacgtaccgttccgtcctttccgtacgtcggtaccttaccggtaacgtcgtacggacctaaccggcccggtccctacccgtacgacctacttccgtccgtccggtccctaccgtacggtcccgtacgtaccgggtaacggacgttcttaacgtttaactacgttttaacgtcctccgtttaccgtactttaacgtacgttagtacggtaagtaacgttagttacggttaacggttttagggttacggggtacggggttacccggggggacgggttaacggaccgggtttaccggaccggtttaccgggccgttaaccgggaacccggtcccggacggttcccccgtaccccggggtacccctttacgtaccgttaccccggtttcctaaccccccggttacccc

SEQ ID NO: 6835 - DNA, 773 bp, Homo sapiens
  misc_feature: GYAE6OF01DO1TW.23.71.G05.1.454.CMB.1.raw
  modified_base (241)..(241): a, c, t, g, unknown or other
  misc_feature (241)..(241): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactcagcctgccctccgtgtcgttcgggtcctccgtggacagtcgatccaccgtctcctcgcacgtcggaacccgnagtgtagttggttaggttacttttaatagtggttcctacggtacgtaacctaactaccccgtaccgaaggaccaaaacccgacccccctaaactcttaactttactttagtacggaacggtacctaaccggtaacggtcccggtcccgttacggttaaggggtttcctacggtccgttactttcgtacgtcggtcctacgtaagtcgtacggacctaaaccgtccggtccctacccgtacgaaccctacttccgtaccgtccggtcccctacgtacggaccgtacgaccggacggtacgtacgttagttaaatttagttcttcggtctacgtactactatacgtacgacttaaggtctttaagggttacgtttacggttacgggtaccgggggttacgggaccggggtaaacgttacgggtccggttaccggttaccgggtacggtacccgaaccggccgtaccgggtacccgtttccccgggtaccccttacgggtaccctttcccggtccccgtttcccgttaccccccg

SEQ ID NO: 6836 - DNA, 833 bp, Homo sapiens
  misc_feature: GYAE6OF01ABZOS.23.71.G05.1.454.CMB.1.raw
  modified_base (190)..(190): a, c, t, g, unknown or other
  misc_feature (190)..(190): n is a, c, g, or t
  modified_base (285)..(285): a, c, t, g, unknown or other
  misc_feature (285)..(285): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctccctcactcgaggacacgtagggtcctgggccctaggtcctcgccctagactcgagtcctgcctcgtntcgtggtcctccgtaggactacgtcgactccgtacctctactcggactacgtcggaacccgcgtagtcgtattcgggttacggtaactttttagngttacggtcttacggtacggtacctaacgttaccccgttcgaacggaccaaaaccccgtaccccctaaaagttccgtaatttaaccgtttagcggtaacggacctaaccggttacgcccggtccgtacggttacgggtttacctacggtccgtacttaccgtcggtacggtccctacgtaacgttccgcggtaaaccgtaccgtccggtacccttacccgtaggaaccctagttcccgtttccggaccgggtcccttacccggaacggtttccgtaaccggtaccggtaaccggtaacgtacgtttaacgttaacggtttacgtttacgttacggacccttacgtaaccttacgtaacgtgttaccgacgttaagtacgttaccgggttagttaacggtttacgggaccgggttacggggaccgggttaaccgtacgggtaccccggtaacggttccgtaaacgggtaccgtaccgggtaccgtaacccggtccgttacccggttcccgttggaaaccctttccggttcccgtaacccgtttcccccg

SEQ ID NO: 6837 - DNA, 1054 bp, Homo sapiens
  misc_feature: GYAE6OF01D2LDR.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgattggttaggggtactttttaagtattggttaccgttcggttacggtaaccctaaacttacccgtcccgagggaccaaaaccggcccccccaaaacttacctaaactttaacctttttaagtacgggaaggggtacctaaccgtaaacggcccgggtccccttaccggttaaggggggtttttaccctaacggtttccgggtccttttaccgttccgttcgggtacccgttacccgtaaacgttccgtacggggtaccaaacccgtacccgggtccccttccccgtacggtaacccctacgttccttccgtccggggtccccttacccgaccggtccccgttagggaaccccgggtaacccgggaacgggtccgtttaagttaaccgtttttaacgttttaacttttccggtacccgtttacgtaccccgtttaactaaacgttttaaccgttacgggtaacccgttaaagggtttaaacgtttaaacggggtttttaaaccgttttaacccgggtttttttaacggggggttaacccggggggtttttacccggggggggggaaacccggggggggggttaaacccccgttaaaaacggggggttttccccggggttaaaccccgggggtttaccccggggttttaaacccgggggttaccccgtaaaacccgggggttaacccccccggaaaacgggggtttccccccgttaaccccccgggggttccccccccccggttttaacccggggggtttacccccttaacccccggttttccccgtttaaccccccggggtttttaaaccccccccccccg

SEQ ID NO: 6838 - DNA, 846 bp, Homo sapiens
  misc_feature: GYAE6OF01ERQXF.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccgtctcctgcactcggacccncagtgattggtaggtaacttttaagtagtcggttctcggtaggtaacctaacttaccctaccgaggaaccaaacccggcccccctaaaaaccttcgtaactttaacgttttacgagggtacgggacctaaaccgttaaccggcccggtaccctttagggttacggggttttactaccggttccgttcctttccgttccttcgggtacccttaccgtaacggttcgtcgggaaacccgtaacctacccgggtcccttaccccgtacggtaccctacgttccgtcggttcccggccctacccggtaccgtccgtacggtaaccggacggtacggcttacggttactttaacgtttacgtcgtaccggtttcgtccttacgtaacctagtacggtaaccgtaaggtacggtttaaacgtttacgggttttacggttttacgggaacgggggttttccgggggaacccggggggtaaacgtaccgggttaaccccgggtacgggtttaacccggacgggtttaccgaacccggtacccggggaaaccgttcccggttaaccccgggtcccccggttacgggttacccctacggttcccccgttccggttacccccccgg

SEQ ID NO: 6839 - DNA, 672 bp, Homo sapiens
  misc_feature: GYAE6OF01CCSWI.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccgttctcctgccacgtcggaacccgcgagtgatggttggtaactttaatatggtctcgtacggtacctaactcctaccgaggacaaaccgccccctaaactctacttacttagtagacggactaacgtaacgccgtcccgtagtacggggtttactacgtccgtccttcgtcgtggtacctaccgtagtccgtcggacctaaccgccgtccctccgtacgtacctacttcgtccgtcgggtccctaccgacgtccgtacgtaccgacggtacggtctagtactttagttagttacgtcttacgtcctactacgttagtcgacgtaacgtaacgttaggttaccgttagttacgggtacggggtaccgggtcggggtaaccgtaggtccggtaccggtcgtacggacaccggtaccggacgtcccgtacgtccccggtcgtaccgtctccgttcccgtaccccg

SEQ ID NO: 6840 - DNA, 880 bp, Homo sapiens
  misc_feature: GYAE6OF01CHCUK.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgactccaccgtctcctgcacgtcggaacccgcagtgtagttggttacgggttaactttttaaatagttcgggttcttaccggttacggtaaccctaaaccgttaccccgttcccgaacgggacccaaaaaccggccccccctaaaaacttcctaaacgtttaaccctttttaaggtcggaacggggtacctaaccgtaaacggcccgggtccccttaggttaacggggtttctaacggttccgtcctttcgtccgtcgggtacccttaccgtaaacggttcgtacggaccgtaaaccgacccggtacccctccccgtacgtaacccgacttcctcgttccggcccttacccgacgtacccgtacggtaaccggtacgacggttccgttaagtaacttttaagtttagttacgtaccgtcgtccgttaactattacgtacgtacgtaagtaagtttaaccggtttacggtttacgtttacggggtacgggggtttaccggggaccggggggtaaacctaacgggggttccggtaaccccgggttacgggttaccgggttacccgaacccgggttaacccccgggtacggggacccccgtttaccccgggtaccccccccggtttacgggttaccccgttaacccggtttccccgttccccgggtttaacccccccccc

SEQ ID NO: 6841 - DNA, 649 bp, Homo sapiens
  misc_feature: GYAE6OF01EKPCD.23.71.G05.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (353)..(353): a, c, t, g, unknown or other
  misc_feature (353)..(353): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcgatcaccgtctcctgcactggaaccccgnagtgattggttggtacttttaatagtggttctcgtcggtaccaactaccctcccgagacaaaccgacccccaaactcatactttatggaggactactaggccgtcctacgtagggtttctagnttcgcttgtctcgagtccaggtctaggcgacnccggctacccagtccatcgccttcgctccngcctgacgactaggcttagtattgtacttgccttgcttactagtacttagactagtaagttaacgtttaggttacgttttcgggacgggggttaccggtaacggggggtaccgaaaccggggttacgggtaaccggggttccgtaacgggttcccgaacgggtccccgtaaacgggtcccccgttccgggttaccccctacccgggtttcccgttcccgttccccgttaccccg

SEQ ID NO: 6842 - DNA, 957 bp, Homo sapiens
  misc_feature: GYAE6OF01ACC83.23.71.G05.1.454.CMB.1.raw
tcagacgcgagtatcacgaccggtgctcgatttagtgtcgtcgcaagagagagggggggtcacaagaggcagcgctctcgggacgtctccaccatggcctggctctgctgctcctcactctcctcactcaggacacgagggtcctgggcccagtctgccctgactcagcctgcctccgtgtctgggtctcctggacagtcgatcaccgtctcctgcactcggaacccgcagtcgagttcggttacggtaacttttaagtagttcggtcttccggtacggtaaccctaaacgttaccccttacccgaacggtacctaaaaaccggtaccccccctaaaaacgttccctaaacgtttaacctttttaacgacgggaaaccggggtacctaaaccggttaaaccggcccggtacccccgttacggtaacggggggtttttaccttaacggttcccggtaccgttttccgttccggttacgggtaccccgttaccgtaaagggttcccgtacggggaaccctaaacccggtaaccggtccccttacccgtacgtaaccctaacgttcccgttccgtaccgggtaccccttacccgaacgggtccccgttaacgggaaacccggtaacccgggtaacgggttcccgtttaagttaaacgttttaaccgttttaacgtttccgggccttttagggaccctttaacgtaaacgtttacgtaccggtaaccgtaaaggttaacgttaaacggtttaacgggtttaccgttttacggggtaaccgggggtttacccgggggaacggggggttaaccctaaggggtttcccggaaacccgggtttacggggtacggtaccggaaacccgggtaccccgtaaacggggtcccccgttaccccgggtaacccccccggttacggttacccttaaccccgttttccgggttcccccggtttacccccccg

SEQ ID NO: 6843 - DNA, 614 bp, Homo sapiens
  misc_feature: GYAE6OF01CKSFL.23.71.G05.1.454.CMB.1.raw
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggtacttttaatatggtctcgtgtaccaatacctccaggaccaacgccccaaactctactacttangacggcaactaacgccggcctcgtaggggtttctagtcgtcttctcgtcggctccgtaagtcgtggacctaacgaccggccctcccgtacgacctatcctcgtcggtccctccgacgccgtagaccgacggtacggtctacgtaattacttagttcgctgcctacatctgacagtacgtagttacgttacgttcgggtacggtacgggacggggtactagggtacgtacggttcggtacggtcaccggtccgaacgggtcctacccggtccccgttacggtacctacccgttccgtccgttacccccg

SEQ ID NO: 6844 - DNA, 709 bp, Homo sapiens
  misc_feature: GYAE6OF01DIKKW.23.71.G05.1.454.CMB.1.raw
  modified_base (230)..(230): a, c, t, g, unknown or other
  misc_feature (230)..(230): n is a, c, g, or t
  modified_base (313)..(313): a, c, t, g, unknown or other
  misc_feature (313)..(313): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggcacagggtcctgggcccagtctgccctgactcagcctgcctccgtgtctgggtctcctggacagtcgatccaccgtctcctgcactcggaacccnagtgatggttggtactttaatagtggtctcgtgtaaccaactacctccgaggaccaaacgaccccaactctagttactttagngtaggctacgtacgccggcctacgtagggttctagtcgtcttctcgtggctctaagtctcggacaaccgcggtccctccgtacgacctactcctcgtcgcctccgacgtccgtagaccggacgtacgtaccgttagtaacttttacgttacgtttcggtactcgtacttaccgtaattacgtacgtacgtaacgttaacgttaaggtttacgttaacggttttcgggacgggggtttccgggggaccggggtaaaccggtaacgggttccgggtacccggttacgggttaacgggtaccctaaccgggtccccggaaacgggtcccggttaccccggtccccccggttacgggttacccgtttaaccgttccccgggtttaccccttccccccggg

SEQ ID NO: 6845 - DNA, 648 bp, Homo sapiens
  misc_feature: GYAE6OF01AM9EX.23.71.G05.1.454.CMB.1.raw
  modified_base (304)..(304): a, c, t, g, unknown or other
  misc_feature (304)..(304): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggactttttaatatggtctcgtggtacctaatacctccaggcaaacgcccccaaatcatacttangaggcactaacgcgccctgagggtttctagtcgcttctctgctcaagtctgacaacgacgcctccctgacccatctactcggccctccagcctgaccggtacggaggtctgtaattattacgttgacctgtaccctactaacttagtcgtaccaggtaacgttaacggttacgttaacgttttggggtacgggtttccgggaaccgggggggtaacctaaggggttcggtaacccgggttacgggtaacgggttacccgaacgggtcccccaaaggggtcccgttacccgggtcccccccgttacgggttacccctaccttccccggtccggttaacccccccg

SEQ ID NO: 6846 - DNA, 734 bp, Homo sapiens
  misc_feature: GYAE6OF01B2600.23.71.G05.1.454.CMB.1.raw
  modified_base (233)..(233): a, c, t, g, unknown or other
  misc_feature (233)..(233): n is a, c, g, or t
  modified_base (543)..(543): a, c, t, g, unknown or other
  misc_feature (543)..(543): n is a, c, g, or t
tcagacgcgagtatcacgaccggtgctcgatttagtgtcgtcgcaagagagagggggggggtcacaagaggcagcgctctcgggacgtctccaccatggcctggctctgctgctcctcactctcctcactcaggacacagggtcctgggcccagtctcgccctgactcagcctgccctcgtgtctggtctcctggacagtcgatccgaccgtctcctgcacgtcggaacccgngagtgtagttggttagggttaacttttaagtagttcggttccttacggtacggtaaccaaactacctaccgaacggaccaaaaccgaccccccaaatcaactttacttagtcggacggtaccaacgtaacgccggtaccctagtacggggtttactacgtcgtcctttctcgtcggtcctacgtaacgtcgtacgaccaaaccgtccggtccctacccgtacgaaccgtcttccgtaccgtcgccctaccgacgtcctagaccggacgacggtctatacgttatttacgtcgctcgtctactaattacgngtaacgaagttaagttacggtttaacgttacgttttgggtaaccgggggttcgggtaaaccgggggtaaccgttaacgggtcccggtaaccgggttaggttacccgggacctaaaccgggtacccgtaaccggttcccgttaccccgcccggttacctccggttaccctttccgtcccggtttaccccccg

SEQ ID NO: 6847 - DNA, 599 bp, Homo sapiens
  misc_feature: GYAE6OF01AYXPE.23.71.G05.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (576)..(576): a, c, t, g, unknown or other
  misc_feature (576)..(576): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcgccgtctcctgcactggaacccnagtgatgttggacttttanatgtctcgtgtaccatacctccaggacaacgccccaactcatactttatgacggtcacgtaacgcggtccctcgtacggggtttctacgtcgtcttctcgtgcctacctaagtccgtggacaacgcggtcccttcccgtgtaccctactcctcgtcgtaccctccgacgcctcggaccgacgcggtctgtattattctgtctcnctnattactgctagtagtagtagttacgttggtacgggttcgggaccggggtactacgggtcgtacccggttaggtacggtacacggtcccgagggtccccgttacggtcccccgttacgggtaccncccttccgttcccgttacccccg

SEQ ID NO: 6848 - DNA, 864 bp, Homo sapiens
  misc_feature: GYAE6OF01EK0H0.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatccaccgtctcctgcactcggaacccncagtgagttggttagggtaactttttaatagttcggtcttcggtacggtaacccaacttaccctcccgaaggaccaaaaccgacccccctaaacttcctaactttaactttagtacgggaacggggacctaacgtaacggcccgggtaccccgttacggtaacggggttttctaacggttccgtaccgtttcctccgtcgggtcccttaccgtaacgttccgtacggacccaaaccgtacccggtccccttaccccgtacgaccctacgttcccttaccgtccggtccccttacccgaccgtcccgtacgggaacccggtaacggtacgggtacttagttaaacttttacgtttaacgttcgtaccgtttacgtacctttacgtaattacgtcgtaaccgtaaggttaaccgtttaagggtttaaccgtttaacgggttttacggggtaaccgggggtttaccggggggacccggggggtaaaccgtaacgggggttaccggtaacccgggttacgggttaaccgggtacccgaacccgggtaccccggtaaccgggttcccgttacccccgggtaccccccgtttacgggtacccttacccggtttccccggttccccggttacccccccg

SEQ ID NO: 6849 - DNA, 687 bp, Homo sapiens
  misc_feature: GYAE6OF01AD7YX.23.71.G05.1.454.CMB.1.raw
  modified_base (228)..(228): a, c, t, g, unknown or other
  misc_feature (228)..(228): n is a, c, g, or t
  modified_base (310)..(310): a, c, t, g, unknown or other
  misc_feature (310)..(310): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgagtggttggtaacttttaatagtggtcttacgtaggtaccaatacctccaggtacaaacgccccaaatctatacttangacggcacgtaacgcgcctcgtagggttctacgtcgtcttctctggtcctacaagtcctaggacaaccgaccggtccctacccttaacacttcctccgtcggacccttccgaacgtcccgttaggaacccggacgtacgggtacccttaggtaattttaacgttacttcggtctccgtacctaccgtaaatttcggtcgaacgtaacgttaggttaacgtttaagggttaccgtttttacgggaacgggggtttacccggggtaccggggaaaccgttaggggtacgtacccggttaggtaacccggttcgaccgtaacccgagggtcccctcccggtaccccgtcgtaccctacgttccgtccgtttcccccgccc

SEQ ID NO: 6850 - DNA, 683 bp, Homo sapiens
  misc_feature: GYAE6OF01CM5KK.23.71.G05.1.454.CMB.1.raw
  modified_base (244)..(244): a, c, t, g, unknown or other
  misc_feature (244)..(244): n is a, c, g, or t
  modified_base (345)..(345): a, c, t, g, unknown or other
  misc_feature (345)..(345): n is a, c, g, or t
  modified_base (381)..(381): a, c, t, g, unknown or other
  misc_feature (381)..(381): n is a, c, g, or t
  modified_base (504)..(504): a, c, t, g, unknown or other
  misc_feature (504)..(504): n is a, c, g, or t
  modified_base (543)..(543): a, c, t, g, unknown or other
  misc_feature (543)..(543): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactcacgcctgcctccgtgtccgtgggtctccgtggacaggtcgatccgacccgttctcctgcctacgtcggaaccccnacggttgacgttggttgggtaacttttaagtctggttctacggtcggtaacctaactacctacccgaggaccaaaccgcccccaaatactacttactttanaggaggccaacgtacggcgtccctgtagggtttacncgttcgtcttcctcgtacggccttaccgtagtccgtaggaccaaccggtacccggtccctcccgtactaacccgtacttccgtccgtaccgtccctccaacggtcctacggaaaccggtacgngtacgttagtatttaacgtcttcggtctagtctaacgtntaagtacgactaaggtataacggttgtttaccgttagggtccgggtacgggtaccggggaacttagggtcctaccggtcgggtagtccgacggtccgtacgcgttaccccgccggtctactccggttcctccggtccccc

SEQ ID NO: 6851 - DNA, 869 bp, Homo sapiens
  misc_feature: GYAE6OF01AEVVO.23.71.G05.1.454.CMB.1.raw
  modified_base (243)..(243): a, c, t, g, unknown or other
  misc_feature (243)..(243): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgacgggtcctcgggcccagtcctcgccctgactcacgcctcgcctccgtgtcgtggtcctcgtcggacagtcactccgaccgtctcctgcacgtacggaacccgnagtcgtagttcggttaggtaacttttaagtagttcggtcgttaccggtacggtaacctaacgttaccctaccgaaccggaccgaaaaccccgtaaccccctaaacttacctaacgtttactttaacggacggtaaccggacgtaaccgtaaccggccggtacccgtacgggttacgggtttactacggttcgtccttacgtcgtccgtactaccgtagtccgtacgaccaaccgtccgtaccctaccgtacgacctacgtactccgtcgacccacgacgccgtacggacgacggtagtcttagttaacttacggttactcggaccgttacaccgttaagtaccgttagtacggtaccttaagggttaacggttacggtttaaaccggtttcgggttaaccgggggttaccgggggttaaccggggggaaacccggggtaaaacgttttcccggggtaaccgggttaaccccggggttttaaacgggaccgggttaaaccccgggtaaacgggtcccccccggttaaaacggggttccccccgtttacccccgggtaacccccgggttttttcggaaacccccgttcccgggtttttaccccggtcccccggtttaaacccccccgg

SEQ ID NO: 6852 - DNA, 666 bp, Homo sapiens
  misc_feature: GYAE6OF01E4L74.23.71.G05.1.454.CMB.1.raw
  modified_base (233)..(233): a, c, t, g, unknown or other
  misc_feature (233)..(233): n is a, c, g, or t
  modified_base (440)..(440): a, c, t, g, unknown or other
  misc_feature (440)..(440): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaacccgnagtgattggtttagggtacttttaatatcggtctcgtacggtaccactacctccgaagccaaacgccccaaactcattacttatgacggcacgtaacgcgccctcgtagggttctagtccgtcttctcgtcggtactccgaagtcgtacggaccaaccgaccggcccttacccgtcgtaccctacttccgttcgtccggccctaccncggtccgtacgaccggacggacgtctagtattacgttatcgtctcgactacgtatagtagacaacgtattaacggttagtttaccggttcgggtaacgggttccggggaccggggtaccgtaaggttaccggtacccggttacggtcggtaccgacccggtacccgtaacggtcccgtcccggtcccccgttacggacccttaccgttccgttcccgttacccccc

SEQ ID NO: 6853 - DNA, 854 bp, Homo sapiens
  misc_feature: GYAE6OF01BCGQR.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccgtctcctgctacgtcggaacccgnaggtgatggttagggtacttttaatatggtctcggtcggtacctaactacctacccaggaccaaaccgccccctaaactctacttactttatgagggcacgtaacggccggccctcgtaggggtttctaggtccgtcttcctcgtcggctccgtagtcgtacggaccaacgtaccggtccctccgtacgaccgtactcgtcgtccgccctaccgaccgtccgttacggaccggaccggtacgggtccttaggttaactttaagtttacgttacggtcccttacggtaccttacgttaactacgttcgtaaccgtaacggttaacggttaaccgggttttaaacgggttttaaccggttttacggggttaaccgggggttttaccgggggggtaaacccccgggggggggttaaaccgttaaacggggggtttacccgggtaaccccggggtttaaacccgggggtttaaaccgggttaaaacccggggttaaccccccgggtaaacgggttaccccggttaccccccgggttacccccccgggttacccgggtttacccccggtttaaccccgtttcccccggttttacccccggtttaaccccccccgttaaccccccccgg

SEQ ID NO: 6854 - DNA, 641 bp, Homo sapiens
  misc_feature: GYAE6OF01AOJZ6.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcaggtgatggttggactttttaatatcggtctcgtgtaccaatacctccaggcaaacgccccaaactcaatacttatgacggcaactacgccgtccgtcgacgggtttctagtcgtcttcgtctggctccgaagtcctaggacaacgcggtccctccgtacgacctactcctacgtcggccctcgacggtcctaggaccgaacgtaggctagtaattacgttattcgacgtcgtctctaagtactacgctaaggtagttagttacgttaccgttttagggaccgggtttacggggacgggggaaccgtacgggtaccgtaaccgggttcgtacgggtaccgacggtcccgtaacggtacccgtcccggtccccgttacgggttccctaccttccgttccccgttacccccg

SEQ ID NO: 6855 - DNA, 597 bp, Homo sapiens
  misc_feature: GYAE6OF01A2U5J.23.71.G05.1.454.CMB.1.raw
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (357)..(357): a, c, t, g, unknown or other
  misc_feature (357)..(357): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggccccaggtctgccctgactcagccctgcctccgtgtctgggtctcctggaccagtcgatcaccgtctcctgcactggaacccgnagtgatgttaggacttttaantggtctcgtgtaccaatacctccagcaaacgccccaaatcatactttatggaggcactaagccggtcctgtagggtttcagtcgcttctctggctccagtcngcaacacggccctcctgacatctctcgcctccacgccgtgacgacgacggtctcgtatttattagttcgactcgtctagactacgtgacagtaagttagttagttacgtttacgggtaggttaccggggacgggggtaaccgtaagggtccggtaaccggtacgggtacggttacgacggacccgaagtccgtaccggcccccgttacggtaccctaccgttccgtacccggttcccccg

SEQ ID NO: 6856 - DNA, 904 bp, Homo sapiens
  misc_feature: GYAE6OF01AQ457.23.71.G05.1.454.CMB.1.raw
  modified_base (703)..(703): a, c, t, g, unknown or other
  misc_feature (703)..(703): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgacacgtcggaacccgctaggtcgattgggttcgggtaaaccttttttaattagtgggtccttacggttcgggtaaaccctaaacttaccccttacccgaacggggaaccaaaaccggtacccccccccaaaaactttcccgtaaaacttttaaacctttttaacggttacgggaacggggggaacccttaaaccgggttaaacggtcccccggggtaccccctttagggttaacggggggtttttaccgttaaccgttcgggtaccctttttcccgttaccggtcgggtaccccttaacccggtaaaggttacccggtgggaaacccgtaacccggaccggtccccccgtacccgtttacgacccgtaactttcccgttcggttcccgggtaccctacccgtacgtcccggttaacgggaaccgacccgggtaaggtacgttcgtaattaccgttttattccgggcttcgacgttcctacggttntaacgtcgtaacgtacgtaagtttaccggtttaacggttttcgggaacgggggttttaccggggacgggggggttaaacccgagggttacccggtaccgggtccgggtttaaacggccgaacgggtccccgaacggggtcccttaccccggtcccccggtaggtttacccctcgttaacccggttccccgtttaacccccg

SEQ ID NO: 6857 - DNA, 658 bp, Homo sapiens
  misc_feature: GYAE6OF01BGKBS.23.71.G05.1.454.CMB.1.raw
  modified_base (231)..(231): a, c, t, g, unknown or other
  misc_feature (231)..(231): n is a, c, g, or t
  modified_base (322)..(322): a, c, t, g, unknown or other
  misc_feature (322)..(322): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcaccgtcggaacccgntagtgatggttaggtacttttaatattggttctcggtggtaaccaattaccctacccgaggaccaaacgacccccaaacttcattacttanggtacggctactaacgccggtcctcgtagggtttctaggtcgtcttctcgtcgcctacaagtctcggaccaacgccggtccctccgtagtacccattcctaccgtcgggccctctacggccttacgacgaccggtagggccttagtagtttaactttagttacggctttcgaccttacgtaagttgtcgaacgagttagttaacgttagtttacggtttggtacggggttacgggacggggtaccaaggtccggtacccggttagtcggtcgaaccggtcccgaacggtcctacccgtccccggtacggttccacgttcccgtccgtttacccccg

SEQ ID NO: 6858 - DNA, 753 bp, Homo sapiens
  misc_feature: GYAE6OF01AT3I6.23.71.G05.1.454.CMB.1.raw
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
  modified_base (314)..(314): a, c, t, g, unknown or other
  misc_feature (314)..(314): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcacgtcggaacccngagtgattggttaggtacttttaanatggtctcggtacgtaccaatacctccgaggaccaaacgcccccaaatcatacttangacggcactagccgtcctgtagggtttctagtcgtcttctcgtcggcctaccgtagtcgtacggacctaaccgaccggtcccctcccgtacgtaccctacttccgtccgttccggccctaccgacgtcccgtacggaaccggtaccggacggtcttacggttaactttaagtttacgtttcggtccttacggtaccttacctaagtttacgtacgtaacctaaggttaatttaacgggtttaacggtttaccggttttaggggtaaccggggggtttacccgggggaaccggggggttaaacccggtaacggggttacccggtacccgggtttacgggttaccgggtacccggaacggttaccccggtaaccggtcccgttaccccggtcccccggttacgtacccgtacccgtttcccggttcccggttccccccccg

SEQ ID NO: 6859 - DNA, 575 bp, Homo sapiens
  misc_feature: GYAE6OF01EW71P.23.71.G05.1.454.CMB.1.raw
  modified_base (330)..(330): a, c, t, g, unknown or other
  misc_feature (330)..(330): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatggttgggactttttaaatatggtctcgtggtaaccaatacctcccaggacaaacgcccccaaactcatacttatgaggcactaagccggcctntaggggtttctagtcgcttctctggctccaagtcgtggaccaacgaccggcctccctgacccaatcctctacgggcctcccgagtcctagaccgaacggaggctgatttacttattcgctgctctatatcgcaagtagttaggttataccgtttggacgggttcgggaccggggacaagggtcgacccgtggtagtccacggtcccaaggctaccgcccccgtacgctacttcgtccgttacccc

SEQ ID NO: 6860 - DNA, 637 bp, Homo sapiens
  misc_feature: GYAE6OF01D5HF5.23.71.G05.1.454.CMB.1.raw
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacngtcntcaccgtctcctgcactggaacccnagtgatggttggacttttanatggtctgtgtacatcctccagcaacgccccaaatctatacttagtcggacggacacgtaacgcgtccctgtacgggtttctagtcgtcttcgtcgtcggctccgaagttcctacggactaaaccgcggccctacctcgacctattcctcgtacggcccttccgacgcctacgaccgtacgaggtcttagtactttatagttcgactcgtacctactactagtcgacgtataagttacgttagtttaacgtttcggtacgggttacgggaaccggggggtactaagggttccggtaacggttacggtacggtaccaacggtccccggaacgtccgtacccgtacccccggttacgtacccgtaccgtttcccgtccccgtttaaccccccg

SEQ ID NO: 6861 - DNA, 685 bp, Homo sapiens
  misc_feature: GYAE6OF01D74QQ.23.71.G05.1.454.CMB.1.raw
  modified_base (482)..(482): a, c, t, g, unknown or other
  misc_feature (482)..(482): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaaccccgcaggtgagttggtttagggtacttttaatattggtctcggtggtaaccaatacctcccaggccaaacgcccccaaatcatactttatggaggcactagccgcctgtagggtttctagtcgtcttctcgtcggctcgaacgtcgtggaccaaccgaccggtcccttcccgtacgaaccctaacttccgttcgtacgggcccttccgaacggtccctagggaaccgacgacggtcttaggtactttagtttnttacggctaggtcctagtattcgtacgctaaggtattaggtacgtttacgtttgggaagggtttccggggacgggggtaacctaaaggggttccgacccggttagggttaaccggtacgtaacggccccggtaaaggccccgttacccgtacccccccggtttacggtacccttacccgtttccgttccggtttacccccccc

SEQ ID NO: 6862 - DNA, 768 bp, Homo sapiens
  misc_feature: GYAE6OF01A753K.23.71.G05.1.454.CMB.1.raw
  modified_base (233)..(233): a, c, t, g, unknown or other
  misc_feature (233)..(233): n is a, c, g, or t
  modified_base (337)..(337): a, c, t, g, unknown or other
  misc_feature (337)..(337): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaacccgnagtgagttggttaggtaactttttaatagttcggtcttcggtacggtaacctaactaccctccgacggaccaaaaccgaccccctaaactctaacttactttanggacggctaacgtaaggccggaccctacggtacgggtttactacgtcgtcttccgtcgtcggtcctaccgtaacgttcgtaggaccaaccgtaccggtccccttacccgtacgaacctacttccgttccgtccggtcccctaccgaccgtccgtacggaccggacggtacggctagttatttagtttacgttacgtcgtacgtctactattactcggtacctaagtacgtttaagtttacgtttaaccgtttggggttaaccggggttccggggggtaacccgggggtaaccgttaaggggttacccggtaaccccggggttcgggttaaacgggtccccaaccgggtaccccggtaaccgggtcccgttaccccgggtccccccgttaccgggtacccttaacccggttcccgttccccggttccccccg

SEQ ID NO: 6863 - DNA, 831 bp, Homo sapiens
  misc_feature: GYAE6OF01EZW2T.23.71.G05.1.454.CMB.1.raw
  modified_base (435)..(435): a, c, t, g, unknown or other
  misc_feature (435)..(435): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacgagggtcctgggccagtctcgccctgactcagcctcgcctcgtgtcgtcggtctccgtggactagtcgtaactccgtaccgtcctcctcgaccgtaccgtacggaaccccgtgtaggtacgtagttggttacggttaacttttaagtagttcggtacttaccggttaacggttaaacccaaacgttcccgtaaccgacgaaaccaaacccggaccccctaaaattctaatttaaccgttagtacgggacggtactaaccgtaacggtcccggtaccttagggttaaccgggtttntacgttccgtcgttaccgtcgtacggtaccctaacggtacgttaccgacgtaccgaaaccgtccggtccttaccgacgtaaccttacgttcgtccggtacggcccttaccgacgtaccgtacggaaaccgtacgggtacgtttacgtagtttaaatttacgttcgttacggacttgtaacccttaacgtagtaacgtcgtaagttaacgtaacggtttacgttacggtttaaacggttccgggggttaagggttacccgggggaaccgggttaacgacggggttacccggaaccggtttagggaccgtaaccggtaccggtacccgtacggtccccggttacccgtaccccggggtattaccccggttacgtttccccgttaccccggtacccccg

SEQ ID NO: 6864 - DNA, 891 bp, Homo sapiens
  misc_feature: GYAE6OF01DR7WX.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctgccctgactcagcctgcctccgtgtctggtctcgtggacagtcgatccgaccgtctccgtagcctacgtcggaacccgtcagtgagttcgggtttacggttaacttttaagtgttcggttccgttacggttaccggtaacctaaaccttacccgtacccgaaggaaccctaaaacccgacccccctaaacttaccgttaacgtttaaccggttttacgggttaccggggggaccttaaaccggttaaaccgggtccccggttaccccgttacggggtttacggggtttttacccgttacggttccgttccgttttccgtacgtcgggtaccttaccgtaaggttccgtacgggacctaaccggcccgtccctcccgtacggtaaccctcgttccgttccgttccggtacccttacggacccgtaccgtaccgggaaccggtaacggtcggtacgttaagtttaacgtttacgtttacgttacggtcgttaaccgtaccgtttacgttacttaacgtcgtaacgttaacgttaacggtttacgtttaacggtttacggtttacgggtacggggggttaccgggtacgggggaaacccgttacggggttaccggttaaacccgggttgtaaacccgggtccggtaccgggtaccggttaaccggtcccggttccccgttacccccggttacggtacccctaaccctttccggtccccgtttacccctaaccccgg

SEQ ID NO: 6865 - DNA, 829 bp, Homo sapiens
  misc_feature: GYAE6OF01CATU2.23.71.G05.1.454.CMB.1.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcggtgtcgtgggtcctccgtggacagtcgatccaccgtctccngcacgtcggaacccnctaggtagtagttggttaggttaacttttaagttagttcggtcgttacggttacggtaacctaaacgttacccgtacccgaacggaacctaaaaccgacccccctaaaacttaccctaatttaacctttaagtacggaacgggtacctaaccggtaaaccggcccggtacccgttacggttaacggggtttaccttaacggtccgttaccgtttccgtacgtacggtacctaccgtaacggttcgtacggacctaaccggccggtccctacccgtacgacctactccgttccgtacgtccctaccgacgtccgtacggaaccggtaacggacgttacgtaacgtagttttaacgttacggtttacgtcgtacgttacctacgtaagttacgtacgaacgtacgttaaagttacggtttaacgttacgggttttaacgggtaacgggggttaccggggtaccggggtaaacggtacggttaaccgggttacccgggttaggttaacccgggtaccgaaccggtaacccggtacggttacccgccccgttaccccggtacggttaccctaccggtttccttccccgttaacccccg

SEQ ID NO: 6866 - DNA, 828 bp, Homo sapiens
  misc_feature: GYAE6OF01A8SOD.23.71.G05.1.454.CMB.1.raw
  modified_base (147)..(147): a, c, t, g, unknown or other
  misc_feature (147)..(147): n is a, c, g, or t
  modified_base (467)..(467): a, c, t, g, unknown or other
  misc_feature (467)..(467): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtccngggcccagtctcgccctgactcagcctcgcctcgtgtcgtgggtctccgtggacagtcgactcctaccgtctctgacacgtcggaacccgcagttagagttggttacgggttaacttttaatagtggtcgtcggtacggtaacctaacgtacctccgaggaacctaaaccgcccctaaaacctctacttaacgttttacgtaggacgtacaaccgtaacggccgtcccgtacggtaacgggtttctacggttcgtcgttactccgtcgtaccgtaccgtaacgtcgtacggtaaccaccggtaaccgtcccgtttacccncggtaaaccctacgttccgtcccgtaccgggtaccctaccgtaccggtacccgttaacggaacccggtaacgggtaccggtaacgttacggttaaacttttaacgttacgtttacgtccgtaccggtaccttaacgttaactaacgttacggaacgtaaggttaaccttaaggggtttaacgttacggttttacgggtaacccgggggttacggggaaccggggggtaaccgtaaggttaccgggttaaccggtacgggttaaccggtacggtaaccggtaccccggaaccggttcccgacccgttaccccggtaccggtaccccgttaccggttccccgttaccccggtttaaccccccg

SEQ ID NO: 6867 - DNA, 725 bp, Homo sapiens
  misc_feature: GYAE6OF01BDXQN.23.71.G05.1.454.CMB.1.raw
tcagacgcgagtatcacgaccggtgctcgatttagtgtcgtcgcaagagagaggggggggtcacaagaggcagcgctctcgggacgtctccaccatgcctgggctctgctgctcctcactctcctcactcaggacacagggtcctgggcccagtctgccctgactcagcctgcctccgtgtctgggtctcgtggacagtcgatccaccgtctcctagctacgtcggaacccgcaggtgattggtttacgggtacttttaagtatcggtcttcggtaggtaacctaactacctccgagaccaaaccgtccccctaaaactcctaatttaccgtttagttacgggaggtacctaacgttaacggcccggtacccttacggtaccggggttttactaaccgggttccgtaccgttttccgtccgttcggttacctacccgtaacggtccgtacggaacctaaccgacccgggtccctaccccgtacgtaacctacctccgttccggtaccggtccctaccgaaccggtccggttacggaacccgtacggtaccggtacttaggttaacgtttattaacgttcgccgttactcgtactatacgtcgatagttagtagttacgttaacgttggtacggttcggacgggtaggtaccgtcggtccgtcggtccgtcgtacgtccgtacaccggccgtaacggtcccgaacgtccccttggtaccgttcccg

SEQ ID NO: 6868 - DNA, 637 bp, Homo sapiens
  misc_feature: GYAE6OF01CPMH4.23.71.G05.1.454.CMB.1.raw
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (470)..(470): a, c, t, g, unknown or other
  misc_feature (470)..(470): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccgtctcctgaccacgtcggaaccncagtgatggttggtactttantggtctcgtgtaccatcctccgagacaaacgccccaaactctatactttatggacggcaactaacggccgccctgtacgggtttctacgtcgcttcncgtgctcagtcngacacgccgtcctccagacctatccgtcgtcgccctccgacgccgtacgaccggaacgcggtactaggttatttacgtattgtccttcggtaccttcgtaacttcnggtaactaagttaagtttacggttaagtttcgtttagggttacggggttaccggggaccgggggtaaacgacgggttacggtacccggttagggttcgtacgaccggtcccggaacggtccctacccggtccccttacggcccttaccgtccgtcccgttacccccg

SEQ ID NO: 6869 - DNA, 730 bp, Homo sapiens
  misc_feature: GYAE6OF01E2FHL.23.71.G05.1.454.CMB.1.raw
  modified_base (198)..(198): a, c, t, g, unknown or other
  misc_feature (198)..(198): n is a, c, g, or t
  modified_base (309)..(309): a, c, t, g, unknown or other
  misc_feature (309)..(309): n is a, c, g, or t
tcagacgcgagtatcacgaccggtgctcgatttagtgtcgtcgcaagagagaggggggggccacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccgtctcctgcactggaacccgcagtgattggttgggtacttttaatagtggtctcgtcggtaccaactaccctccagacaaaccgccccaaatcatacttangaggcactaacgcgtcctacgtaggttctagtcgtcttctcgtggtcctaccgtaagtcgtggaccaaccgtaccggtccccttaccgtacgaccctacttccgtcgtcgggcccctacccgaagtccccgtagaaccggacgtacgtcgttaggtaatttacgttagtccgtacttcgacctactacgttacgtagtaccgtaaagttaacgttaacgggtttaacgttttaaccgtttacgggggtaaccgggtttaccggggggaccgggggttaaaccaacgggggtttccggtaaccccggggtttagggtaacggtccggaaaccccggtccccggtaaagggtccccgttacccccgggtcccccgtttacgggtacccttcccggtttcccgttacccggtttaccccccccg

SEQ ID NO: 6870 - DNA, 724 bp, Homo sapiens
  misc_feature: GYAE6OF01A4H96.23.71.G05.1.454.CMB.1.raw
  modified_base (229)..(229): a, c, t, g, unknown or other
  misc_feature (229)..(229): n is a, c, g, or t
  modified_base (565)..(565): a, c, t, g, unknown or other
  misc_feature (565)..(565): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggcacgagggtcctgggcccagtctcgccctgactcagcctgcctcgtgtctggtctcgtgacagtcgatcaccgtctcctgcacgtcggaacccncagtgacgttggtttacgggtaactttttaatagttggttccgtcggttacggtaacctaacgtaccctcccgaacggaccaaacgaccccccaactactaactttactttagtggaacgggtactacgtacgaccgtcccttaggtacgggtttctacgtcgtaccttcgtcgtacggtcctaccgtaacgttcgtaccgtacgaaacccgtaccggtccctacccgtacgtaccctactccgttccgtccgtcctaccgacgtccgtacggaaccgtcggacggtcttaggtaacttatttacgttgtccgtcgtacttactaattgtacgtanaacggttagttaacgttacgttacggtttacgggtcggggttaccggggtcgggtaacggttacgggtcgtaccgggttacggtacgggacgtaccgggacccgtacggtccgttacccggtccccgttcggacccttcttcccgtacccggttccccc

SEQ ID NO: 6871 - DNA, 970 bp, Homo sapiens
  misc_feature: GYAE6OF01DZXXM.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccgtctccgtagcctacgtcggaaccccgcaggttcgtaagttgggtttacgggttaactttttaaagttacggttcgggttaccttaccgggtttacggtaacccctaaaacgtttacccccgtacccgaaacgggtaccctaaaaacccggacccccccctaaaaactttacctaacgttttaaaccgttttaacgtacggggaaccggggtaaccctaaaccggttaaaccgggtacccgggtacccccgtttacgggttaaaccgggggttttaccgttaacgggtcccgttacccgtttttcgtaccgtttacgggtcccttaaacccgtaaacgggttccgttacgggaaccctaaacccggtacccggtaccccttaccccgtaaccggaaccccttaacgttcccgttaccggttccgggtaccccgttacccgtaaccggtcccgttaaccgggtaaaccggtaacccggggtacggttaccggttaacggttaaccttttaagttttaccggtttccgtaccgtttacgtacccgtttacgtaacgttaacgttacggaaccgttaaagtaaggtttacggttaacggttttaacggttttacggggtaaccggggtttaccgggggaccggggggttaaaccgtaaggggttcccgtaacccgggttacgtacgggttaccaccgggtacccgtaacggtcccgtacccgtaccccgttcggttaccctcgttcccgttccctacccccg

SEQ ID NO: 6872 - DNA, 624 bp, Homo sapiens
  misc_feature: GYAE6OF01D6PPT.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcacgtcggaaccgcagtgatgttggtactttaatatggtctcgtggtaccaactacctccagacaacgaccccaactacatacttatggacggcacgtaagccggcctcgtacgggttctacgtcgtcttctctcgcgtactacgtctgacgaacaccggtcctcccgtcgacctctaaaactctcgtcctccgacgtcctcgaccgaacggacggtcgtagtatttacttattgtctgtctactatatgctacgtagtagttagtttacgtttaggtacgggttcggggtaccgggggtaacggtaacggtacggtaccggttacggttacgggtacgacggtcccgtacggacccgtcccggtcccccgtaccggttacctccgttccgtccggtttaccccccgg

SEQ ID NO: 6873 - DNA, 664 bp, Homo sapiens
  misc_feature: GYAE6OF01APHNT.23.71.G05.1.454.CMB.1.raw
  modified_base (235)..(235): a, c, t, g, unknown or other
  misc_feature (235)..(235): n is a, c, g, or t
  modified_base (438)..(438): a, c, t, g, unknown or other
  misc_feature (438)..(438): n is a, c, g, or t
  modified_base (523)..(523): a, c, t, g, unknown or other
  misc_feature (523)..(523): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctcgggcccagtctgccctgactcagcctgcctcgtgtcgtgggtctcctggacagtcgactcaccgtctcctgctacgtcggaacccnctagtgtagttggtttacgggtaacttttaagtgttcggtcttcggtacggtaaccctaactaccctccgaaggacctaaaccgacccccctaaatctatttactttagacggacggaccacgtaacgccggtacctaggttagggtttctacgtcgtcttctcgtcgctacgagtcgacgacacgcgtccctacgacacctntcctcgtccggtccctcgacgtcctaggaccgacgtggtctagtaagtttacttcgtgtaaccgtcgtcctagtatacgcgtaanaagtttacgtagttacgttcgttaggtacggggttccgggacgggtaactagggtccgttaccggtggtaccggtacaccgggtaccgtaggtccccgtccggtccccgtacggtcctaccgtttcccgttccggtacccc

SEQ ID NO: 6874 - DNA, 676 bp, Homo sapiens
  misc_feature: GYAE6OF01BDLMU.23.71.G05.1.454.CMB.1.raw
  modified_base (235)..(235): a, c, t, g, unknown or other
  misc_feature (235)..(235): n is a, c, g, or t
  modified_base (506)..(506): a, c, t, g, unknown or other
  misc_feature (506)..(506): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccgtctcctgcacgtcggaacccgnagtgagttggttgggtaactttttaatagtggtctcggtacggtaacctaactaccctacccgaggaccaaaccgaccccctaaactactacttaactttagtaggacggacacgtaacgccggaccctcgtacgggtttcctacgtcgtcttcctcgtcggcctacgaacgtcgtacggaccaaccgtaccggtccctcccgtacgacctactcctccgtcgtccctaccgacgtccgtacggacgacgacggtctagttactttagttntacgtctcgtctactatagtacgacgtaagtagttagttacgtttacggttgggtacggggttacggggaccggggtaaccgtaagggtccgtaccggtcggttacgacgacggtcccgaacggtcctccccggtccccgttcggtacctccgtccgtcccgttaccccg

SEQ ID NO: 6875 - DNA, 862 bp, Homo sapiens
  misc_feature: GYAE6OF01A6PR5.23.71.G05.1.454.CMB.1.raw
  modified_base (173)..(173): a, c, t, g, unknown or other
  misc_feature (173)..(173): n is a, c, g, or t
  modified_base (255)..(255): a, c, t, g, unknown or other
  misc_feature (255)..(255): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcgaggacacgacgggtcctcgggcccctagttcctcgccctnactcacgcctcgtcctcgtgtcgttcgggtcctccgtggacacgtcgactccaccgttctacctgcctacgtaccggaaccncgtagtcgagttcggttacggtaacttttagtgtcggttcttcggtacgtaacctaacctacctccgagtaaccaaacccgtaccccaactactattaccgtttagtcggaacggtactaaccggtaacggcccggtacccgttacggtttacgggttacctacgttccgtactttcccgtacggtcgtacctaccgtaacggtcgtacggtaccaaccgccggtacccgttaccacgtaaaccctcttcccgtcgtaccgtccctacccgtaccgtccgtaaccggacggtacggtaccgtcggttaatacgttttaactttcgggtacgttccgtacgttaccctaacgttagttacgttaaccggtaacgtaacggttaaaccggttaaggtttacggtttttaccggttaccggggttaaggggttaccccggggggttaacgggaaccggttaaacgggtttacccggtaaccgggtttaccggggtaacgttacccgggaacccgggttaccccgtacgggtccccccggttaccccgggtaccccgttaaccgggttccccgtttaacccgttccccggtttcccccgttaaaccccccg

SEQ ID NO: 6876 - DNA, 725 bp, Homo sapiens
  misc_feature: GYAE6OF01AR5Y4.23.71.G05.1.454.CMB.1.raw
  modified_base (158)..(158): a, c, t, g, unknown or other
  misc_feature (158)..(158): n is a, c, g, or t
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtcngccctgactcagcctgcctccgtgtcgtgggtctcctggacagtcgatcaccgtntcctgcactggaacccnagtgatggttggaactttttaangtggtctcgtcggtaaccactaccnccgaaggccaaacnccccaaaatcatttacttagnggtacggcaagtaacgccgccctgtagggttcctagtccgtcttacgtctcggaccttaccgtaagtcctaggaccctaaacgacccggtcccttacccagaaccccttagtccctttacgcggtcccctacctacggacctagggaaccgaacgacggtacctaggtaaactttacttaagtcgtacncggtccttanacttacgtacgaaccgtaagtaacgttaaaggttacgtttaacgtttacggggtacgggttaccggggggaaccggggtaacgttaaaacggggtccgtaaaccccgggttaggttacccgtacgggtaaacccggtaccccaacggggttacccttacccggtaccccccgtttacgggaaccttaccggttacccttcggttaaccccccc

SEQ ID NO: 6877 - DNA, 655 bp, Homo sapiens
  misc_feature: GYAE6OF01CPP1Z.23.71.G05.1.454.CMB.1.raw
  modified_base (229)..(229): a, c, t, g, unknown or other
  misc_feature (229)..(229): n is a, c, g, or t
  modified_base (314)..(314): a, c, t, g, unknown or other
  misc_feature (314)..(314): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccgtctcctgcactcggaacccnagtgagtggttggtacttttaatgttggtctcgtgtaccaactaccctccaggaccaaaccgcccccaaactctaattactttanggacggcacgtacggccgcctgtacgggtttctagtcgtcttctcgtcgcctacgaagtcgtacgacaaccgcgtccctccgtacgacctacttcctcgtcgcctccgagtcccgtacggacgacgtacgtcgtagttactttattacgttcgtacgtcgtaccttactaagtacgttcgaccgtaaggttacttaagggttacgtttacggttacgggtacggggttccggggaacggggtacctacgggtccggtaccggttacggtaacggtccgaacggcccgacggtcccgttcccgtaccccgttacggtcctacccgtcgttccccgttccccg

SEQ ID NO: 6878 - DNA, 773 bp, Homo sapiens
  misc_feature: GYAE6OF01BN0QO.23.71.G05.1.454.CMB.1.raw
  modified_base (257)..(257): a, c, t, g, unknown or other
  misc_feature (257)..(257): n is a, c, g, or t
  modified_base (310)..(310): a, c, t, g, unknown or other
  misc_feature (310)..(310): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactcagcctgcctccgtgtctggtctccgtgacagtcgactcaccgtctcctgctactcggaacccgcagtgattggttaggtacttttaanatggtctgtgtaccaatacctccgagcaacgcccccaaatcacttactttagnggacggcaacgtacggccggtcctagtagggttctagtctcttctcgtgctacagtctcgacaacgccgtcctccgtacgacctctcctcgtcggtccctaccgacgtcccgtaggaccgtaacggagtaccgttagtaattttacgttacgttacggtccgtacgtccttaacgtaacgtttacgttacggaaccgtaagggttaaacgttttaagggttaaacggtttttaacccggttttaggggttaccgggggggtttacccgggggaaacccggggggtttaaaccggttaacgggggttccggttaaaccccgggggtttaccgggttaaaccggggtaacccggaaccccggggttaccccggtaaacccgggttcccccgttaacccgggtcccccccgttttagggaacccctttaccccggtttcccccgttacccggtttaaccccccccg

SEQ ID NO: 6879 - DNA, 607 bp, Homo sapiens
  misc_feature: GYAE6OF01E03OT.23.71.G05.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (357)..(357): a, c, t, g, unknown or other
  misc_feature (357)..(357): n is a, c, g, or t
  modified_base (482)..(482): a, c, t, g, unknown or other
  misc_feature (482)..(482): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgccttccgtgtctgggtctcctggacngtcgatcaccgtctcctgcacgtcggaaccccgnagtgattggttagggtaacttttaatagtggtctcggtacgtaaccaactacctccagacaaaccgaccccaaactctatacttagtggacggcacgtaacgccggtcctcgtacgggtttntagtcgtcttctcgtggcctcgtagtcgtacggcaacgccgtcctcctgacctctccttcgtcgccctaccgacgtcctacgacgacggacgtctagtatttatacgttgctcgtactctaatcncgacaagtatagttacgttaggttggtacgggtcgggacggggtactaacgggttcggccgttaggtacgacgaccggtaccgacgtccgtacccggtcccgtcgtactccttcgcccgtccccg

SEQ ID NO: 6880 - DNA, 780 bp, Homo sapiens
  misc_feature: GYAE6OF01DZR95.23.71.G05.1.454.CMB.1.raw
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccgttcctcctgccacgtcggaaccccgctaggtcgagttggtttacggggtaactttttaaagtagttcggttcctcggttacggtaaccctaaacttacccgtacccgaacggacctaaaaaccgccccccaaaaccttctaactttaaccgttttagtacgggacgggtacctaacgtaacggtcccggtccccgttacggttacggggttttacctacggtccgttccttttctaccgttcggtccgtaccgtaacgtcgtacggacctaaaccgccgtcccctccctcgaaccctacttcctcgtccgtccctccgtacgtccgtacggaaccgtacgacgtacgtagttactttagtttagttcgtcgttcgtccttacgtaacttcgtcgacgtaagttacgttaaggtttaacgttacggttttagggtacggggttccggggtacgggggtaaccgtaagggtaccgggtaccggttcgggtaacggtacgtaccggtacccggacggtccgtacccggtcccccggttacgtcccgttacccgtcccgttcccgttacccccg

SEQ ID NO: 6881 - DNA, 657 bp, Homo sapiens
  misc_feature: GYAE6OF01CPYP6.23.71.G05.1.454.CMB.1.raw
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
  modified_base (458)..(458): a, c, t, g, unknown or other
  misc_feature (458)..(458): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcgtggacagtcgatcaccgtctcctgcactggaacccnagtnatgttggtacttttanatggtctcgtgtaccaatacctccgaggacaaacgccccaaactcatactttagngggcacgacgcgccgcgtagggttctagtcgcttctcgtcgctcgagtcgtgacaacncggcctcccacgacctactctccgtcgtccctcctacgccgtcgaccgaacgacgggtctaggttactttaagtttacgtcgtacgtcgccgttanacgttaagttcgaaccgtagtaaacggttacgttaacgttttcggtttacgggttacgggttacccggggggtcgggggaaacccgtaaggggttaccggtaccggtccgggttaacgtcgaacggaccccgtaacgggcccgtaccccgggccccgttccgttaccgccctttccggtcccctttcccccgtaccccg

SEQ ID NO: 6882 - DNA, 801 bp, Homo sapiens
  misc_feature: GYAE6OF01D3A3W.23.71.G05.1.454.CMB.1.raw
  modified_base (200)..(200): a, c, t, g, unknown or other
  misc_feature (200)..(200): n is a, c, g, or t
  modified_base (648)..(648): a, c, t, g, unknown or other
  misc_feature (648)..(648): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggccctagtctcgccctgactcagcctgcctccgtgtctgggtctcctgacngtcgatcaccgtctccgtgccacgtcggaaccccgtcaaggtcgagttggtttacgggtaactttttaagtagtcggttccttcgtcgggtaacctaaaccgttaccgtacccgaacggaccgaaaacgtcccccctaaaactactaactttaacctttacgtacggtaacgggacctaaccgtaaacggacccggtcccgttacggttaacgggggttttacctaaacggttccggtacttttcccttccggtacgggtcccttacccgtaaacggttccgttacggacctaaaccggacccggtccctaccccgttacgaacccgtacttcccgttaccgttccggccccttacgacccggtacccgttacggaaccgggtacggtaacgggtctttaaggtaactttacgttttaagttcggtacttcgtactccgtaatacgtnaacggtaatacgttaaggttaccgttacgtttacgggttaggggtacccgggtacgggggtaacctaagggttccgacggttagggtacgtacggaccgtaccgaggttccgtccggtcccccgtcggttccacccttcgtcccgttaccccc

SEQ ID NO: 6883 - DNA, 906 bp, Homo sapiens
  misc_feature: GYAE6OF01AYJ5U.23.71.G05.1.454.CMB.1.raw
  modified_base (233)..(233): a, c, t, g, unknown or other
  misc_feature (233)..(233): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatccaccgttctcctgctacgtcggaacccgntaggtgagttggtttagggtaactttttaaagtcgttgggttaccttcggttacggtaaccctaaacttaccccgtacccgaacgggtaaccaaaaaccccggtccccccctaaaaacttccttaactttaaccgttttaggtacgggaacggggtaccctaaccgttaaaccggccccgggtaccccgttacggtacgggggtttttacctacggttccggttcctttccgttcgtcggtacccttaccgtaacgttccgtacgggaacctaaccggtacccggtcccctaccccgtacggaacccctcgttcccgttaccggtcccgggtccccttaccgaccgtccgtacggaccggtaccggaacgggttcttaagttactttttaagttccgtttcggtccttcgtaccttcgtaattacggtcgaacgtaacgttaacgtttaagggtttaacggtttaccgggtttaacggggttaccgggggtttaccggggggaaccgggggttaaacccggttaagggggttacccggtaaccccggggttaaccggtttaccgggtacccggtaaccgggtaccccggtaaaccgggtcccgttaccccccggttaccccgggtcccgtttacccgttacccgttccccggtttaccccgttaccccccccg

SEQ ID NO: 6884 - DNA, 653 bp, Homo sapiens
  misc_feature: GYAE6OF01BDET3.23.71.G05.1.454.CMB.1.raw
  modified_base (228)..(228): a, c, t, g, unknown or other
  misc_feature (228)..(228): n is a, c, g, or t
  modified_base (326)..(326): a, c, t, g, unknown or other
  misc_feature (326)..(326): n is a, c, g, or t
  modified_base (490)..(490): a, c, t, g, unknown or other
  misc_feature (490)..(490): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgagttgttgggtacttttaatatggtctcgtggtaccaatacctccaggtcaacgcccccaaatcatactttatgagggcactaagccggcctnagggtttctagtcgtcttctctcgtcgtaccacgtacgtggtacgacaaccgcccgtaccctcgtaccacttccgtaccttcggcccttccgaccgccgttaccggaaccggacgacgggtctgttacgttaattttaagttcgtcgttcgacttcactttaancggtaccacgtaattaaggttacgttaactttgggtaggttccggggtacgggggaccggtaaaggttacggtaccggttccggtaggttaccgacggtccccgaaacgggtctacccggtaccccgttccggtaaccggtccctcgttcccgttccccccgg

SEQ ID NO: 6885 - DNA, 643 bp, Homo sapiens
  misc_feature: GYAE6OF01CHU50.23.71.G05.1.454.CMB.1.raw
  modified_base (181)..(181): a, c, t, g, unknown or other
  misc_feature (181)..(181): n is a, c, g, or t
  modified_base (230)..(230): a, c, t, g, unknown or other
  misc_feature (230)..(230): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtntcgtgggtctcctggacagtcgatcaccgtctcctgccactggaacccnagtgatggttggtaacttttaatatggtctcggtagtaaccaataccctccgagacaaacgaccccaaatctattacttatgacggcaactaaggcgcctgagggtttcaggtcgtctttctctcggactaccgtaagtccgtaggactaacgaccggtcctaccctgaccctatccttcgtcggtccctaccgacgtccgtacgaaccggtaacggacggtaccgttaaggtaacttttaattaacgtttacgccgttacgtacctacgtaaacttagtcgtactaagtaagttaagttacggttaacgttttggacggtttacggggacgggggtaactaagggtcgacgtacggtagccagaccgaacgtccgtacgtccccgtacgttccaacttccgtccgttacccc

SEQ ID NO: 6886 - DNA, 922 bp, Homo sapiens
  misc_feature: GYAE6OF01AY8HG.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagagggggggggtcacaagaggcagcgctctcgggacgtctccaccatggcctgggctctgctgctctcactctcctcactcaggacacgagggtcctgggccagtctgccctgactcagcctgcctcgtgtctcgggtctcctggacagtcgatccacgtctctgcactcggaacccgntaggtgtacgttggtttacggggtaactttttaatacgttcgggttccttacggttacggttaacccaaattaacccgttcccgaacgggaccaaaaccggtacccccctaaaagttcctaactttacgttttaacgtggaacgggacctaacgttaacggcccggtccccgttacggtacggggtttacctacgtcggtccttttcgtccgttacgggaccctttacccggtaaaggttccgtacgggtaaccgtaaacccgtaccccgggtacccttccccggtttaccgaaccccgttactttccgttaccgggttccgggtacccctttaccggaacccgttcccgttacgggaaacccggttaccggggaacgggttacctaacggttacgtttttaaacgtttacgtttccgggtccgttaccggtccttaaccgttaatacggttacggtccttaaggtaacggtttaaacggtttaccggtttaggtttaaccgggggttacgggggttaccgggggtacccggggggtaaacccggtaaaggggttccggttacccggggtttaacgggtttacccgggtaacgaccccgggttaacgggtaaacccgtccgggttaccccggtacccccgggttacccggtttacccggttacccggtttcccgttccgggtttcccccccgg

SEQ ID NO: 6887 - DNA, 831 bp, Homo sapiens
  misc_feature: GYAE6OF01EWIQC.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaacccgcagtgagttggttgggtaactttttaatagtacggtctcggtcggtaaccctaaacgttaccctcccgaggaccaaaaccggccccccaaaacttctaactttacttttaagtggacgggcctaacgtaacggccggtaccccttcgtacggggtttcctacggttcgtcctttcgtccttcggccttccaaaggtccgtggacctaacccgaccggtccctaccccgtgtaccctacttccctccgtccgggtccctcccgtaacgtcccgtaacggaccgacccgggtagtccgttagttaacttttagttacgtttcgtcgttcgactttacctatttacgagtccgtaaggtagtttacggttaacgtttacggtttacgggtacgggggtttaccggggacgggggggttaacccgttaaacggggggttacccggtaaccccggggtttacgggttaccggggttaacccgggaacccggtaccccgggttaaaacccgggtccccggtttaccccgggtacccccccccgggtttcggggttaaccccctttaccccggttcccggtttacccccgggtttacccccccccg

SEQ ID NO: 6888 - DNA, 857 bp, Homo sapiens
  misc_feature: GYAE6OF01AFNDD.23.71.G05.1.454.CMB.1.raw
  modified_base (205)..(205): a, c, t, g, unknown or other
  misc_feature (205)..(205): n is a, c, g, or t
  modified_base (657)..(657): a, c, t, g, unknown or other
  misc_feature (657)..(657): n is a, c, g, or t
tcagacgcgagtatcacgaccggtgctcgatttagtgtcgtcgcaagagagagggggggtcgacaagaggcagcgctctcgggacgtctccaccatggcctggctctgctgctcctcactctcctcactcaggaccacgagggtcctgggcccagtcctcgccctgacctctagccctgcctccgtgtcgtggtacctcgtgacncgttcgatccgaccttccgtctcgcctaacgtccggtaaacccgcgtaggtcgacgtttggttcgggtaaactttttattacgttacgggtactttccgggttacgtaacccgtaaacttacccttacccgaaacggggtaaccaaaccggtaaccccccctaaagttacccgtaaactttaccgtttaacgtacggtaccggggtaccgtaaacgtaccgtaacccgggtccttaacggtacggggtttaacctacggttccgttaccgttccgttcggttacggtctaccgtacgtacgttccgaaccgaccgtaccggtaccctcccgttacgaccctactcgtccgtaccggtccctaccgaacgttccgtacgaccgggtaccgacggttacgtacgtttacttagttttaccgtcgttaccgtctttacgactaactgggtttacnccgtaacgtagttaacgtttaaggttagttaccggggttagggttacccggggttacgggggaaccgtttacgggggtacccgttaacccgggttacggttaccgggttacggaaccggtacccggtacggttccccgtaaaccccgggtcccgttacccggtaacccgttcctttccccgtacggtttaacccccccgg

SEQ ID NO: 6889 - DNA, 658 bp, Homo sapiens
  misc_feature: GYAE6OF01A4TZ5.23.71.G05.1.454.CMB.1.raw
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (400)..(400): a, c, t, g, unknown or other
  misc_feature (400)..(400): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgacctcagcctgcctccgtgtctgggtctcctggacagtcgatccaccgtctcctgcacgtcggaacccgcagtgagttcggttggtaacttttagtatggtctcgtagtaccaatacctccgagacaaacgccccaacncatacttangacggcacgagccgcctacgtagggttctagtcgtctctcgtcggtctaccgtagtcgtggaccaacgaccggccctcctagacctntcctctccgcctccagtccctagaccgacgacgtctagtacttagttatgtcgtcgtctactattagtcgacgtaagtaacgtagttaacgttttacgttagggtacgggttacccggggtaacgggggtacccgtaagggttccggtaaccgggtaccggttacgggtaccctaacggggtaccccctaaggggttccccgtccccggtcccccggttacgggtaccctaccgttcccggttcccgttaccccccgg

SEQ ID NO: 6890 - DNA, 926 bp, Homo sapiens
  misc_feature: GYAE6OF01B9JKB.23.71.G05.1.454.CMB.1.raw
  modified_base (229)..(229): a, c, t, g, unknown or other
  misc_feature (229)..(229): n is a, c, g, or t
  modified_base (344)..(344): a, c, t, g, unknown or other
  misc_feature (344)..(344): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactcagcctgcctccgtgtctggtctctggacagtcatcaccgtctcctgcactcggaacccgnagtgattggttaggtaacttttaatagttcggttcttcggtacggtaacctaacttaccctccgaacggaaccaaacccgtacccccctaaacgtctaactttaaccttttacgngggtaacgggacctaaccgtaaaccgggtcccgggaccccgttacgggttaacgggggttttacctacggttccgttacctttccgtcgtaccggtcctaaccgtaaacgttccggttacggaccctaaacccggtcccggtccccttacccggtacgtaaccccttagttccccgttccgtacccggtccccgttaccctaaccggtcccggtacggaaacccggggtaccggtacgggttaccctttaagggtttaacctttttaagttttacccggtttacgggttaccctttacggtaacccctttaaggtaaactttaccgggttacgaaccggttaagttaaacgtttaacggggttttaaccgttttaacgggtttacggggtaacgggggttacccgggggggtaaccggggtaaccgggttaaaggggtccccggtaaaccgggttccgggttaaacgggtacccggtacccggggaaccccggttaaacgggtccccgttacccccggttacccccccgggttgggtaacccccgttccgtttacccccgggtcccccgttaacccccccgg

SEQ ID NO: 6891 - DNA, 800 bp, Homo sapiens
  misc_feature: GYAE6OF01A6ZHI.23.71.G05.1.454.CMB.1.raw
  modified_base (237)..(237): a, c, t, g, unknown or other
  misc_feature (237)..(237): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtcctgccctgactcagcctgccctccgtgtcgttgggtctccgtggacagtccgatccaccgtctcctgcacgtcggaacccntacgtgattggttaggtaactttttaatagtggttcctcggtaggtaaccaacttacccgtacccgaggaccaaaccgacccccaaatactaattacgtttagtacggacggaccacgttaacggccggtacccctcgtaggggtttacctacggtaccgtcctttacgtcgtacggaccttaccgtaaacgttcgacggtaccaaaccgtaccggtaccccttacccgtacgaaccctacttaccgttccgtccgtacccgttcccgaacgtacccggtacgtaaacccgggacggtaacggtcttaacggtaacttttaacgtttagtttacgaccgtttacgtaccttaacgtattaacgttcgaaccgtaaggttaaaccgttaggtttaaccgtttaacggttttacgggtaacgggggtttaccggggaacccggggggtaaccgttaacggggtacccggtaaccggttacgggttacgtacccgtaccggacccggtaacgtccccggtacccgtaccccgtcgttaccacccggttcccgtacccgttaccccc

SEQ ID NO: 6892 - DNA, 702 bp, Homo sapiens
  misc_feature: GYAE6OF01CVT1A.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgctacgtcggaacccncagtgagttggttggtacttttaatattcggtctcggtgtaaccaactacctccgaggacaaacgccccaaatcattacttagcgaggcacgtacgcggtcctagtagggtttctagtccgtcttcgtcgtcggcctaccgtagtccgtagacctaacgccgtccctcccgtagaccctacttccgtcctcgggtcccttaccgacgtacccgtaggaaccggacggtacggtacttaagtacttttacgtttacgttcgtacgtcgttacttactaagttatcgaacgtagtaagtttaacggttagtttacggtttagggtaacgggttccgggggaacgggggtaaccgtaaagggtccggtaacgggttaccggtcgggttaaccgacgggtaaccccgaacgggttccctacccgggtccccccgttacggttccctaaccgtttcccgttcccgttaaccccccg

SEQ ID NO: 6893 - DNA, 745 bp, Homo sapiens
  misc_feature: GYAE6OF01BZWQM.23.71.G05.1.454.CMB.1.raw
  modified_base (229)..(229): a, c, t, g, unknown or other
  misc_feature (229)..(229): n is a, c, g, or t
  modified_base (373)..(373): a, c, t, g, unknown or other
  misc_feature (373)..(373): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcacgtcggaacccnagtgattggttaggtacttttaatatggtctcggtcggtaccaacgtaccctcccaaggtccaaacgccccctaaactcaattacctttatcggacgggcaactaaggccggccctgtaggggtttctagtccgtcttcgtcgnggctccgaagtctggccaacgaccggccctccgtacgacctatctccgtacgggcccttaccgacgtccgttacggaaccgacggacggtaccgttagtaacctttatttaacgttcgtacgttcggtcctacgttacttacgtcggtacgtaacggttaagtttaacggtttaacggtttacggtttttaggggacggggttttccggggggaaccgggggtacccggttaaggggttacccgggtaacccggttaccgggttacggggtaccgtacccgggtaccccggtaaagggccccgtttacccggacccccccggtttacggtcccggtaacccgtttcccggttccccggttttacccccccgg

SEQ ID NO: 6894 - DNA, 725 bp, Homo sapiens
  misc_feature: GYAE6OF01E4CUG.23.71.G05.1.454.CMB.1.raw
  modified_base (267)..(267): a, c, t, g, unknown or other
  misc_feature (267)..(267): n is a, c, g, or t
  modified_base (478)..(478): a, c, t, g, unknown or other
  misc_feature (478)..(478): n is a, c, g, or t
  modified_base (549)..(549): a, c, t, g, unknown or other
  misc_feature (549)..(549): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcacgcctgcctccgtgtctgggtcctccgtaggacaggttcgatccaccgtctcctgcacgtcggaacccgcagtgtacttggtttaggtaactttttaangtcggttctcgtcggtacctaactaccctacccgaaggtaccaaaccgacccccctaaacgtctaacgtttaccttagtacggaaccggactaacgtaaccggccgtaccctaggttacggttactacgtcgtcttcgtcgtcgcctcgaacgttcgacgtaccacggtacccgtcctacccgtataccgacttccgtcctaccgtacccncgtaacgtccgtacggaccgcggtagcttagtcgtttaacttgtcgtctaacgtctagttaactgaccgtntaaacggtattacggttaagtttacgggttcgtaacgggggttcccgggaacggggttacccgtaacgggttccggaacccgggtacggttacggacctacccgggtaccgttaccgggcccttacccccggtccccggtaccgtaccgttccctttcccgtccttaccccccccg

SEQ ID NO: 6895 - DNA, 641 bp, Homo sapiens
  misc_feature: GYAE6OF01ARVEO.23.71.G05.1.454.CMB.1.raw
  modified_base (230)..(230): a, c, t, g, unknown or other
  misc_feature (230)..(230): n is a, c, g, or t
  modified_base (368)..(368): a, c, t, g, unknown or other
  misc_feature (368)..(368): n is a, c, g, or t
  modified_base (413)..(413): a, c, t, g, unknown or other
  misc_feature (413)..(413): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctgccctgactcagcctgcctcgtgtctggtcctcgtgacagtcatccaccgtctcctgcacgtcggaacccgnagtgagttggttggtactttaatgtcgtctcgtgtaccaactacctcacgacaaaccgtccccaaatctaacttacttagtcggacggactaacgtaacggccgtaccgtacggttacgggtttctacgtcgtcttcncgtcgctacgagtcgacgactaccgaccgtcctaccgtcgacctntccgtcgtcgacctccgacgtcctaggtaccgaggtacgtcttaagtacttacttgttcgcttcgacttcattacgctaacgtaagtacgtagttacgttaggttacgggtcggggtaccgggacggggtactacggtaccggtaccggttacggtaacgtcgaaccggtcccgaacggtcccgtacccgtccccgtagacccttccgttcccgtacccgttaccccg

SEQ ID NO: 6896 - DNA, 653 bp, Homo sapiens
  misc_feature: GYAE6OF01BKFDN.23.71.G05.1.454.CMB.1.raw
  modified_base (231)..(231): a, c, t, g, unknown or other
  misc_feature (231)..(231): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnaggtgattggttgggtaacttttaatattggtcttcgtaggtaaccaattaccctcccaggaccaaacgacccccaaactcaattacttatggaggcactaaggcgcctcgtagggttctagtcncttcngtgctcagtcngcacgcgcctccnacatctcgcgcctccacgtccctaggaccgacgacggtcttagtatttagttacttcgtcttcgaccttctaattacgtcggacgtaagtacgtttaagggttagtttaacggtttcggggtaacggggttccggggaaccggggggtacctaaggggttccgacccgggttacggtacgggtaccgaaccgggcccctaagggccccgttaccccgggtcccccgttcgggtaccctaccccggtttcgtccccggttaccccccgg

SEQ ID NO: 6897 - DNA, 743 bp, Homo sapiens
  misc_feature: GYAE6OF01B83N5.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgcctgactcagcctgcctccgtgtctggtctcctggacagtcgatcaccgtctcctgcacgtcggaacccgcagtgattggttggtaacttttaatagtcggttctcggtacggtaaccaacgtaccctaccgaggaccaaaccgaccccctaaactctaacttactttacgtgacggtacctacgtaacggccggtaccctaggtacgggtttctacgttccgtcttctcgttggcctaccgtagtcgtcggaccaacgtccggtccctcccgtacgtacctacgttccttccgtccggtaccctcccgacgtcccgtacggaaccggtaccggtaggtcgttagtaacgtttactttacgttcgtctacgtcttactactacgtcgtacgtaacgtaacgttacgttagtttacggttacgggttacggggttaccggggtaccgggggtaaccgtaacgggttccggtaccggttacgggtaccggttacgaccggtaccccggtaacggtcccgttccccggttacccccggttacgggtttacccttacccgggttttccccggtcccccgttaccccgg

SEQ ID NO: 6898 - DNA, 739 bp, Homo sapiens
  misc_feature: GYAE6OF01AZSPA.23.71.G05.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
  modified_base (406)..(406): a, c, t, g, unknown or other
  misc_feature (406)..(406): n is a, c, g, or t
  modified_base (545)..(545): a, c, t, g, unknown or other
  misc_feature (545)..(545): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctcggccctagtctcgccctgacctcacgcctcgcctcgtgtctgggtcctccgngtacngtcgatccgaccgtcctcgtcncacgtacggacccgtcngtgacgttggttacggtacttttaagcgttcgtctcggttacgtaacctaacgtccctacgacggtaccaaacccgtacccctaaagtctaacttacgtttacgtacggacggaacctacgtacggcccggtccttaggtacgggtttactcggtcgtcttntcgtacgtctacgtactcgacgacgaccgacgtcccgtacctacgctactccgttacgtacccgcctccgtacgtacgcggtaccgacggtacgtacttagttaactttacgttacgttcgttccgtagtcctattacncgtacgacgtaagtacgttacggttgttaccgtttgggtaccgggtacggggtaccgggtacggttacggaccggttaccgggtacgttacgggtacccaccggggttacccgaacccgggttccgtacccccgggttacccggtacccggtttaacccgtcccgtttcccggtttccccggttaaccccccgg

SEQ ID NO: 6899 - DNA, 796 bp, Homo sapiens
  misc_feature: GYAE6OF01BKCY1.23.71.G05.1.454.CMB.1.raw
  modified_base (263)..(263): a, c, t, g, unknown or other
  misc_feature (263)..(263): n is a, c, g, or t
tcagacgcgagtatcacgaccggtgctcgatttagtgtcgtcgcaagagagaggggggggtcacaagaggcagcgctactcgggacgtctcccaccatggcctgggctctgctgctcctcactctcctcactcaggacacgagggtcctgggcccaggtctcgacccttgacctcacgcctgccctccgtgtcgtcgggtctccgtggaccacggtcgactccgaccgttcctccgtcgaccaaccgttacgggaaccccgtnaggttggagttcggtttaggggtaacctttttaagtacgttcggtacgtaccggtaaccggtaaccctaaccgttaccccgtacccgaaccgaacccgtaaaccccgtaacccccctaaacttacttaactttaaccgtttaacggtacgggtaacggtacctaaccggtaaccggtacccggtacccgttacgggttacgggtttaccgtacggtccgttccttaccgtcgtacgtacctacgtacggtcgtacgtaccgtaaccgtccggtaccctaccgtacgtaccgtactccgtaccgtccgtacctaccgaccgtacgtacggaccgtacggtacgtcgttagttaactttacgttacgttcgtcgtacgtcctactatagtacgtagtaagttacgttaagttacgtttaggttacgggtacgggtaccgggtaacgggtacgtcggtacggtaccggttaggtcgtacggaccggtcgaccggtccctacccggtcccgtctaccgtcctcccgttcccgtaccc

SEQ ID NO: 6900 - DNA, 772 bp, Homo sapiens
  misc_feature: GYAE6OF01EKIJC.23.71.G05.1.454.CMB.1.raw
  modified_base (232)..(232): a, c, t, g, unknown or other
  misc_feature (232)..(232): n is a, c, g, or t
  modified_base (567)..(567): a, c, t, g, unknown or other
  misc_feature (567)..(567): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatccaccgtctcctgctactcggaaccccnagtgatttggttacggtactttttaagtattggtccttcggtacggtaacctaactaccctcccgaaggaccaaaccgacccccctaaattctaatttaaccttttagtacgggacgggtacctaaccgtaaacggccggtacccttcggttaacggggttttcctaggttcccgtactttccgtcgtcggtaccttaccgtaagttcgtacggactaaacccgtccggccccttcccgtaacgaccctaagttccctacggtccgggtccctaccgacgtaccgtacggaaccggtacggacggcctttaaggtaactttacgtttagttccgnttacggcctactaattagcgactaaggttaacttagtttacggttacgtttaggggacggggtttacccggggacgggggtaaaccgttagggtccggttaaacccgggttgggttaccgtaaccgggtaacccgtaccggaacggtcccgttaccccgggacccccttacggtaccctccgttccgttccccggttaccccccg

SEQ ID NO: 6901 - DNA, 917 bp, Homo sapiens
  misc_feature: GYAE6OF01A25JJ.23.71.G05.1.454.CMB.1.raw
  modified_base (240)..(240): a, c, t, g, unknown or other
  misc_feature (240)..(240): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtcctcgccctgactcagcctgcctccgtgtcgtgggtctcctggacagtcgactccaccgtctcctgcacgtacggaacccgtnacggtgagttggttacgggttaacttttaagtattcgggttccttcggtaggttaacccaaacttaccccttaccccgaacgggttaacccaaaaccggaccccccctaaaacttacctaacgtttaaccgtttttacgtacgggacggggtaacctaaccggtaaacggccgggtacccccgttacggtacgggggttttaccgttacgtccggtcccttttccgttcgtcgggtacctaccgtaaacgggttccgtacggtacctaaacccgacccggggttccccttacccctacgggaaccccttaacgttccccgttccgttacccgggtccccgttaccccgtacggttccccgtaacggtaacccggaacccgggtacgggtccgtaagttaaccgttttaagtttacgttacgtccttacggtccttactaattacgtcgacgtaacggtagttaacggttacgtttaccggtttacggggttacggggttaccggggggtaccggggggttaacggaaccgggggttaccgggtaacccggggtttaccggggtaaccgggttacccgggtaccggaccccggtaaacgggtcccgttaaccccgggtccccccgttacgggttaaccccggtacccgtttccccgggttcccggtttacccccccgg

SEQ ID NO: 6902 - DNA, 758 bp, Homo sapiens
  misc_feature: GYAE6OF01CZL5H.23.71.G05.1.454.CMB.1.raw
  modified_base (114)..(114): a, c, t, g, unknown or other
  misc_feature (114)..(114): n is a, c, g, or t
tcagacgcgagtatcacgaccggtgctcgatttagtgtcgtcgcaagagagaggggggggggtcacaagaggcagcgctctcgggacgtctccaccatggcctgggctctgctnctcctcactctcctcactcaggacacacgggtcctcgggcccagtctcgccctgactcagtcctcgcctccgtgtcgtcgggtcctcgtggacacgtcgatccaccgtctcctgcctacgtacggaacccgcagtagtacgttggttacgggttaacttttaagtagttcggttacctcgggtacgtaacctaactaccctacccgaaggaccaaaaccgtacccccaaacttcaacgttttaactttagacggaacggacctaaaccgtacggccggtaccgttacggtacggggtttactacggtccggtcgttcctcggtcgaccgtaacgtacgtcgacggaacgtaacccgccggtccccttcgtaacgtacccctacttccgtaccgtcccgtaccctacccgtccggtaccgttacgggaacccggtaacgtcgggtacttaagttacctttagtttacgttgtaccgtcgttaccttacgattacgtcgactaagtacgttagttacgtttacggttaaggggtcggggtacggggaccgggggtacgtaacgggtccgtacggttcggtaaccgcgtacggccgaaccggtccgtacccgtcccgtaccgtcttacctcccggttcccctacccg

SEQ ID NO: 6903 - DNA, 877 bp, Homo sapiens
  misc_feature: GYAE6OF01DMP93.23.71.G05.1.454.CMB.1.raw
  modified_base (115)..(115): a, c, t, g, unknown or other
  misc_feature (115)..(115): n is a, c, g, or t
tcagacgcgagtatcacgaccggtgctcgatttagtgtcgtcgcaagagagagggggggtcacaagaggcagcgctctcggacgtctccaccatggcctggctctgctgctcctnactctcctcactcaggacacagggtcctgggcccagtctgccctgactcagcctgcctcgtgtctgggtctcctggacagtccgatcacgttctcctgaccacgtcggaacccgcaagttgattggttacggtacttttaaagtattcggtcttacggttacggtaccaaagttacccgtaccgaaggacctaaaaacggacccccctaaaacgttaccaactttaaccgtttttaagacggtaacggggtcctaaaccggtaaacggtccccgggtacccctaaccggttaacggggggttttttaccctaacgggttttacccgtccggtttttaaccctccggtttacgggtaccctttaccccggttaaaaaggggtttcccgaacggggtaacccttaaaaacccgtacccgggggacccccttttacccccgtaggttaaaccccgaacgttttacccgtttaaccggtccgggtaaccccctttaccggaaacgtccccgggttaacggtaaacccgggtacggtaacggtaccgttacgttaaccttttaagtttaacgttcgtcgtacgtctactaacgtacttcgaacctagtagtaacgttacgttagtttacggacggggttaccgggacggggttaaacacgggttcggaacggttttacggaccggtacgttaaccggaccgtaaaccgggtctaaccccggtcccccggttaggtaacccttcccggttccttccggttaccccccg

SEQ ID NO: 6904 - DNA, 1030 bp, Homo sapiens
  misc_feature: GYAE6OF01DCSUV.23.71.G05.1.454.CMB.1.raw
  modified_base (240)..(240): a, c, t, g, unknown or other
  misc_feature (240)..(240): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacgagggtcctgggcccagtctcgccctgactcagcctgcctccgtgtctggtcctcctggacagtcgattccaccgtctccgtgcctaccgtacggaaccccgntaggtcgtagttcggttaggttacctttttaagttagttcggttccttacggttacggtaaccctaaacgttacccctacccgaaggacccaaaacgaccccccctaaaacttcctaacgtttaacctttaagtcggaaccgggtacctaaaccggtaaccgggcccggtacccccgttagggttaacggggttttaccgtaaccggttccggtccctttccgtaccgttcggtaccgttaccgtaaacggttccgtaaccgggaccctaaaccggtcccgggtacccccttaccccgtacggtaaaccccttacgttacccgttcccggtttcccgggacccctttaccccgaaccgggttaccccgttaacgggaacccggtaaccggggtaacggtaccgtttaaggttaacctttttaagtttacgtttaccggtccgttaccggtttccttttaaccggaaactttaccgggtaacgtaacccgttaaggttaaaaccggtttttaacgggtttaagggttttaacccggtttttaaggggggtttaacccgggggttttaccccgggggggaaaccggggggggtttaaaacccgggttaaacccgggggttaccgggttaaacccgggttaccccgggggttaaaccgggttaaacccccgaccgggggtttaaaccccccggaaaccggggttccccgtttaccccccgggtacccccccgggtttaacggttacccccgtttaacccgtttccccgggttcccccggtttaccccccccgg

SEQ ID NO: 6905 - DNA, 754 bp, Homo sapiens
  misc_feature: GYAE6OF01DEDI0.23.71.G05.1.454.CMB.1.raw
  modified_base (234)..(234): a, c, t, g, unknown or other
  misc_feature (234)..(234): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctcgccctgactcagcctgcctccgtgtctgggtctccgtggacagtcgactcaccgtctcctgccactcggaacccgnagtgattggttggtacttttaatattggtctcggtaggtaaccaaacttaccctccaggaccaaaacgccccccaaaacttctaactttaccttttaagcggaacgggcctaaacgttaacggccggtccccttacggttagggggttttactacggtccgttcctttcgtcgtcggtccttacccgtaaagttccgtacggacaaaccgccggtccctcccgtcgaccctattccgtcgtcggaccccttacccgacgtcccgtacggaaccgacggacggtcttaggtaactttaatttagttcggtccttggtccttacgtaacttagtgacctaagtaacgttaggttagtttaccggtttaggtacggggtttaccggggaaccgggggtaaccgtaaaggggtcggttaacccgggttacgggttaacggtcgtaaccggtcccggtaaacgggtcccgtaccccggtcccccgttacgggttaccctaccgttccgttcccggttcccccccg

SEQ ID NO: 6906 - DNA, 802 bp, Homo sapiens
  misc_feature: GYAE6OF01D5W27.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttagggtaacttttaatagttggttccgttcggttacggtaacctaacttaccctcccgaaggaccaaaaccgccccccaaaacttctaactttaacctttagtacggacgggtaccaacgtaacggccggtcccttcgtacggggtttctacgtcgtcttcgtcgtggcctacgaagtcgaggccaaccgaccggtcccctacccgtagaccctacttccgttccgtacggccccttccgacgtccgtacggaaccggtacggtacggccttagtaacttttaatttacgttcggccttcgtaccttactaagttacgtcggtaactaaacggttaattaacgggtttaacggtttaaacgtttggggtaaccggggggtttacggggggaacccgggggggttaaaacctaacgggggttccggttaacccggggtttacgggtaccgggttacccggaaccgggttacccccggaaagggtacccccgttaccccggggtcccccccgtttacgggttaacccgtttccccgtttcccgttaccccggtttacccccccc

SEQ ID NO: 6907 - DNA, 715 bp, Homo sapiens
  misc_feature: GYAE6OF01BNH7U.23.71.G05.1.454.CMB.1.raw
  modified_base (238)..(238): a, c, t, g, unknown or other
  misc_feature (238)..(238): n is a, c, g, or t
  modified_base (573)..(573): a, c, t, g, unknown or other
  misc_feature (573)..(573): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgacgggtcctcgggcccagtctgccctgactcagcctgcctccgtgtcgtgggtcctcctggacagtcgactccaccgtctcctgcacgtcggaacccncagtgtagttggttagggtaacttttaatgttcggttctcggttacggtaacctaactaccctccgaacggtaccaaaacccgaccccctaaaacttacctaactttacgttttaagtacggtaacggggtacctaaccgtaacgggcccggtacccgtacggttacggggtttactaacgtccgttcttccgtcgttcggcctaccgtaagtccgtacgacctaaaccgaccggtccctaccctaggtaacctactccgtctccggtacctccgtaccgtccgacggtaccgacggtacgtctagtactttagttgttcgctcacgtatatacngaactagtaacgttagttaacgtttgttacggtcgggttaccggggacgggtacgtacgggtcggtaccggtcgtacggtaccgacggacccgtacggcccgtacccgtcccgtacttaccgtcccttcgttcccgtccccg

SEQ ID NO: 6908 - DNA, 862 bp, Homo sapiens
  misc_feature: GYAE6OF01BMCCA.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctcgtgtcgtgggtctccgtggacagtcgatccaccgtctcctgctaccgtcggaacccgcgtagtgtagttggttacgggtaactttttaagtacgttggttccgttcggtacggtaaaccctaacgttacccctacccgaaggaaccaaaacccgcccccctaaaaatcctaacgtttaccgtttagacgggaacgggacctaacggtaacggcccggtaccccgttagggttaacggggttttcctacggttcccttaccgttttcccgtaccggttacgggtacccttaccgtaaacggttccgtacgggtaacccaaacccgtcccggtaccccttacccgtacgaacccttacgttcccgtacgttccgtacccttaccgacgtaccgtaacggaaccggtacgacggttacgttaaggtaacttttacgtacggttcgacctcggtacttaacgtaacgttaacgtcggtaactaagttacgtttacggggtttaacgttttacgggttacggggttaccgggggttaacccggggaccgggggttaacgtaaccggggttaccgtaccgggttacggtaccgggtaccgtaacccgggtaacccgacgggttccccgttacccccgggtacccttcgggttaaccctacccgtttccggtttaccccgttaccccccg

SEQ ID NO: 6909 - DNA, 827 bp, Homo sapiens
  misc_feature: GYAE6OF01B18PP.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgacgggtccgtcgggcccagtctcgccctgactcagcctcgccttccgtgtcgtcgggtcctccgtcggactaggtcgactccgacccgttcctcctcgcaccgtaccggaacccgctaggtgtaggttggttacggttaacttttaagtacgttcggttccttcggttacgtaacctaacttacccgtacccgtaacggacctaaacccgacccccctaaattccgtaactttaaccgtttaggtcggaccggtacctaaccggtaacggcccggtaccccgttggttacggggttttctaccggttccgtaccgtttctccgtacgtcctaccgtacgtccgtacgaccgtaaaccgccgtcccctacccgtactacccgtctaccgttccgtccgtacccgtcccgtaccggtcccgtacggaccggaaccggtacgtaccgttacgttaattttacgttagttccgtcgtaccgtacttacgtatacgtcgtacgttaacgtagtttaacgttacggtttacgggttacgggttaccggggttaccggggaaccggggtaacgggtaacgggtccggtaccgggttacggtacgggttaccggaacccggtcccggtaaccggtcccgttacccggtaccccggttccggtacccttacccgttcccgttccccgttaaccccg

SEQ ID NO: 6910 - DNA, 832 bp, Homo sapiens
  misc_feature: GYAE6OF01CB679.23.71.G05.1.454.CMB.1.raw
  modified_base (665)..(665): a, c, t, g, unknown or other
  misc_feature (665)..(665): n is a, c, g, or t
  modified_base (807)..(807): a, c, t, g, unknown or other
  misc_feature (807)..(807): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtccgtcgggcccagtctcgccctgactcacgcctcgcctccgtgtcgtcgggtcctccgtcggactacgtcgatcctaccgttcctccgtcgccaccgtaccggaaccccgcgtagtggtacgtttgggtttacggggttaaactttttaagtacgtttcgggttccgttacgggtaccggttaaaccctaaaaccgtttaccccttacccggaaacgggaccccgaaaaaaccccggtacccccccctaaaaaaccgtcccttaaaacgttttaaccgttttacggtaacggggaccgggtaacccgtaaaccggtaaaccgggtccccgggtaccccgttaccgggttacgggggttttacctacggttccggttccttcgtccgtcggtaccttaccgtaagtccggtacgccaaaccgtcccggtcccctccgtacgtacctactcttccgtccgtaccctccgaccgtccgtacgaccggacggtacgtcgttagttattattcgttcgtcgtacncgttaactattacgtcgtataacgtagttaaggttacgttcgtttacggtacggggtaccgggcgggacgtacggtaccggtaccggttacgtcggtaacgaccggtaccgtacggtcccgtaccccggtcccgtcgtaccncccgtttccgtccccgttacccccg

SEQ ID NO: 6911 - DNA, 741 bp, Homo sapiens
  misc_feature: GYAE6OF01CWVYZ.23.71.G05.1.454.CMB.1.raw
  modified_base (277)..(277): a, c, t, g, unknown or other
  misc_feature (277)..(277): n is a, c, g, or t
  modified_base (615)..(615): a, c, t, g, unknown or other
  misc_feature (615)..(615): n is a, c, g, or t
  modified_base (658)..(658): a, c, t, g, unknown or other
  misc_feature (658)..(658): n is a, c, g, or t
tcagacgcgagtatcacgaccggtgctcgatttagtgtcgtcgcaagagagaggggggggtcacaagaggcagcgctctcgggacgtctccaaccatggcctgggctctgctgctcctcactctcctcactcaggacacgaggtcctggcccagtctgccctgactcacgcctgccctcgtgtcgtcggtcctcgtaggactgtacgactccgaccgtcctctcgacctacgtaccggaccctcgtagtagtacgttaggttacgttattttaaagngtcggtactacggtacgtaaaccaacgttccctaccgacgtaaccaaacccgtacccctaaagtctacgtttaacttaggacggtaacggacctaacgtaccggccggtacccttagggttacggtttaccacgtccgttcttccgtcgtacgtaccgttaacgtacgtacgtaccgtaaaccgaaccggtcccggtccccttacggaaccaaccgtttactccggttaaccggtccgtaaccccgttaacgacccgtttacgtaacgggaaacccgtacggtaccgttaacgttaagttaacttttacgttacgtcggctacgtacttagaatgtanaacgtagttagtacgtgttacgtcgagggtcgggacggtaacncggtacgtacggacgtagtccgaacgttacggaccgtcccgtacccgtcccggtacttacgtcccgtccgtttcctaaccccg

SEQ ID NO: 6912 - DNA, 670 bp, Homo sapiens
  misc_feature: GYAE6OF01CPSMX.23.71.G05.1.454.CMB.1.raw
  modified_base (257)..(257): a, c, t, g, unknown or other
  misc_feature (257)..(257): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggcagtcgatcaccgtctcctgctactcggaacccgcaggtgattggttggtaactttttaanattggtctcgtggtacctaatacctccaggacaaacgcccccaaatctactaactttatgacggtcactaaggcgtcctacgtagggtttctagtcgtacttcgtcgtcgctaccgtaagtcctggacaaccgaccggtccctccgtacgacctacttccgtcgtcggtcccttcccgaacgtcctggaccggtaacgacggtcgtagtaactttagttaacttgaccgttcgtctactaagttacctgcctagtagttaggtacgttacgtttgggtaccggggttcgggtaaccgggggtacgtaaggggtaccggtaccggttacgggtcgggtacgtaacgggcccgtaagggtcccgtccgtaccccccggttacgtaccctaccgttccggttcccgttaccccccg

SEQ ID NO: 6913 - DNA, 752 bp, Homo sapiens
  misc_feature: GYAE6OF01B2UB2.23.71.G05.1.454.CMB.1.raw
  modified_base (237)..(237): a, c, t, g, unknown or other
  misc_feature (237)..(237): n is a, c, g, or t
  modified_base (712)..(712): a, c, t, g, unknown or other
  misc_feature (712)..(712): n is a, c, g, or t
  modified_base (736)..(736): a, c, t, g, unknown or other
  misc_feature (736)..(736): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgaggtcctgggcccagtctgccctgactcacgcctgccctccgtgtcgtgggtctcctggacagtcgatccaccgtctcctgcacgtacggaacccgngtagtgtagttggttacgggttaacttttaagtacgttcggtccgttaccggttacggtaaccctaaacttacccgtacccgaaggaacccgtaaacccgtaccccctaaaacttcgtaaactttaaccgtttagtacgggaacggtactaacggtaccggtccggaccccgttacgggttaacggggttttaccttacggtccgttccttccgttacggttccggtcctaaccgtaaagttccggtacggtaaccgaacccgtaccggtcccctacccgtacgacccgtacttcccgtcggtaccggtcccctaccggtaccgtaccgtacggtaaccgggaccgtaggtacgttacgttaagtttaacttcggttcgtcttaccggtacctatacgtaacgttcgagtaacgtcgttaattacggttacgttcggacggggttcgggacgggtacgtaggcgtacgtagtcgnacggcgcgccgtccgtccctcganccgttcgtccgtcccg

SEQ ID NO: 6914 - DNA, 788 bp, Homo sapiens
  misc_feature: GYAE6OF01BE496.23.71.G05.1.454.CMB.1.raw
  modified_base (205)..(205): a, c, t, g, unknown or other
  misc_feature (205)..(205): n is a, c, g, or t
  modified_base (582)..(582): a, c, t, g, unknown or other
  misc_feature (582)..(582): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactcctcctcactcaggacacgagggtcctcgggcccagtctcgccctgactcacgcctcgccctccgtgtcgtggtctcgtgacngtcgatccaccgtctccgtcgaccgtacgtaccggaacccgtgtacgtggtagttgggtttacggttaacctttttaagtacggttcggttccgttaccgggttaccgtaaaccctaacccgttaccccgtaccgaacggtaacccaaaacccggtacccccctaaaacttccgttaactttaccgtttagacgggaccggacgtaaccgacggtcccggtaccgtgggttacggtttactacgttccgtcttcgtcgtacggtctacgtacgtcgtacgaccgaaccgtccggtcccttaccgcgtacctcttccgtcgtccgtacccgtaccgtacgtcgtacggaccgtacggtacgtacgttattaacgtttnttacgttacgccttacgtaccctagtaactcgtaacgacggtaagttacgttagttaacggtttcggttaacgggttacggggtccggggtaacgggtaccggtagggttccgtaacggggtcgtaccgggtccggtaaccgggtccggaccggttaccgtaccccggtccggtacccgttatccgttccccgtacccgttacccc

SEQ ID NO: 6915 - DNA, 840 bp, Homo sapiens
  misc_feature: GYAE6OF01BWTWU.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctcgccctgactcacgcctgcctcgtgtcgtcgggtctccgtggactagtcgatccgaccgtctcctgcctacgtaccggaacccgcgtaggtgagttcggtttacgggtaactttttaagtattggttccttacggttacggtaacctaaccttacccgtacccgaacggacccgaaaacccgacccccctaaactacctaactttaactttacgtacgggacggactaaccgtaacggcccggtacccgttcgggttacggggtttactacggtccgttcttccgtgtcggtcctacgtacgtcgtacgacaaccgtaccggtccctcccgcgtacctactcctacgtccgtacccttccgacgtccgtacggaacccggtacggacggtacttaacgtttaagttttacgttacgttcggtccttacggtaaccttcgtaattcgtacgtacctaaggttaaccgtttacgggtttaacgtttaaccgggtttacgggggtacggggttacccggggggaaccggggttaaacgggttacgggttaccgggttaaacccggtttacggggtaaccgggttaaccgaacccggttacccgggaaccgtaccccggttacccccggtccccgtttaccgggtacccgtttacccggttcccgttaacccccgttaccccccg

SEQ ID NO: 6916 - DNA, 728 bp, Homo sapiens
  misc_feature: GYAE6OF01BUBMF.23.71.G05.1.454.CMB.1.raw
  modified_base (117)..(117): a, c, t, g, unknown or other
  misc_feature (117)..(117): n is a, c, g, or t
  modified_base (244)..(244): a, c, t, g, unknown or other
  misc_feature (244)..(244): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctnactctcctcactcaggacacgacgggtcctcggggcccagtcctacgccccttagacctcagccctgccctcgtgtcctaggtctccgtgacagtcgatcaccgtctcctgccacgtacggaacccncgagtcgagttcggttaggtaacttttaagtagttggtactacggtagtaaccctaagtacccgtacccagggtaccaaaaccggaccccctaaaatcctaattaaccttttagtacggacggacctaacgtaaacggtcccggtacccgtacgtaacggggttttactaacggtccgtacgttcgtacgttcgccttaccgaaagttcgcgactaaaccgcccgtcctaccctgaccctaagtcctacgtacgcccttaccacggtcctaggaccgtaccgagtacctatagtttacgttattgccttacgtactactaagaccgttagacctaaggtaacgttacgttagttaacgtttgggacggttaccggggtaccgggaactaagggtccgtaaccggtcgggtaacgtaccgacggtaacccggaacggtcaacccgggttcccccgacgggttcctacgtccgttcggtacccccg

SEQ ID NO: 6917 - DNA, 793 bp, Homo sapiens
  misc_feature: GYAE6OF01ACN1E.23.71.G05.1.454.CMB.1.raw
  modified_base (452)..(452): a, c, t, g, unknown or other
  misc_feature (452)..(452): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacgaggtcctgggcccagtctgccctgactcagcctgcctccgtgtctgggtacctcctggacacgtcgatccaccgtctccgtgacacgtcggaacccccgtagtgattgggttaggtaactttttaatagtggtcttcggtcggtaccaataccctaccgaggtaccaaacgcccccgaaattacaacttacgtttagtcggacggtacaccgtaaacgccggtaccccgtacggtacggggtttctacggttccggtcctttccgtccgttcggtacccttacctaaacgtccgttacggaccgtaaacccnccgggtacccctcccgtagtaacctactcctccgttcgaccccgttactaccggaccttaggaccgtaaccggacgggtactaggttactttaagtttacgttcgtacgttaccgtacttctaacgtacttacggtctaaaccggtagtttaacgttaggtttaacccgggttagggttaccgggtttaccgggggaccggggggttaaaccgtaggggtacccggttaacccgggtaccggttaccgggttaaccgccgggttaacccgaaccgggttccctaacccgggttcccccgtaccggttaccgtaaccccttccgttccccgggttacccccg

SEQ ID NO: 6918 - DNA, 713 bp, Homo sapiens
  misc_feature: GYAE6OF01BNXND.23.71.G05.1.454.CMB.1.raw
  modified_base (236)..(236): a, c, t, g, unknown or other
  misc_feature (236)..(236): n is a, c, g, or t
  modified_base (333)..(333): a, c, t, g, unknown or other
  misc_feature (333)..(333): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgacgggtcctgggcccagtctcgccctgactcagcctgcctccgtgtcgtgggtctccgtggacagtcgatcaccgtctcctgctacgtcggaacccnacgtgtgttcggttaggtacttttaagtatcggtctcggtacggtaaccaactacctaccgaggaccaaaccgacccccaaatctaattactttagnggacggactacgacgccggacctcgtacgggtttctacgtcgctttcgtcgtcggacctacagttcgacggaccacgaccgtccctaccgtcgaacctgttcctacgtccgtccctccgacgtaccgtacgaccggtaacggtacggtacttacgttaacgtttacgttacgttcgtcgttcgtacgtacgtaagtctaacggacgtaacgttaagttaacggtttacggtttacggtttacgggtacggggttacggggtaccggggtaacgtaacggggttcggtaaccggttcggggtaacgtacggacggaccggtaccgtaccgtccggttaccccgttacgggttacctccggttacccgttcccggtcccccg

SEQ ID NO: 6919 - DNA, 657 bp, Homo sapiens
  misc_feature: GYAE6OF01E2BX6.23.71.G05.1.454.CMB.1.raw
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
  modified_base (514)..(514): a, c, t, g, unknown or other
  misc_feature (514)..(514): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccgcgagtgagttggttacgggtacttttaaagtagtggttccttcggtacggtaaccctaactaccctcccgaaggaccaaaaccgaccccccctaaaactccaatttaacttttagaggaacgggacctacgtaacggcccggtaccctcggtacgggtttctagtccgtcttctcgtgtcctacagtcnggacaaccgccggtccctcctcgtaccntcctcgtcgccctcgtacgcctagacgacgacgtctagtactttattacttgtctctctacatangactaaggtatacggttagttacgtttaggtacgggtcggggtacgggtaacgtaggttaccggtaccgttacggtcgtacgaccggccgtaacggtccgtacccgtccccgttacggtcctccgttcccgtcccgtcccccg

SEQ ID NO: 6920 - DNA, 744 bp, Homo sapiens
  misc_feature: GYAE6OF01B7ALB.23.71.G05.1.454.CMB.1.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtcctcgacccttgactcgacgcctggcctccgtgtcgtgggctccgtggacagtcgagtcaccgttcncgtgacacgtacggaaccgtnaagtgtagttggttacggttaacttttaaagtcgttcgggtccttacgggttacgttaacctaaaccgttacccgaccgtaacggaaacccaaacccgacccccctaaatccgttaattacgtttaagacggacggtacaacgtacggccgtacctaggtacgggtttcacgtcgtaccttgtcgtcgactacgtacgtcggtaacgacgaaaccgtccgtccctaaccgtacgaacctcgtccgtacgtcggtacccacgtaccgcgtcggaaaccggtcgtacggtacttaacgtagttttaactcgttacgcgtcgtacctatagttaacgtcaacgtaagttagtttacgtaacggttcggtttacggggaggggtttaccgggaccggggtaacgtacggttaccgtaaccgggtggttaaccggcgtaccccggtacggaccggtcccctaccggttcccgacgttacccgcttcccggttacccgtcccccg

SEQ ID NO: 6921 - DNA, 803 bp, Homo sapiens
  misc_feature: GYAE6OF01EWX5Q.23.71.G05.1.454.CMB.1.raw
  modified_base (121)..(121): a, c, t, g, unknown or other
  misc_feature (121)..(121): n is a, c, g, or t
  modified_base (474)..(474): a, c, t, g, unknown or other
  misc_feature (474)..(474): n is a, c, g, or t
  modified_base (557)..(557): a, c, t, g, unknown or other
  misc_feature (557)..(557): n is a, c, g, or t
  modified_base (789)..(789): a, c, t, g, unknown or other
  misc_feature (789)..(789): n is a, c, g, or t
tcagacgcgagtatcacgaccggtgctcgatttagtgtcgtcgcaagagagagggggggggtcacaagaggcagcgctctcgggacgtctccaccatggcctggctctgctgcctcctacnctctcctcactcagacgacgacggtccgttcgggaccctagtcgtccgtcccgtagaccgtcacgtccctcgtcccgttcgtcgtcggtcggtccgtcgtacgacgtacgtcgtactcctaccgttcctcctgccgtacggtacccgaccgtgtagtcgtagtttaggttaacgtttaactttatcgtcggttcgttacggtaaccgttaaacctacctcccgaccgaacgtaaccccgaacccgaacccctaaaactttcgttaacgtttacgttacggcgggaaccgtaactaaccggccggtcccggttcgttaccgggtagggtttacctcggtttcctccgtttaccncggttaacctaccgtaattccggtcctaaggaccctaacccgggtccctaacccgttccgtctaacccttgttcccgttaccncccggtaccctcccggttaccgtacccggtaacggaccgtacgggttacgttacgtttaacgtttaacgttgtttaccgtccgtgttctaccgttaattcgaccgtaagttacgaaacggtttactaaggtttccggttacggtttaggtcggggtaccggtacgggacgggttacgacggttcgtacggtcgttacgcgtacccgtcgcgtccccgtccggttccgcctcnccgtcccggtcccg

SEQ ID NO: 6922 - DNA, 792 bp, Homo sapiens
  misc_feature: GYAE6OF01A66IX.23.71.G05.1.454.CMB.1.raw
  modified_base (141)..(141): a, c, t, g, unknown or other
  misc_feature (141)..(141): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgngggtcctgggcccagtctcgccctgactcagcctgccctccgtgtcgttgggtcctccgtggactagtcgactccaccgtctccgtgccgtacgtccggaacccgcgtaggtcggtacgttggtttacgggttaacttttaagtacggttcgggtccttacgggttaccggtaaaccctaacgttaccccgtacccgaacgggaacctaaaaaccccgtacccccctaaaattccgtaactttaccgttttaacgacgggtaaccgggtcctaaaccggtaacgggtcccggtacccgttagggtaccggggttttactaccggtcgttcttaccgtcgtcggtacctacgtacggttcgtacggtaccgaaccggtccgtcccgtcccgtagtaacctcgtccgtccggtacgtccccgtacgtaccggtcctaacgggtaccgtacggtagtaccgttagtaactttagttccgtaggtctactcgtacgtatacgtcgaacgtagtagttaggtacgtttacgttagggtacggggtacggggtaccgggtagtacgggtcgtaacgggttcggtaacgtccgacggtcccggtacgtcccgtaccccgtccccggttagtacccttcggtcccgttcccgtaccccg

SEQ ID NO: 6923 - DNA, 650 bp, Homo sapiens
  misc_feature: GYAE6OF01A1VRL.23.71.G05.1.454.CMB.1.raw
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
tcagacgcgagtatcacgaccggtgctcgatttagtgtcgtcgcaagagagaggggggggtcacaagaggcagcgctctcgggacgtctccaaccatggcctgggctctgctgctcctcactctcctcactcaggacacgacgggtcctcggcccagtctgccctgactcacgcctcgcccgtccgtgtcgtggtctaccgtgacagtcgactccaccgtctcctgcactacggaccncagtnagtgttggtaactttaatntgtctcgtacgtaccatcccnccgagaccaaccgaccccaaatcctagttacttagnggacggcacgtacgccgtcctcgtacggttacncgtctcttctcgtcgctaccgagtctcggactaacgccgtccctaccgataacctctccgtctccgaccgtccacggtcccgtaagccggacgtacgcttaacgtatttacttcgtacgcctcgtactaactagtaagtcagtaattagtacgtttacgttaggttacggttagggccggggtaaccgggacgttacgggacgttaccggtacggtacggtacccacgggtaccctaaccgcccggttacccctccccgggttactaacccgtccgtttccctcccggttaaaccccc

SEQ ID NO: 6924 - DNA, 807 bp, Homo sapiens
  misc_feature: GYAE6OF01EOJXC.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcaactcaggacacaggtcctgggcccagtctgccctgactcagcctcgtccctccgtgtcgtgggtctcctggacagtcgatccaccgtctcctgccaccgtacggaacccgcagtgtagttggttagggttaacttttaagtagttcggtccgttcggttacggtaaccctaaacgttacccctacccgtaaggtaacctaaaacccggtaccccccctaaaacttccgtaacttttaaccgttttaagtacgggtaacgggtacctaaccgttaacggtcccggtaccccgttacgggttacgggtttactacggttccgtctttccgtcgtccggtccttaccgtaacggttccgtacggaccaaccgtccggtccccttcccgacgtaccctacttccgtcgtaccggtcccctacgaccggtccgttacggaacccggacggtacggtactttacggtaacttttacgttacggtttcgtcgttcgtaccttagtacggttattcggaaagtacgttaaccgttaggtttacggttttacggttacgggtaccgggggttacggggtacccgggaacgttacggtcgggttacccgttagggtaccgtacgaccgcccggtacgtcccgtccccggcccggttacgtaccgttaccttccgtccccggtaccccg

SEQ ID NO: 6925 - DNA, 739 bp, Homo sapiens
  misc_feature: GYAE6OF01CQG4N.23.71.G05.1.454.CMB.1.raw
  modified_base (208)..(208): a, c, t, g, unknown or other
  misc_feature (208)..(208): n is a, c, g, or t
  modified_base (491)..(491): a, c, t, g, unknown or other
  misc_feature (491)..(491): n is a, c, g, or t
tcagacgcgagtatcacgaccggtgctcgatttagtgtcgtcgcaagagagagggggggtcacaagaggcagcgctcgtcgggacgtcctccaccatggcctgggctctgctgctcctcactcctcctcaactcacggacacgacgggtcctaggcccagtctcgaccctcgactcgagcctcgcctcgtgtctcggtctccgtgacngtcgatcgaccgtctctcgcacgtacggacccgtgagtagtagtcggttaggtacttttaagtgttcgtacgtacgtacgtaacctaacttacccgaccgagaacccaaacccgacccctaaaacgtctaatttaaccgtttagcggaacgacctaacgttaccggccggtacccttaggtacggtttacgacgttcgtcctttacgcgtacggcctacgtagtccgtacgcgaaccgtccggcccttaccgacgaaccttcttcctacgtccaccgtacccncgtaccgtacgaaaccggtcgtaacgtacgttaagtactttacgtttaacgtcggtacctcggtaccttacgtaactcgtacgagtaaaccgttacgttaagtttaaccggttgttaaccggggtaggggttacccgggtaacggggtaaccggtacgggttaacccggtaccggttacggtaacgggtcgtaacggcccgtacgggtcctcccgtacgtacctcgtaccgtcccgttcccgtacccc

SEQ ID NO: 6926 - DNA, 509 bp, Homo sapiens
  misc_feature: GYAE6OF02IVDRE.23.71.G05.1.454.CMB.1.raw
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatactttatgaggcactaagcgccctcaggggtttctagtcgcttctctggctccaagtctggcaacacggcctccctgacccatcctctggcctccagcctgacgacgaggctgattattattgctgctcatatgcagatagtatactttgaggttcggcggggacaggtgaccgtggtaggtcagcccaaggctcgcccctggcactctcgtccc

SEQ ID NO: 6927 - DNA, 509 bp, Homo sapiens
  misc_feature: GYAE6OF02HXKZV.23.71.G05.1.454.CMB.1.raw
tcagacgcgagtatcacgaccggtgctcgatttagtgtcgtcgcaagagagaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaaactcatactttatgagggcactaagcggccctcaggggtttctagtcgcttctctggctcaagtctggcaacacggcctccctgaccatctctggcctccagcctgacgacgaggctgattattattgctgctcatatgcagatagtagtactttgaggttcggcggggacaggtgacgtcgtaggtcagccaagctcgccccgtcgtcactctgtccc

SEQ ID NO: 6928 - DNA, 516 bp, Homo sapiens
  misc_feature: GYAE6OF02G0G89.23.71.G05.1.454.CMB.1.raw
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaactcatactttatgaggcactaagcggccctcaggggtttctagtcgcttctctggctccaagtctggcaacacggcctccctgaccatctctggcctccagcctgacgacgagctgattattattgctgctcatatgcagatagtagttactttgaggttcggcgggggaccaagggtgaccgtgtaggtcagccaaggctcgcccctggtcacgtctcgtcccc

SEQ ID NO: 6929 - DNA, 518 bp, Homo sapiens
  misc_feature: GYAE6OF02FVIPZ.23.71.G05.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
tcagacgcgagtatcacgaccggtgctcgatttagtgtcgtcgcaagagagaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaatcatactttangagggcactaagcggccctnaggggtttcagtcgcttctctggctccaagtctggcaacacggcctccctgacccatcctctggcctccagcctgacgacgagctgattattattgctgctcatatgcagatagtagtactttgaggttcggcgggggacaagggtgaccggtcgtaggtcaggcccaaggctcgcccctcggtcactctgttcccc

SEQ ID NO: 6930 - DNA, 548 bp, Homo sapiens
  misc_feature: GYAE6OF02I3HTY.23.71.G05.1.454.CMB.1.raw
  modified_base (363)..(363): a, c, t, g, unknown or other
  misc_feature (363)..(363): n is a, c, g, or t
tcagacgcgagtatcacgaccggtgctcgatttagtgtcgtcgcaagagagagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaatcatacttatgaggcactaagccggccctcaggggtttctagtcgcttctctggctccaagtctggcaacncggcctcctgaccatctctggcctccagcctgacgacgagctgattatattgctgctcatatgcagatagtacgttactttgaggtttcgggacgggggtaccaagggtcgaccggttcggtaagggtcctacggccctaacgggtcctcgcccccgttcggtccaccgttcgtccgttcccccg

SEQ ID NO: 6931 - DNA, 516 bp, Homo sapiens
  misc_feature: GYAE6OF02IPVO1.23.71.G05.1.454.CMB.1.raw
  modified_base (388)..(388): a, c, t, g, unknown or other
  misc_feature (388)..(388): n is a, c, g, or t
tcagacgcgagtatcacgaccggtgctcgatttagtgtcgtcgcaagagagagggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagccccaaactcatacttatgaggcactaagcggccctcaggggtttctagtcgcttctctggctccaagtctggcaacacggcctccctgaccatctctggcctccancctgacgacgaggctgacttattattgtctgcttcatatgcagatagtagtactttagaggttcgcgggggacaaggtgaccgtcggtaggtcagccaagctcgcccctccggtcactctgttacccc

SEQ ID NO: 6932 - DNA, 529 bp, Homo sapiens
  misc_feature: GYAE6OF02H4Z0C.23.71.G05.1.454.CMB.1.raw
  modified_base (418)..(418): a, c, t, g, unknown or other
  misc_feature (418)..(418): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagccccaaatcatactttatgaggcactaagcggccctcaggggtttctagtcgcttctctggctcagtctggcaacacggcctcctgaccatctctgcctccacgcctgacgacgaggctgattattattgctgctnatatgcagatagtagttactttgagggttcggcgggggtacaagggtcgaccggtcggtaggtcgagcccgaaggcctcgccccgtcggtcctacttccgtcgttcccccg

SEQ ID NO: 6933 - DNA, 543 bp, Homo sapiens
  misc_feature: GYAE6OF02HXWFD.23.71.G05.1.454.CMB.1.raw
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaactcatactttatgaggcactaagcgccctcaggggtttctagtcgcttctctggctccaagtctggcaacacggcctccctgaccatctctcggcctccagcctgacgacgaggctgattattattgctgctcatatgcagatagtagtactttgagggttcggacgggggaccaagggtcgaccggtcggtaggtccgacggcccgaaggccgtccggcccccgtcggtccaccgttccgtcgttcccccg

SEQ ID NO: 6934 - DNA, 559 bp, Homo sapiens
  misc_feature: GYAE6OF02JOALR.23.71.G05.1.454.CMB.1.raw
  modified_base (340)..(340): a, c, t, g, unknown or other
  misc_feature (340)..(340): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaactcatacttatgaggcactaagcgccctcgaggggtttcagtcgcttcnctggctccaagtctggcaacgacgcctcctgaccatctctcggcctccagcctgacgacgaggctagtattattagttgcttgctcatatgctagatagttagttactttggaggttcgggacgggggtacctaagggtcgaaccggtcggtaacggtcacggtacccgaaggtccgtccggtaccccctcggtacctaccgttccgttcgttcccccg

SEQ ID NO: 6935 - DNA, 521 bp, Homo sapiens
  misc_feature: GYAE6OF02HUURR.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaatcatactttatgagggcactaagcggccctcaggggtttctagtcgcttctctggctccaagtctggcaacacggcctccctgaccatctctcggcctccagcctgacgacgaggctgattatattgctgctcatatgcagatagtagtactttgaggttcggcggggtacaagggtgaccgtcggtggtcagccctaaggcctcgcccctggtccactctcgttcccc

SEQ ID NO: 6936 - DNA, 546 bp, Homo sapiens
  misc_feature: GYAE6OF02G0ZY0.23.71.G05.1.454.CMB.1.raw
  modified_base (363)..(363): a, c, t, g, unknown or other
  misc_feature (363)..(363): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaactcatacttatgaggcactaagcggccctgaggggtttctagtcgcttctctggctccaagtctggcaacncggcctccctgaccctatcctctcggccctccagtcctgaccgacgaggctgattattattgcttgctcatatgcagattagtagttactttggagggttcgggcgggggacaagggtcgaccggtcggtaggtcgacgcccgaaggtcctccggcccctcggtccacttccgtcgttccccg

SEQ ID NO: 6937 - DNA, 548 bp, Homo sapiens
  misc_feature: GYAE6OF02IJKHD.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggtacttttaatatggtctcgtggtaccaatacctccaggcaaagcccccaaactcatactttatgaggcactaagcgccctcagggtttctagtcgcttctctgctcaagtctggcacacggcctccctgaccatctctcgcctccacgcctgacgacgacggctgattattattgctgctcatatgcagatagtagttacgtttgtgggttcggcgggggtaccgaaggtcgaaccggttcggtaggtccacggacccgaaggccgtcgcccccgtcggtacctaccgttccgtcgttaccccccg

SEQ ID NO: 6938 - DNA, 523 bp, Homo sapiens
  misc_feature: GYAE6OF02GB39W.23.71.G05.1.454.CMB.1.raw
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttatgaggcactaagcggccctcgaggggtttctagtcgcttctctggctccaagtctggcaacacgctccctcgaccactctctcgcctccagcctgacgacgagctgtattattattgctgctcatatgcagatagtagttacgtttgaggttcggcgggggacgaggtcgacggtcgtaggtcacgccgtaggctcgcccctcggtccacgtctcgttaccccg

SEQ ID NO: 6939 - DNA, 579 bp, Homo sapiens
  misc_feature: GYAE6OF02H7CV8.23.71.G05.1.454.CMB.1.raw
  modified_base (228)..(228): a, c, t, g, unknown or other
  misc_feature (228)..(228): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatggttggacttttaatatggtctcgtgtaccaatcctccaggcaaacgccccaaactcattacttatgaggacactaagcgccctgagggtttctagtcgcttctcgtggcctcgaagtctggccaacacggcctaccctgaccatctcgtcgcctccacgcctcgacgacgacggtctagtattattatcgtctgctcatactgactagtatagttagttacgtttggtacgggttcgggaccgggggtacgtaacgggttcgtaccggttcggtacggtacacggtacccgaacggtccgtaccggtccccgtcggtacctaccgttccgtccgttacccccg

SEQ ID NO: 6940 - DNA, 516 bp, Homo sapiens
  misc_feature: GYAE6OF02JWJUC.23.71.G05.1.454.CMB.1.raw
  modified_base (318)..(318): a, c, t, g, unknown or other
  misc_feature (318)..(318): n is a, c, g, or t
tcagacgcgagtatcacgaccggtgctcgatttagtgtcgtcgcaagagagaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagccccaaatcatacttatgaggcactaagcggccctnaggggtttcagtcgcttctctggctccaagtctggcaacacggcctccctgaccatctctggcctccagcctagacgacgagctgattattattgctgctcatatgcagattagtagttactttgacggttcgggacggggtacagggtcgtaccggtcgtaggtcaggcccaaggctcgccctgctactctgtcccc

SEQ ID NO: 6941 - DNA, 523 bp, Homo sapiens
  misc_feature: GYAE6OF02G6LEF.23.71.G05.1.454.CMB.1.raw
  modified_base (511)..(511): a, c, t, g, unknown or other
  misc_feature (511)..(511): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttatgaggcactaagcggcctcaggggtttctagtcgcttctctggctccaagtctggcaacacggcctccctgaccatctctcggccctccacgcctgaccgacgaggctagattattattgctgctcatatgcagtatagtagtactttgaggttcggcgggggtacagggtcgaccgtggtaggtcacgccaggctcgccccgtcggtccnctctcgtccccg

SEQ ID NO: 6942 - DNA, 509 bp, Homo sapiens
  misc_feature: GYAE6OF02GE7W7.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatgttgggacttttaatatggtctcgtggtaccaatacctccaggcaaagcccccaaatcatactttatgaggcactaagcggccctcaggggtttctagtcgcttctctggctccaagtctggcaacacggcctccctgaccatctctcggcctccagcctgacgacgaggctgattattattgctgctcatatgcagatagtagtactttgaggttcggcggggacaggtgacgtcgtaggtcagcccaaggctcgccctgcactctcgtccc

SEQ ID NO: 6943 - DNA, 530 bp, Homo sapiens
  misc_feature: GYAE6OF02GWQYE.23.71.G05.1.454.CMB.1.raw
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttangaggcactaagcgccctnaggggtttcagtcgcttctctggctccaagtctggcaacacggcctccctgacccatctctcggcctccagcctgacgacgagctgattattattgctgctcatatgcagatagtagttactttgacgggttcggcgggggacaagggtcgaccggtcggtaggtcacggcccgaaggtccgtcgccccgtggtccacgtcgtcgttcccc

SEQ ID NO: 6944 - DNA, 527 bp, Homo sapiens
  misc_feature: GYAE6OF02HID4J.23.71.G05.1.454.CMB.1.raw
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactggaacccgcagtgatgttgggacttttaatatggtctcgtggtaccaatacctcccaggcaaagccccaaactcatacttatgaggcactaagcggccctcgaggggtttctagtcgcttctctggctcaagtctggcaacacggcctccctgaccatctctgcctccagcctgacgacgaggctgattattattgctgctcatatgcagatagtagtactttgaggttcgggacgggggacctagggtcgaccgtcggtaggtcacgcccgaaggcgtcgcccccgtcggtccaccttctcgttcccc

SEQ ID NO: 6945 - DNA, 525 bp, Homo sapiens
  misc_feature: GYAE6OF02IQIFS.23.71.G05.1.454.CMB.1.raw
  modified_base (364)..(364): a, c, t, g, unknown or other
  misc_feature (364)..(364): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaatcatactttatgaggcactaagcggccctcaggggtttctagtcgcttctctggctccaagtctggcaacncggcctccctgaccatctctcggccctccacgcctgaccgacgaggctgattattattgcttgctcatatgcagatagtagttactttgagggttcggcgggggacagggtcgaccgtggtaggtcaggcccaggcctcgcccctggccactctcgtcccc

SEQ ID NO: 6946 - DNA, 610 bp, Homo sapiens
  misc_feature: GYAE6OF02IYP0Q.23.71.G05.1.454.CMB.1.raw
  modified_base (307)..(307): a, c, t, g, unknown or other
  misc_feature (307)..(307): n is a, c, g, or t
  modified_base (379)..(379): a, c, t, g, unknown or other
  misc_feature (379)..(379): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatggttgggtacttttaatatggtctcgtggtaccaatacctcccaggcaaacgcccccaaactcatacttangagggcactaagccggccctcgaggggtttctagtcgcttctctggctccaagtctggcaacacggcctccngaccatctctcggcctccacgcctgacgacgagctgattattattgctgctcatatgcagtattacgtaagttacgtttggtaacgggtttccggggacgggggggtaacctaaggggttcggtaacccgggttccgggttaagggttaccgaccgggtaccccgtaaggggtcccttacccgggtccccccgttcgggtacccaccgtttcccgttccggttccccccgg

SEQ ID NO: 6947 - DNA, 592 bp, Homo sapiens
  misc_feature: GYAE6OF02HW2T4.23.71.G05.1.454.CMB.1.raw
  modified_base (215)..(215): a, c, t, g, unknown or other
  misc_feature (215)..(215): n is a, c, g, or t
tcagacgcgagtatcacgaccggtgctcgatttagtgtcgtcgcaagagagagggggggtcggacgaagaggcgagcgcgtctcgggacgtcgtccaccatggcctgggctctgctgctcctcactctcctcactcaagacacaggtcctgggcccagtctgccctgactcagcctgcctccgtgtctgggtctcctggacagtcgatcaccgtntcctgcactggaacccgcagtgatgttgggacttttaatatggtctcgtggtaccaatacctccaggcaaacgccccaaactcactacttatgaggcactaagcgcctcagggtttctagtcgcttctctggctccaagtctgggtcaacacggtccctccctgaccatcgtctggcctccacgtcctgaccgacgacggctaggacttattattcggtctgtcttcatatcgacgtactagtagtagttaactttgtacgggttcgggacgggggtaccaagggtacggaccggttacggtaggtaccgtgaccccgtaaggccgtttaccggcccccgttcggttacccggaccttaccgttccgttaccccccg

SEQ ID NO: 6948 - DNA, 562 bp, Homo sapiens
  misc_feature: GYAE6OF02IONNF.23.71.G05.1.454.CMB.1.raw
  modified_base (366)..(366): a, c, t, g, unknown or other
  misc_feature (366)..(366): n is a, c, g, or t
  modified_base (429)..(429): a, c, t, g, unknown or other
  misc_feature (429)..(429): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaactcatactttatgaggcactaagccggccctcgaggggtttctagtcgcttctctggctccagtctggacaacncgcctcctgaccatcctctcggcctccagcctgaccgacgaggctgattattattgcttgctnatattgactagatagttattacgtttagacgggttcgggacgggggtaccgtaagggtcgtaccggtcggtaaggtccgacggtcccgaaggcctccggtccccgtcggtaccaccgttccgtcgttaccccc

SEQ ID NO: 6949 - DNA, 544 bp, Homo sapiens
  misc_feature: GYAE6OF02G6R9D.23.71.G05.1.454.CMB.1.raw
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagacgcgagtatcacgaccggtgctcgatttagtgtcgtcgcaagagagagggggggggtcacaagaggcagcgctctcgagacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaactcatactttatgaggcactaagccgccctcaggggtttctagtcgcttctctggctcagtctggcacncgcctccngaccntctctggcctccagcctgacgacgaggctgattattatgctgctcatatgcagattagtagttactttggacgggttcgggacgggggtaccagggtcggtaccggtcggttaggtcgacgacccgaagggtcctcggccccccgttcggtcctaccgtccgttacccg

SEQ ID NO: 6950 - DNA, 546 bp, Homo sapiens
  misc_feature: GYAE6OF02H6PNL.23.71.G05.1.454.CMB.1.raw
  modified_base (127)..(127): a, c, t, g, unknown or other
  misc_feature (127)..(127): n is a, c, g, or t
  modified_base (250)..(250): a, c, t, g, unknown or other
  misc_feature (250)..(250): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctnactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctcccaggcaaagcccccaaatcatactttatgaggcactaagcggccctgaggggtttcagtcgcttctctggctcaagtctggcaacacggcctcctgaccatctctggcctccacgcctgacgacgagctgattattattgtctgctcatatgcagatagttagtactttgtaggttcgggacgggggacgtaagggtgtaccggtacggtacggtaccgacggtcccgaaggccgtcggccccgtcggtcctacgttccgttcgttccccg

SEQ ID NO: 6951 - DNA, 617 bp, Homo sapiens
  misc_feature: GYAE6OF02G0IYV.23.71.G05.1.454.CMB.1.raw
  modified_base (303)..(303): a, c, t, g, unknown or other
  misc_feature (303)..(303): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaactcatacttangaggcactaagcggccctgaggggtttctagtcgcttctctggctccaagtctggcaacacggcctccctgaccatctctcggcccctcgacgcctacgaccgacggacgtctagtaatttattagttcgcttcgtctactatagtcgactaagtagttagttaacgtttacgtttagggtacggggttccggggaaccgggggtaacgtaagggtccggtaccggttacggtacgggtaccgaccggacccggtaacggtccgtacccggtcccccggttcggtaccctaccgttccgttacccgttaccccc

SEQ ID NO: 6952 - DNA, 542 bp, Homo sapiens
  misc_feature: GYAE6OF02H64MV.23.71.G05.1.454.CMB.1.raw
  modified_base (358)..(358): a, c, t, g, unknown or other
  misc_feature (358)..(358): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggacaaagcccccaaaatcattactttatgaggcactaagcggccctgaggggtttctagtcgcttctctggctcaagtcnggcaacacggcctcctgaccatctctggcctccacgcctgacgacgagctgtattattattgctgctacatatgcagtactagtagttactttggagggttcgggacgggggtacaaggtcgtaccggtacggtacggtcagcccgaaggcctcgccccgtcggtccacttccgtcgttccccg

SEQ ID NO: 6953 - DNA, 562 bp, Homo sapiens
  misc_feature: GYAE6OF02JH20P.23.71.G05.1.454.CMB.1.raw
tcagacgcgagtatcacgaccggtgctcgatttagtgtcgtcgcaagagagagggggggtcggacgaagaggcagcgctctcgggacggtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaactcatacttatgaggcactaagcggccctcaggggtttcagtcgcttctctggctccaagtctggcaacacggcctccctgaccatctctcggcctccagcctgacgacgaggctgatttattattgctgctctatatgcagattagtagttactttgaggtttcgggacgggggtacctaaggtcggaccgtcggttacggtccacggccccgaagggtcctacggccccccctagggttccaacccttcgtcccggtttaccccc

SEQ ID NO: 6954 - DNA, 532 bp, Homo sapiens
  misc_feature: GYAE6OF02I2W7O.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatgttgggacttttaatatggtctcgtggtaccaatacctccaggcaaagccccaaactcatactttatgagggcactaagcggccctcgaggggtttctagtcgcttctctggctccaagtctggcaacacggcctccctgacccatcctctcggccctccacgcctgacgacgagggctgattattattgcttgctcatatgcagatagtagttactttggaggttcggcgggggacaggtgacggtcggtaggtcacgcccgaaggctcgccccgtcggtcacctctcgttcccc

SEQ ID NO: 6955 - DNA, 576 bp, Homo sapiens
  misc_feature: GYAE6OF02GFMIP.23.71.G05.1.454.CMB.1.raw
  modified_base (308)..(308): a, c, t, g, unknown or other
  misc_feature (308)..(308): n is a, c, g, or t
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttgggtacttttaatatggtctcgtggtaccaattacctcccaggcaaacgcccccaaactcatactttangaggcactaagcgccctgagggtttctagtcgcttctctggctcaagtctggacaacacggcctcctgaccatcctctcggccctcagcctgacgacgngctagattattntgctgctctatntgacagtagttagttagttacgtttgggacgggttccggggacgggggaactagggttcggtaccggttcggtaacggtccgaacggtaccccgaaggtcccgtccgcccccgttcggtacctaccgttccgtaccgttcccccg

SEQ ID NO: 6956 - DNA, 563 bp, Homo sapiens
  misc_feature: GYAE6OF02IDX5Y.23.71.G05.1.454.CMB.1.raw
  modified_base (302)..(302): a, c, t, g, unknown or other
  misc_feature (302)..(302): n is a, c, g, or t
  modified_base (354)..(354): a, c, t, g, unknown or other
  misc_feature (354)..(354): n is a, c, g, or t
  modified_base (439)..(439): a, c, t, g, unknown or other
  misc_feature (439)..(439): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtgtaccaatacctccaggcaaacgcccccaaatcatactttangaggcactaagccgccctgtaggggtttctagtcgcttctctggctcagtcnggcaacgacgccctccctgaccctatctcgtcggccctccgacgtcctaggaccgacgacggtctgtatttattattgctgcctnatatgacagtatagttagtacgtttgacgggttcgggacggggtacgaggtcgtaccggttcggtaaggtccacggacccgacggtccgtccgccccgtcggtcctacgtccgtcgttcccccg

SEQ ID NO: 6957 - DNA, 598 bp, Homo sapiens
  misc_feature: GYAE6OF02JDHI2.23.71.G05.1.454.CMB.1.raw
  modified_base (250)..(250): a, c, t, g, unknown or other
  misc_feature (250)..(250): n is a, c, g, or t
  modified_base (333)..(333): a, c, t, g, unknown or other
  misc_feature (333)..(333): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggacttttaantggtctcgtggtaccaatacctccaggcaaacgccccaaatcatacttatgaggcactaagcggccctgaggggtttcagtcncttctctggctaccaagtctaggctaaacgaccggtccctccgtagaccctatcctcgtcggccctccacgccttcgacgtacgacggtctagtacgtttattacttgcttgcctctatacttcgactagtaacgtagttacgttacgtttagtacgggttcgggtaccgggggactaagggttcgtaccggttacggtacggtacacggaccgtaacggtcctccggccccgtaccggtccgtacgttccgtaccgttaccccg

SEQ ID NO: 6958 - DNA, 533 bp, Homo sapiens
  misc_feature: GYAE6OF02GM5G9.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaactcatactttatgaggcactaagcggccctcaggggtttctagtcgcttctctggctcaagtctggcaacacggcctccctgacccatctctggcctcagcctgacgacgaggctgattattattgctgctcatatgcagatagtagtactttgaggttcgggcggggaccagggtcgaccggtcggtaggtccaggcccgaaggtcctcgcccccgttggtccaccgttctcgttcccccg

SEQ ID NO: 6959 - DNA, 554 bp, Homo sapiens
  misc_feature: GYAE6OF02IKHSR.23.71.G05.1.454.CMB.1.raw
  modified_base (346)..(346): a, c, t, g, unknown or other
  misc_feature (346)..(346): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaacgcccccaaactcatactttatgaggcactaagccggcctcgaggggtttctagtcgcttcnctggctcaagtctggcaacgacggcctccctgaccatctctcggcctccagcctgacgacgaggctgtattattattgctgctcatatgcagtattagtagttactttggtagggttcgggacgggggtacctaagggtcgaccggtggtacggtccacggacccaaggcctcggcccccgttggtcccacgttccgtcgttcccccg

SEQ ID NO: 6960 - DNA, 554 bp, Homo sapiens
  misc_feature: GYAE6OF02ISOHI.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccgcagtgatgttgggacttttaatatggtctcgtggtaccaatacctccaggcaaaagccccaaaactcatacttatgaggcactaagcggcctcagggtttcagtcgcttctctggctaccaagtctaggcaaacgacggctaccctgacccatctcgtcgcctccagcctgacgagagctgattatattgctgctcatatgcagatagtagtactttgacggttcggcgggggacctaaggtcgaccggtaggtacggttacacggtcccgaaacggtcctacggtccccccgtcggttaccgtaaccttcgtacgtttccccccgg

SEQ ID NO: 6961 - DNA, 608 bp, Homo sapiens
  misc_feature: GYAE6OF02IEZQ3.23.71.G05.1.454.CMB.1.raw
  modified_base (257)..(257): a, c, t, g, unknown or other
  misc_feature (257)..(257): n is a, c, g, or t
  modified_base (314)..(314): a, c, t, g, unknown or other
  misc_feature (314)..(314): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
tcagacgcgagtatcacgaccggtgctcgatttagtgtcgtcgcaagagagagggggggtcgacgaagaggcagcgctctcgggacgtctccaccactggcctgggctctgctgctcctcactctcctcactcaggacacagggtcctgggcccagtctgccctgactcagcctgcctccgtgtctgggtctcctggacagtcgatcaccgtctcctgcactcggaaccgcagttgattggttgggtacttttaatntggtctcgttggtaccaatcctccgagaccaaacgtccccaaactcattacctttanggacggaccactaacgcggtccctgaggggtttctaaggtcgtcttctctggcctaccagtctggcaaacncggccctcccgtanacccgattctccgtacgtcctcctacgtcctacgaccgagacggctgtattatacttagctacgtctactatatgactagaagttagtaagttactttagggtacgggttggaccgggggtacaagggtcgaccggtcgtaagggtaccacggtccgtaacggccgttaccggccccgttacggtccgtaccgttcctcgttacccccg

SEQ ID NO: 6962 - DNA, 705 bp, Homo sapiens
  misc_feature: GYAE6OF02G95AU.23.71.G05.1.454.CMB.1.raw
  modified_base (228)..(228): a, c, t, g, unknown or other
  misc_feature (228)..(228): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccncagtgatggttgggtaacttttaatagttggtctcggtacggtaaccaattaccctccgaggaccaaaccgacccccaaaactcaacttactttatggacgggacctaacgtaacggccggtcccttacgtacgggggttttcctaggtccgtctttctcgtcggtcctaccgaacgttcgtcggaccaaaccgtaccggtccccttccccgtacgaccctacttccttcgttcggccctccacgccctacggaccggacgacggtctaggtaatttagttacgttcgtaccttgtcctctattagtgactagtataacggttagttacgttttaggtacgggttaccggggtacgggggtaaccgtaagggttacggtaccggttacggttacgggtaccgacggtacccgtaagggtccgttaccgggtcccccgttacggttacccgtaccgttccgttccggtttaccccccg

SEQ ID NO: 6963 - DNA, 537 bp, Homo sapiens
  misc_feature: GYAE6OF02GSW0S.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaactcatactttatgaggcactaagcggcctcaggggtttcagtcgcttctctggctcaagtctggcaacgacggcctccctgaccatcctctcggcctccagcctgacgacgagctgattattattgctgctcatatgcagtactagtagttacgtttgagggttcgggacgggggaccaggtcgacgtcggtaggtcacggcccgtaaggcctccggccccgtggtcacgttcctcgttacccc

SEQ ID NO: 6964 - DNA, 551 bp, Homo sapiens
  misc_feature: GYAE6OF02J14JP.23.71.G05.1.454.CMB.1.raw
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccagacaaacgccccccaaaactcatacctttatgaggcactaagcggccctnaggggtttcagtcgcttctctggctccaagtctggcacncgcctccngaccatctctcggcctccagcctcgacgacgngctgattatattgctgcctnatatgcagatagtagttactttggacggtttccgggagggggtacctagggtcgaccgttcggtacggtcgacggacccgaggaccgtcgtcccccgtcggtaccacgttcctcgttacccccg

SEQ ID NO: 6965 - DNA, 525 bp, Homo sapiens
  misc_feature: GYAE6OF02FIYUW.23.71.G05.1.454.CMB.1.raw
  modified_base (300)..(300): a, c, t, g, unknown or other
  misc_feature (300)..(300): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttangaggcactaagcggccctcaggggtttcagtcgcttctctggctccaagtctggcaacacggcctccctgacccatctctggcctccagcctgacgacgaggctgattattattgcttgctcatatgcagatagtagtactttgaggtttcggcgggggaccaagggtgaccggtcggtaggtcacggcccgaaggcctcgccccctggtccactctcgttcccc

SEQ ID NO: 6966 - DNA, 609 bp, Homo sapiens
  misc_feature: GYAE6OF02I4VRK.23.71.G05.1.454.CMB.1.raw
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
  modified_base (529)..(529): a, c, t, g, unknown or other
  misc_feature (529)..(529): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatggttggacttttaatatggtctcgtgtaccaatactccaggacaaacgccccaaatcatacttangaggcactaagcgcctcgtagggttctagtctcttctctgctcagtcgtgacaacacgtcctcctagaccatcctcgtcgccctcgtacgcctacgacgacgacgtctagtattattagttcgtacgtcgtactacgtatacgtagactagtaagtagtaacgttacgtttagtacggggttaccgggaaccgggggtaacgtaacgggtacgtaccggttacggtacngggttacccaaagggtcccctaaaggggtcccccttaagggtcccccttaacgggtcccttacggttccccttaacccgg

SEQ ID NO: 6967 - DNA, 582 bp, Homo sapiens
  misc_feature: GYAE6OF02IXQ33.23.71.G05.1.454.CMB.1.raw
  modified_base (372)..(372): a, c, t, g, unknown or other
  misc_feature (372)..(372): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggactttaatatggtctcgtggtaccaatacctcccaggcaaagcccccaaactcatactttatgagggcactaagcggccctgagggtttctagtcgtcttctctggctcaagtctggcaacgcgcctccngaccatcctctggccctccacgcctgaccgacgaggctgactttattattgctgctcatatgctagattagttagttacgtttgtagggttcggacgggggtacctaaggggtcgacccgggttacggtacgggtaccgacggtaccccgtaagggtcccgtacggtaccccccgttcggttaccacccgttccgtaccgttaccccccg

SEQ ID NO: 6968 - DNA, 686 bp, Homo sapiens
  misc_feature: GYAE6OF02IYSRX.23.71.G05.1.454.CMB.1.raw
  modified_base (234)..(234): a, c, t, g, unknown or other
  misc_feature (234)..(234): n is a, c, g, or t
  modified_base (313)..(313): a, c, t, g, unknown or other
  misc_feature (313)..(313): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatccaccgtctcctgcacgtcggaacccgnagtgatggttggtactttaatagtggtctcgtggtaccaactacctcccaggcaaacgccccaaactctaattacttanggagggcaacgtacgccgtccctgtacgggtttctagtcgtcttctcgtcggctaccgaagtctcggacaaacgccggtcctccctcggaccctagttcctacgtcgggacccctaccgacgtccctacggaaccggacggacgggtctaggttaactttagtttaacgttcgtcttcgtaccttactaatatcggactaagtacgttagttaacggtttacgtttgggtacgggttccggggaaccgggggtacgaaagggttccgggtaccggttacgggtacggtaccggaccggtaacccgtaacgggtcccgtacccggtcccccggttacggtaccctacccgtttaccggtcccgttaccccccgg

SEQ ID NO: 6969 - DNA, 576 bp, Homo sapiens
  misc_feature: GYAE6OF02GH1H0.23.71.G05.1.454.CMB.1.raw
  modified_base (250)..(250): a, c, t, g, unknown or other
  misc_feature (250)..(250): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctccaggcaaacgcccccaaactcatactttatgaggcactaagcggccctcgagggtttctagtcgcttctctggctccaagtctggcaacacggcctccctgacctactcctcgtcggccctccacgtccctggaccgtacgaggcttgatttattattgcttgcctcatagtgactagtataagtagtttacgtttggagggttcgggacgggggaacctaagggtcgtaccggtcggtaggtcgacggcccgaaggtccgtccggcccccgtcggtcctaccgttccgttccgttcccccg

SEQ ID NO: 6970 - DNA, 766 bp, Homo sapiens
  misc_feature: GYAE6OF02HA886.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgagttggttagggttaacttttaatagttcggttctcggtacggtaaccaacttaccctccgacggacaaaccgacccccctaaactcctaacttacttttagtacggacgggacctaacgttaacggttccggaccccttacggttacggggttttctacggttccgtcgtttcctcgtcggtaccttaccgtaacggttccgtacgggaccaaaccggtaccggtccccttacccgtaccgtaaccctacttcccgtccggtccggtcccctacccgtaccggtcccgtacgggaacccggtaaccgggacggttaccgttacggttaactttttagttacgtttacgtccgttacgtccttacgtaattacgttcgacgtaaggtacgtttagttacggtttacgttgggtacggggttaccgggaccgggggacgtaagggtccggtaccggtacggtacggtacgacggtacccgaacggtcccgtcccggtcccggttcgtacctaccgttccgttcccgtccccg

SEQ ID NO: 6971 - DNA, 533 bp, Homo sapiens
  misc_feature: GYAE6OF02F7EH2.23.71.G05.1.454.CMB.1.raw
  modified_base (426)..(426): a, c, t, g, unknown or other
  misc_feature (426)..(426): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttatgagggcactaagcggccctcaggggtttctagtcgcttctctggctccaagtctggcaacacggcctccctgaccatctctggcctccagcctgacgacgaggctgattattattgctgctcatntgcagatagtagtactttgaggttcggcgggggtacaagggtcgaccgtcggtaggtcacggcccaaggcctacggccccgtcggtccacgttccgtcgttcccccg

SEQ ID NO: 6972 - DNA, 594 bp, Homo sapiens
  misc_feature: GYAE6OF02GYEPQ.23.71.G05.1.454.CMB.1.raw
  modified_base (233)..(233): a, c, t, g, unknown or other
  misc_feature (233)..(233): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatccaccgtctcctgccacgtcggaacccnagtgattggttggtaacttttaatatggtctcgtgtacaatacctccaggcaaacgccccaaactcatacttatgaggcactagcgcctgacgggtttcagtcgtcttctctcggctaccgaagtctggaccaacgcggccctcccgtagaccctatcctcgtcggccctccgacgtcccgtagaccggacggaggtcctagtaactttattaagttgccttgtcctacgtatagtcgacaagtagtagttacgttacgtttgacgggttcgggacggggtactaagggtcgaccggtggtacggtacacggacccgaaggcctccggccccgttcggtacctacgttccgtcgttacccc

SEQ ID NO: 6973 - DNA, 582 bp, Homo sapiens
  misc_feature: GYAE6OF02H3RWM.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggtacttttaatatggtctcgtggtaccaatacctccaggcaaacgcccccaaactcatactttatggaggcactaagccgccctcgaggggtttctagtcgcttctcgtggctcaagtctggacaacgaccggccctcctgacctatcctctcggcctccacgtcctgaccgacgacggctagtatttattattcgcttcgtctacatatgctagtatagttaagttacgtttggacgggttcgggacgggggtacctaagggtcgtaccggttcggtacggtccacggacccgaaggccgtccgtcccccgtcggtcctacttccgttccgttaccccc

SEQ ID NO: 6974 - DNA, 544 bp, Homo sapiens
  misc_feature: GYAE6OF02JD3RW.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgccccaaatcatacttatgaggcactaagcggcctcgagggtttctagtcgtcttctctggctccagtctggcaacacgtcctcctgaccatctcgtcgcctccagcctgacgacgaggctgattattagtgactgctcatatgctagtatagtagttactttggagggttcggacgggggacctaaggtcgtaccgtcggtaacggtcacggacccgaaggtcctcggtcccctcggtccaccgttccgtcgtacccccg

SEQ ID NO: 6975 - DNA, 530 bp, Homo sapiens
  misc_feature: GYAE6OF02GJPH5.23.71.G05.1.454.CMB.1.raw
  modified_base (301)..(301): a, c, t, g, unknown or other
  misc_feature (301)..(301): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttangaggcactaagcgcctgagggtttctagtcgcttctctggctccaagtctggcaacacggcctccctgaccatcctctggcctccacgcctgacgacgaggctgtattattattgcttgctacatatgcagatagtagttactttgaggttcggacgggggaccagggtcgaccggtcggtaggtcacggacccaggctcgccccgtggtcctacgtcgtcgttccccg

SEQ ID NO: 6976 - DNA, 553 bp, Homo sapiens
  misc_feature: GYAE6OF02JFMJ6.23.71.G05.1.454.CMB.1.raw
  modified_base (363)..(363): a, c, t, g, unknown or other
  misc_feature (363)..(363): n is a, c, g, or t
  modified_base (426)..(426): a, c, t, g, unknown or other
  misc_feature (426)..(426): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaatcatacttatgaggcactaagcggccctcaggggtttctagtcgcttctctggctccaagtctggcaacncgcctccctgaccatctctcggccctccacgcctgacgacgaggctgattattattgctgctnatatgcagtatagtagttacgtttggagggttcgggcgggggtacaagggtcgtaccggtcggtaggtcacggtacccgaaggtcctccggcccccgttcggtaccaccgttcgtccggttcccccg

SEQ ID NO: 6977 - DNA, 513 bp, Homo sapiens
  misc_feature: GYAE6OF02H9W40.23.71.G05.1.454.CMB.1.raw
  modified_base (227)..(227): a, c, t, g, unknown or other
  misc_feature (227)..(227): n is a, c, g, or t
  modified_base (420)..(420): a, c, t, g, unknown or other
  misc_feature (420)..(420): n is a, c, g, or t
  modified_base (500)..(500): a, c, t, g, unknown or other
  misc_feature (500)..(500): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttgggacttttaatatggtctcgtggtaccaatcctccaggcaaagcccccaaatcatactttatgaggcactaagcggccctgaggggtttctagtcgcttctctggctcaagtctggcaacacggcctcctgaccatctctggcctccacgcctgaccgacgaggctgattattatgctgctnatatgcagatagtagttacttgaggttcggcggggacaggtcgacgtcgaggtcagcccgaagcctcgcccctcggtccncgttcctgtcccc

SEQ ID NO: 6978 - DNA, 535 bp, Homo sapiens
  misc_feature: GYAE6OF02F2U3F.23.71.G05.1.454.CMB.1.raw
  modified_base (304)..(304): a, c, t, g, unknown or other
  misc_feature (304)..(304): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaatcatactttangagggcactaagcggccctcaggggtttctagtcgcttctctggctccaagtctggcaacacggcctcctgaccatctctgcctccagcctgacgacgagctgattattattgctgctcatatgcagatagtagtactttgaggttcgggcgggggaccaagggtcgaccggtcggtaggtcgacgcccgaaggtccgtcgcccccgtcggtccacgttcctcgttccccc

SEQ ID NO: 6979 - DNA, 576 bp, Homo sapiens
  misc_feature: GYAE6OF02G6OPJ.23.71.G05.1.454.CMB.1.raw
  modified_base (363)..(363): a, c, t, g, unknown or other
  misc_feature (363)..(363): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaactcatacttatgaggcactaagccggccctgaggggtttctagtcgcttctctggctcagtctggcaacncggcctccctgaccatctctcggccctccagcctgaccgacgaggctgattattattgcttgctcatatgactagtattagttagttacgtttggtacgggttcgggacggggggtaacctaaggggttcgaccggttacggtacggtccgacggacccgtaaggtccgtccggcccccgttcggtccctaccgttccgttcccgttaccccc

SEQ ID NO: 6980 - DNA, 574 bp, Homo sapiens
  misc_feature: GYAE6OF02HWCHQ.23.71.G05.1.454.CMB.1.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
  modified_base (396)..(396): a, c, t, g, unknown or other
  misc_feature (396)..(396): n is a, c, g, or t
  modified_base (435)..(435): a, c, t, g, unknown or other
  misc_feature (435)..(435): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttgggacttttaanatggtctcgtggtaccaatacctcccaaggaaaacgcccccaaactcattactttatgagggcactaagcggccctnaggggtttctagtcgcttctctggctccaagtctggcaacacggcctcctgaccatctctcggcctccncgcctgacgacgagctagattacttattgctgcttcatntgcagtattagtagttacgttggagggtttccggggacggggtaacctagggtcggacccgttggtacgggtccaacggcccgaacggtccgtacgccccccgttcggtacctaccgttccttccgttcccctaccccg

SEQ ID NO: 6981 - DNA, 528 bp, Homo sapiens
  misc_feature: GYAE6OF02FGUMS.23.71.G05.1.454.CMB.1.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttgggacttttaatatggtctcgtggtaccaatacctccaggcaaagcccccaaatcatactttangaggcactaagcggccctcaggggtttctagtcgcttctctggctccaagtctggcaacacggcctccctgaccatctctcggcctcagcctgacgacgagctgattattattgcttgctcatatgcagattagtagttacgtttggaggttcgggcgggggtaccagggtgaccgtgtaaggcacgcccgaaggctcgccccgtcggtcaccttctcgttcccc

SEQ ID NO: 6982 - DNA, 590 bp, Homo sapiens
  misc_feature: GYAE6OF02HFQ02.23.71.G05.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggactttaatatggtctcgtgtaccaatacctccagcaacgcccccaaatcatacttatgaggcactaagccgcctacgtaggggtttctagtcgtcttctcgtgcctcagtctggcaacgacggccctcctgaccactcctcgtcgccctccgacgtccgtaggaccgacggacggtctagtaatttagttagttcgtctcgtccttacatatcgatagtatagttaagttacgtttaggtacgggttacgggacggggtacctagggtcggtaccggtacggtacggtacacggtccgaacggtcgtcccgtccccgtcggtccctaccgttccgtaccgttacccccg

SEQ ID NO: 6983 - DNA, 540 bp, Homo sapiens
  misc_feature: GYAE6OF02HXD13.23.71.G05.1.454.CMB.1.raw
  modified_base (228)..(228): a, c, t, g, unknown or other
  misc_feature (228)..(228): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttgggacttttaatatggtctcgtggtaccaatacctccaggcaaacgcccccaaactcatactttatgagggcactaagcggcctcaggggtttctagtcgcttctctggctcaagtctggcaacacggcctccctgaccatctctcggcctccagcctgacgacgaggctgattattattgctgctcatatgcagatagtagttactttgtagggttcgggcgggggtacagggtcgaccgttacggtaggtcacggcccgaacggctaccgccccgttacggccacgttcgtcgtcccccg

SEQ ID NO: 6984 - DNA, 536 bp, Homo sapiens
  misc_feature: GYAE6OF02FFMN7.23.71.G05.1.454.CMB.1.raw
  modified_base (229)..(229): a, c, t, g, unknown or other
  misc_feature (229)..(229): n is a, c, g, or t
  modified_base (363)..(363): a, c, t, g, unknown or other
  misc_feature (363)..(363): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaatatggtctcgtggtaccaattacctcccaggcaaagcccccaaatcatactttatgaggcactaagcggccctcaggggtttcagtcgcttctctggctccaagtctggcaacncggcctccctgaccatctctggcctcagcctgacgacgagctgattattattgctgctcatatgcagatagttagttacttttgaggtttcgggcgggggacctaagggtcgaccggtcggtaacggcacggcccgaaggcctcgccccgtcggtcaccgttctcgttccccg

SEQ ID NO: 6985 - DNA, 564 bp, Homo sapiens
  misc_feature: GYAE6OF02FZFRG.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaaactcatactttatgaggcactaagcgccctcgaggggtttctagtcgcttctctggctcaagtctggcaacacggcctccctgaccatcctctcggccctccacgtcctgaccgacgaggctgtattattattgctgctcatatgcagtatagttagttacgtttggacgggttcgggacgggggaccgtaagggtcgacggttcggtaacggtccgtacggcccgtaaggccgtcgtcccccgtcggtccaccgttccgtcgttcccccg

SEQ ID NO: 6986 - DNA, 631 bp, Homo sapiens
  misc_feature: GYAE6OF02HGODZ.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgctagtgatggttgggtaacttttaatatggtctcgtggtaccaatacctccaggcaaacgcccccaaactcattactttatggaggcactaagccggtccctgaggggtttctagtcgtcttctcgtcggtctcctaagtctacggctaaaccgacggtaccctcccgtacgaaccctactccttccgtacggtccctccacggccctgaaccgacgaggctggtaactttagtttacttcgcttcgaccttctatattcgacgagtagtagttacgttacgtttggtacgggttcgggaccgggggtacctaagggtcgaaccggttcgtaacgggtcaaccggtcccgaaggtcccgttcgaccccgttcggtacctccgttccgttccgttacccccg

SEQ ID NO: 6987 - DNA, 563 bp, Homo sapiens
  misc_feature: GYAE6OF02IH9OZ.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggactttaatatggtctcgtggtaccaatacctcccaggcaaaacgcccccaaaactcatactttatgagggcactaaagcggccctcgaggggtttctagtcgtcttctctggctccaagtctgcaacgacgcctcctgaccatctctgcctcagcctgacgacgagctgattattattgctgctcatatgcagatagtagttacttgagggttcggacgggggacctaagggtcgtaccggttcggtaacggtcacggtacccgaaggtccgtccggaccccccgttcgggtaccctaccgttccgttaccgttacccccccg

SEQ ID NO: 6988 - DNA, 570 bp, Homo sapiens
  misc_feature: GYAE6OF02IQLKJ.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgccccaaactcatacttatgaggcactaagccggccctcgtaggggtttctagtcgcttctctgctccagtctggacacgacgcctccctgaccatctctcggccctccacgcctgaccgacgacgtctagtattattattcgtactcgctactatactgacagatagttagttactttggtgggttacgggacgggggacgtagggtcggtaccggttcggtacgggtactacggcccgaaggtcctccggccccgttcggtcctaccgttccgttccgttccccg

SEQ ID NO: 6989 - DNA, 523 bp, Homo sapiens
  misc_feature: GYAE6OF02IQ6AB.23.71.G05.1.454.CMB.1.raw
  modified_base (345)..(345): a, c, t, g, unknown or other
  misc_feature (345)..(345): n is a, c, g, or t
  modified_base (430)..(430): a, c, t, g, unknown or other
  misc_feature (430)..(430): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgtcctgactcagcctgcctccgtgtctgggtctcctggacagtcgatcaccgtctcctgcactggaaccccgcagtgatgttgggacttttaatatggtctcgtggtaccaatacctcccaggcaaacgcccccaaactcatacttatgaggcactaagcggcctcgaggggtttctagtcgcttcnctggctccaagtctggcacacggcctcctgaccatcctctggcctccagcctgacgacgaggctgattattattgctgctcatangcagatagtagttactttggacggttcgggacggggacagggtgacggtcgtacggtcacgccaaggctcgccccgtgtcactctcgtccccg

SEQ ID NO: 6990 - DNA, 526 bp, Homo sapiens
  misc_feature: GYAE6OF02JAKM2.23.71.G05.1.454.CMB.1.raw
  modified_base (365)..(365): a, c, t, g, unknown or other
  misc_feature (365)..(365): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaacgcccccaaactcatacttatgagggcactaagcggccctcaggggtttctagtcgcttctctggctccaagtctggcaacncggcctcctgaccatctctcggcctccacgcctgacgacgagctgattattattgctgctcatatgcagatagtagttactttgaggttcggacggggacaaggtcgacgtcggtaggtacagcccgaaggcctcgccccgtcggtcactcgtcgtacccc

SEQ ID NO: 6991 - DNA, 570 bp, Homo sapiens
  misc_feature: GYAE6OF02G7AHC.23.71.G05.1.454.CMB.1.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccncagtgatgttgggacttttaatatggtctgtggtaccaatacctccaggcaaacgccccaaactcatacttangaggcactaagcgcctcgaggggtttcagtcgcttctctcggctacagtctggcaacncgctcctgaccntctctcgcctcgagcctagacgacgagctagtattattattcgctgcttcatatgacgagtatagttacgttacgtttgtagggttcgggacgggggtacctaggggttacgaccggttacggtaacggtaccgtacggacccggtaacggtcgtcccggtccccgttcggtacccaccgttccgtccgttcccccg

SEQ ID NO: 6992 - DNA, 623 bp, Homo sapiens
  misc_feature: GYAE6OF02JKQ8X.23.71.G05.1.454.CMB.1.raw
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (471)..(471): a, c, t, g, unknown or other
  misc_feature (471)..(471): n is a, c, g, or t
tcagacgcgagtatcacgaccggtgctcgatttagtgtcgtcgcaagagagagggggggtcggacgaagaggcagcgcgtctcgggacggtctccaccatggcctgggctctgctgctcctcactctcctcactcagggacacagggtcctgggcccagtctgccctgactcagcctgcctccgtgtctgggtctcctggacctagtccgatcaccgtctcctgcactggaacccccgagtgatggttggtaacttttaatatgtcgtcgtgtaccaactacctccagacaaccgaccccaactacctactacttactacgacggacacgtaacgcgccctacgtacgggttctacggtctcgttctcgtcggctccgtaagtcgtggaccgtaacaccggtccctacccgtcgaccacttctccgtcgccctccacgtccncgacgacgcgctnagttattatcgtactntactctatatcgactagacttagttagttaccgtttagggtcggttcgggacgggggaaccgtaacggttcggtaccggtccggtaaggttaccgacggtccgtacggtaccgtccggtacccccgtccggtctaccggttcctccgttccc

SEQ ID NO: 6993 - DNA, 598 bp, Homo sapiens
  misc_feature: GYAE6OF02IXX88.23.71.G05.1.454.CMB.1.raw
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaatatggtctcgtggtaccaatacctccaggcaaacgccccaaatcatacttangaggcactaagcgaccctgagggtttcacgtcgtcttctctggctactaagtcgtaggcaacacggcctccctgaccatctcgtcggccctccgagccgtgaaccgaccggtaaggccttggaaacttttactttacttggaccttaggccttacaacttagtcgaccagtacttagtaagttacctttggacgggttcgggacggggtacctaagggtcgtaaccggtcggtaaggcctaacgaccccgtaaggtccgtacggtcccctaagtcgggtcctacgttccgttcccgg

SEQ ID NO: 6994 - DNA, 562 bp, Homo sapiens
  misc_feature: GYAE6OF02FXTHP.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatggttgggacttttaatatggtctcgtggtaccaatacctccaggcaaagcccccaaatcatactttatgaggcataagtggccctgaggggtttcagtcgcttctctggctccaagtctggcaacacggccctccctagaccatctctcgccctccagcctgacgacgaggctagtattattattgctgctcattatcgcagatagtagttacgtttgagggttcgggacggggggtaccaaggggtcgtacccggtcggtaacggtcgacggcccgaaggtcctcggcccccgttcggtcctacccgttccgttccgttaccccc

SEQ ID NO: 6995 - DNA, 786 bp, Homo sapiens
  misc_feature: GYAE6OF02I233G.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccgtctcctgccactcggaacccgcagtgagttggttagggtactttaatagtggttctcggtaggtaaccaactacctccgaggtaccaaacgcccccaaaatctaattaccttagtggaacgggtaccaacgttaaccggccggtacccgttacggtacgggggttttacctaggtcctacgttcgtccggtcggtacctaccgtaaaggttccgtacgggaacctaaaccggtccggtccctcctacgacctagttcctcgtcggtccctacacgaccgtacgaacggtaccgaggtacttaacggttaactttacgtttacgttcggccttacggtaccttaactaacgttaacgtgaaccgttaagggtaaccgtttaaaggttaccggtttaacgggtttgggaaccggggggtttccggggaaccggggggttaaccgtaacgggttaccggtaacccgggtttacgggtaaccgggttaccaaccgggtaacccggtaaccggtcccgttaccccgggttcccccgtaacggttcccgtaaccctttcccggtaccccggtttacccccc

SEQ ID NO: 6996 - DNA, 553 bp, Homo sapiens
  misc_feature: GYAE6OF02IG01M.23.71.G05.1.454.CMB.1.raw
  modified_base (340)..(340): a, c, t, g, unknown or other
  misc_feature (340)..(340): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttatgaggcactaagcgccctcgagggtttctagtcgcttcnctgctcaagtctggcaacacggcctccctgaccatctctcggcctcacgcctgacgacgacgctgattattattgctgctcatatgcagtagtagttagtacgtttgacgggttcgggcgggggaactagggtcgaccggttcggtacggtcgacggtacccgaaggtcctccggcccccgtcggtaccctacgttccgttccggttcccccg

SEQ ID NO: 6997 - DNA, 566 bp, Homo sapiens
  misc_feature: GYAE6OF02G8Q4V.23.71.G05.1.454.CMB.1.raw
  modified_base (435)..(435): a, c, t, g, unknown or other
  misc_feature (435)..(435): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaacgcccccaaactcatactttatgaggcactaagcggccctgaggggtttctagtcgcttctctggctcaagtctggcaacgcgcctccctgacccatcctctcggccctccacgcctgaccgacgaggctgattattattgctgctcatangcagatagtagtactttgagggttccgggacggggggtacctaagggtcgaccggttcggtaacggtccacggaccccgaaggccgtccggtcccccggttcggtccctaccgttccgttccgttaccccc

SEQ ID NO: 6998 - DNA, 547 bp, Homo sapiens
  misc_feature: GYAE6OF02F6VPJ.23.71.G05.1.454.CMB.1.raw
  modified_base (306)..(306): a, c, t, g, unknown or other
  misc_feature (306)..(306): n is a, c, g, or t
  modified_base (377)..(377): a, c, t, g, unknown or other
  misc_feature (377)..(377): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaactcaatactttangagggcactaagcggccctcgaggggtttctagtcgcttctctggctccaagtctggcaacacggcctccngaccatctctcggccctccagcctgaccgacgaggctgattattattcgcttgcctcatatgcagatagtagttactttggaggttcgggacgggggtaccagggtgaccgtggtacggtcacggcccgaaggtcctcggccccgtcggtccacgttccgtcgttccccg

SEQ ID NO: 6999 - DNA, 541 bp, Homo sapiens
  misc_feature: GYAE6OF02H87BB.23.71.G05.1.454.CMB.1.raw
  modified_base (322)..(322): a, c, t, g, unknown or other
  misc_feature (322)..(322): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgccccaaactcatactttatgaggcactaagcggccctnaggggtttctagtcgcttctctggctccaagtctggcaacacggcctccctgaccatctctggcctccagccctgacgacgaggctgattattattgctgctcatatgcagatagtagttactttgaggttcgggcggggtaccgaagggtcgaccggttcgtaacggtcagacccgtaaggccgtcgcccccgtcggtccacgttcgtcgttaccccc

SEQ ID NO: 7000 - DNA, 541 bp, Homo sapiens
  misc_feature: GYAE6OF02HBYO6.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttatgaggcactaagcggccctcgaggggtttctagtcgcttctctggctcaagtctggcaacacggcctccctgaccatctctcggccctccgagcctgacgacgagctgattattattgctgctcatatgcagtatagtagttactttgaggttcggacgggggtacagggtcgaccggtcggtaggtcgagcccgaaggtcctccggccccgttcggtcctaccgttccgtcgttaccccc

SEQ ID NO: 7001 - DNA, 661 bp, Homo sapiens
  misc_feature: GYAE6OF02JLR99.23.71.G05.1.454.CMB.1.raw
  modified_base (232)..(232): a, c, t, g, unknown or other
  misc_feature (232)..(232): n is a, c, g, or t
  modified_base (345)..(345): a, c, t, g, unknown or other
  misc_feature (345)..(345): n is a, c, g, or t
tcagacgcgagtatcacgaccggtgctcgatttagtgtcgtcgcaagagagaggggggtcgacgaagaggcgagcgctctcgggacggtctccaccatggcctgggctctgctgctcctcactctcctcactcaggacacagggtcctgggcccagtctgccctgactcagcctgcctccgtgtctgggtctcctggacagtcgatcaccgtctcctgcaactggaaccccnagtgatgttgggacttttaatatggtctcgtggtaccaatacctccaggacaacgacccccaaactccatactttatgacgggtcactaagcggccctcgagggtttcagtcncttctctgctccaagtctgggcaacacggccctccctcgaccattctcctcggccctccacgtcctcgaccgacgagcttggatttatttattcggtactcgtctacttacattgcctaacgattaacgggttagttactttttacgggacggggttttaccgggaccgggggggtacctaaacgggttcgggtaaaccggttcccgggttaagggttacccgtaacgggtaccccccgaaaggggttccccttacccgggtccccccgtttcccgggtacccgttaacccgttcgtttaccccggttaccccccg

SEQ ID NO: 7002 - DNA, 553 bp, Homo sapiens
  misc_feature: GYAE6OF02JDOCK.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagagggggggggtcacaagaggcagcgctctcgggacgtctccaccatggcctggactctgctgctcctcactctcctcactcaggacacagggtcctgggcccagtctgccctgactcagcctgcctccgtgtctgggtctcctggacagtcgatcaccgtctcctgcactggaacccncagtgatgttggacttttaatatggtctcgtggtaccaatacctccaggcaacgcccccaaactcattacttatggaggcactaagccggccctcgtaggggtttctacgtcgcttctcgtggcctccaagtctggcaacgcggcctccctgaccatcctctcgcctccacgtcctagaccgacgagctgtattatagttgactcgctcatatgacagtatagtagttacttggtacggttcgggacggggtactaggtcgtacgtacggtagtcgacgtaccgtaaggctccggcccgtacgtccacgtccgtcgttaccccg

SEQ ID NO: 7003 - DNA, 605 bp, Homo sapiens
  misc_feature: GYAE6OF02HR7HD.23.71.G05.1.454.CMB.1.raw
  modified_base (366)..(366): a, c, t, g, unknown or other
  misc_feature (366)..(366): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggacttttaatatggtctcgtggtaccaatacctccaggcaaacgcccccaaactcatactttatgaggcactaagccggcctcgaggggtttcagtcgcttctctggctcaagtctggacaacncggcctcctgaccatctctcggcctccacgcctgaccgacgaggctgtatttattattgtctgtctctatatgctagtattagttagttacgtttggtacgggtttcgggaccggggggtaacgtaaggggttcgtacccggttacgggtaacgggttacccgaacgggaccccgtaagggtcccttaccggtccccccgttcggttaccctaccgtttcccgtcccggtttccccccg

SEQ ID NO: 7004 - DNA, 522 bp, Homo sapiens
  misc_feature: GYAE6OF02IYGDZ.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatgttgggacttttaatatggtctcgtgtaccaatacctcccaggcaaagcccccaaactcatactttatgaggcactaagcgccctcgagggtttctagtcgcttctctggctccaagtctggcaacacggcctcctgaccatctctggcctccagcctgacgacgagctgattattattgctgctcatatgcagtatagtagttacgttgtagggtcggacgggggacgagggtcgacggtacgtggtacgagaccgagcgtcgcccgtcgtcacgtctcgtccc

SEQ ID NO: 7005 - DNA, 629 bp, Homo sapiens
  misc_feature: GYAE6OF02IL2P7.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactggaaccccgcagtgatggttgggtacttttaatatggtctcgtcggtaccaatacctcccaggacaaacgcccccaaatcatactttatgacggcacgtaagccgcctcgtaggggtttctagtcgcttctcgtcggtcctaccgtaagtccgtggaccaacgaccggtccctccctggaccctactcctctcggtccctcccgacgtcctaggaccgacgtaggcttagtaactttagttattgcttcgcttcattacgcgacgtagtattagtagttaacgtttggtacggggtttccgggacgggggtaacctaagggtcgaccggttcggtacggtccgaacggtcccgaaggtcccgttaccggcccccgttacggtaccaccgttcccgtaccgttcccccg

SEQ ID NO: 7006 - DNA, 561 bp, Homo sapiens
  misc_feature: GYAE6OF02IG133.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaatatggtctcgtggtaccaatacctcccaggcaaacgcccccaaactcatactttatgagggcactaagcggccctcgaggggtttctagtcgcttctcgtggctcgaagtctggcaacacggccctcctcgaccatctcgtcgccctccagcctgacgacgaggctgattattattgctgctcatatgcagatagtagttactttggtacggttcgggacggggaccgtagggtcgttaccggtcggtaggtccacggacccgaaggtccgtacgcccccgttacggtccaccgttccgttcgttacccccg

SEQ ID NO: 7007 - DNA, 562 bp, Homo sapiens
  misc_feature: GYAE6OF02IQDIN.23.71.G05.1.454.CMB.1.raw
  modified_base (231)..(231): a, c, t, g, unknown or other
  misc_feature (231)..(231): n is a, c, g, or t
  modified_base (373)..(373): a, c, t, g, unknown or other
  misc_feature (373)..(373): n is a, c, g, or t
  modified_base (433)..(433): a, c, t, g, unknown or other
  misc_feature (433)..(433): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctccctgcactggaacccgnagtgatgttgggacttttaatatggtctcgtggtaccaatacctccaggcaaacgccccaaactcatacttatgagggcactaagccggcctcgaggggtttctagtcgcttctctgctccaagtctggcaacgcgcctccngaccatcctctcggcctccagcctgacgacgaggctagtattattattgcttgctcatangacagtattagtagttacgtttaggtacggttcgggacgggggactaagggtcgacggttacggtacggtacgacggacccgaaggtccgtaccggtccccgttcggtccacttcgtaccgttaccccc

SEQ ID NO: 7008 - DNA, 557 bp, Homo sapiens
  misc_feature: GYAE6OF02H8YV6.23.71.G05.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggacttttaanatggtctcgtggtaccaatacctccaggcaaacgcccccaaatcactactttatgaggcactaagcggcctcgagggtttctagtcgcttctctggctaccaagtctggcaacncggcctccngaccatctctggcctccagcctgaccgacgagtctgattattatcgctgctcatatgacagatagtagttacgtttggagggttcgggacgggggtacctaagggtacgacgttaggtcggtaacggtcaccgtacccgaaggtccgttaccggccccccgttaggtcctacccgtcttacccg

SEQ ID NO: 7009 - DNA, 558 bp, Homo sapiens
  misc_feature: GYAE6OF02JCNI6.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaatcatacttatgaggcactaagccggccctgaggggtttctagtcgcttctctggctccaagtctggcaacgacggccctccctgacccatcctctcggccctccgacgcctgaccgacgaggctagattattattgctgctcatatgcagtatagtagttactttgaggttcgggcgggggtactaagggtcgaccggtcggtaggtcacggcccgaaggtccgtccggcccccgttcggtacctaccgttccgtccgttcccccg

SEQ ID NO: 7010 - DNA, 641 bp, Homo sapiens
  misc_feature: GYAE6OF02HV7LJ.23.71.G05.1.454.CMB.1.raw
  modified_base (310)..(310): a, c, t, g, unknown or other
  misc_feature (310)..(310): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagactgcctccgtgtctgggtctcctggacagtcgatcaccgtctcctgccacgtggaacccgcagtgattggttgggtacttttaatatggtctcgtggtaccaatacctccaggaccaaacgccccaaatctatactttangaggcactaagcgcctgtagggtttctagtctcttctcgtcggcctaccaagttcctagggacccaacgaccggtccccttcccgtacgaccctacttccgttccgtccggtcccttaccgacgtcccgtacggaaccggacggtacggtcgtagtatttaagttaattcgtcttcgtccttactatacgtcgacgtaagtaacgttagttaagttacgtttggtacgggttacgggaccgggggtaacgtaacgggtcggtaccggttcggtacggtcgacgacccgaacggtccgtccgccccgtgtcctacgttccgtccgttccccg

SEQ ID NO: 7011 - DNA, 630 bp, Homo sapiens
  misc_feature: GYAE6OF02IWDTD.23.71.G05.1.454.CMB.1.raw
  modified_base (230)..(230): a, c, t, g, unknown or other
  misc_feature (230)..(230): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttgggtacttttaatatggtctcgtgtaccaatacctcccaggcaaacgcccccaaatcattacttatgaggcactaagccgccctgtaggggtttcagtcncttctcgngctccaagtctggacaacgaccggcctccctgaccctntcctcgtcgccctccacgcctgaccgacgnggtctagtatttattattgcttgcctctatactgactaagtattaaggttagttacgtttagggtacgggttccggggacgggggtaacctaaggggtccggtaacccgggttacggttaacgggtaccgaccgggtacccgtaacgggtcccttacccggttccccccgttacgggtccctaacccggtttcccgttaccggttacccccccg

SEQ ID NO: 7012 - DNA, 601 bp, Homo sapiens
  misc_feature: GYAE6OF02I3C5U.23.71.G05.1.454.CMB.1.raw
  modified_base (301)..(301): a, c, t, g, unknown or other
  misc_feature (301)..(301): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactcggaacccgcagtcgatgttggactttaatatgtctgtgtaccaatacctcccaggctaaacgccccaaatcaatacttacngaggcacgtaagccgccctgtagggtttctaggtcgtcttctcgtcgcctccgtaagtctcggacaacgtacggcctcccgtagaccctatccgtctcggtccctaccagccctagaccgacgacgtctagtacttattacgttgcgtctctactatactcgacgtaagtattagtagtttacgtttggtaagggttcccgggaggggacctaggttcggaccgttacggtacggttaccacgtacccgaaggtcctccggtacccccgttggcctaaccggttccgtaccgttcccccg

SEQ ID NO: 7013 - DNA, 547 bp, Homo sapiens
  misc_feature: GYAE6OF02GMID8.23.71.G05.1.454.CMB.1.raw
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttatgaggcactaagcggccctcgaggggtttcagtcgcttctctggctccaagtctggcaacacggcctcccngaccatcctctggcactccagcctgacgacgaggctgattattatgctgctnatatgcagtatagttagttactttggaggtttcgggacgggggtacctagggtcgtacccggtcggtacggtcgaacggacccgaaggccttccggcccccgttggtcctaccgttcttcccgg

SEQ ID NO: 7014 - DNA, 520 bp, Homo sapiens
  misc_feature: GYAE6OF02HMOWE.23.71.G05.1.454.CMB.1.raw
  modified_base (388)..(388): a, c, t, g, unknown or other
  misc_feature (388)..(388): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagccccaaactcatactttatgaggcactaagcggccctcaggggtttctagtcgcttctctggctcaagtctggcaacacgcctccctgaccatctctgcctccngcctgacgacgaggctgtattattattgctgctcatatgcagatagtagttactttgaggttcggcggggacagggtgaccgtcggtaggtcacgacccaaggctcgccccgtcgtccacgtctcgtccccg

SEQ ID NO: 7015 - DNA, 556 bp, Homo sapiens
  misc_feature: GYAE6OF02G3RF6.23.71.G05.1.454.CMB.1.raw
  modified_base (365)..(365): a, c, t, g, unknown or other
  misc_feature (365)..(365): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggtacttttaatatggtctcgtggtaccaatacctccaggacaaacgccccaaactcatacttatgaggcactaagccggcctcgaggggtttcagtcgcttctctggctacagtcgtggcaacncggcctcctgacctatcctcgtcgcctccacgcctgaccgacgagctgattatattgctgctntatatgnagtatagtacgttacgttgtacgggttcgggacggggactagggtacgtaccggttggtacggtcacggaccgtaaggcctaccggcccccgttggtacctacgttccgtccgttaccccc

SEQ ID NO: 7016 - DNA, 667 bp, Homo sapiens
  misc_feature: GYAE6OF02JM46I.23.71.G05.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (273)..(273): a, c, t, g, unknown or other
  misc_feature (273)..(273): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcnctggaacccgnagtgattggttggacttttaatatggtctcgtgtaccaataccntccaggccaaacgcccaactactatacttagtagacggacgacgtaacgcggaccgttctagggttctagtcgtcttcgtctgactctaagtctacggacgaacgtaccggtcctaccctagtacctacgtcgtccgtacgaccctccgtacgccgtacgacggtacgtacggtacgtacgtacttacgttacgttacgtactcgtactactagtaacgttacgactacggtaacgttaacggttacgttacggtttacgggtacgggttaaccgggtacgggggtaaccgtacgggtacggtacccggtacggttacggtaccgtaacggtacccgtaccggtacccgtaccgggtacccctacggttacccgttaccgtacccttaccccgg

SEQ ID NO: 7017 - DNA, 528 bp, Homo sapiens
  misc_feature: GYAE6OF02GGW4A.23.71.G05.1.454.CMB.1.raw
  modified_base (360)..(360): a, c, t, g, unknown or other
  misc_feature (360)..(360): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaatcatacttatgaggcactaagcgcctcaggggtttctagtcgcttctctggctccaagtctggcaacncggcctccctgaccatcctctcggccctccagcctgacgacgaggctgattattattgcttgcctcatatgcagtatagtagttactttggaggttcgggacggggtaccaggtcgaccgtggtaggtcacgaccaggcctcggcccctcggtcacgttctcgtcccc

SEQ ID NO: 7018 - DNA, 585 bp, Homo sapiens
  misc_feature: GYAE6OF02HTK65.23.71.G05.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcnctggaacccgnagtgatgttgggtacttttaatatggtctcgtggtaacctaatacctccaggcaaacgccccaaatcattactttanggaggcaactaacgcgcctcgagggtttcagtcgcttctctggcctcaagtctggacaacgcgcctcctgaccatctcgtcgcctccacgcctcgacgacgagctagtattatatgtctgctacatatgacagtatagtagttacgttaggtacgggttacgggacgggggtaactaagggtcggtaccggttacggtaacggtacgtacggacccgtaacgggtccgtccggtacccccggtacggtccctaaccgttcccgttaccgttaccccccg

SEQ ID NO: 7019 - DNA, 546 bp, Homo sapiens
  misc_feature: GYAE6OF02JYYEV.23.71.G05.1.454.CMB.1.raw
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatggttgggactttttaanagtggtctcgtgtaccaatcctccaggcaacgccccaaatcatacttangagcactaagcgcctgagggtttcagtcncttcnctgctcatcngcaacncgcctcngacntctctgcctcacgctgacgacgagctgtattatatcgctgctntatntnctanattagtagttacgtttagtacgggttccgggacggggtacctagggtcggaccggttacggtcggtacgacggtacccgtaacggtctacccggtccccgtcggtacccgacgttccgtccgttacccccg

SEQ ID NO: 7020 - DNA, 631 bp, Homo sapiens
  misc_feature: GYAE6OF02IJSJO.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttgggacttttaatatggtctcgtggtaccaatacctccaggacaaacgcccccaaactcatacttatgaggcactaagcgcctcgtaggggtttctagtctcttctctggcctcgaagtcgtgacaacacggcctccctgaccatctctcggcctccacgcctagacgacggacgctgtatttattagttgctgcttcatagtcgactagtaattagtaacgtttacgtttagggagggtttaccggggaccggggggtaccgtaaggggttcgtaacccgggtttacgggttacgggtacccgtaacggtacccccggtaaagggtcccttacccgggtaccccccgttaccggggttaccctaaccgttcccggttaccgttacccccccg

SEQ ID NO: 7021 - DNA, 562 bp, Homo sapiens
  misc_feature: GYAE6OF02I42WX.23.71.G05.1.454.CMB.1.raw
  modified_base (229)..(229): a, c, t, g, unknown or other
  misc_feature (229)..(229): n is a, c, g, or t
  modified_base (381)..(381): a, c, t, g, unknown or other
  misc_feature (381)..(381): n is a, c, g, or t
  modified_base (443)..(444): a, c, t, g, unknown or other
  misc_feature (443)..(444): n is a, c, g, or t
  modified_base (465)..(465): a, c, t, g, unknown or other
  misc_feature (465)..(465): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccncagtgatggttgggacttttaatatggtctcgtggtaccaatacctccaggcaaacgcccccaaactcaattacttagtgacgggcactaagccggccctcgaggggtttctagtcgtcttctctggcctcaagtctgcaacacgcctcctnaccatcctcgtcgcctccagcctgacgacgaggctagtattattattcgcttcgctctatanncagtatagtattacgtttggnggttcgggacggggactagggtcgtaccgtggtacgtacgacggaccctaggtccgttcgtacccccgttggtcctaccgtcgtcccgttacccccg

SEQ ID NO: 7022 - DNA, 541 bp, Homo sapiens
  misc_feature: GYAE6OF02FTRT9.23.71.G05.1.454.CMB.1.raw
  modified_base (439)..(439): a, c, t, g, unknown or other
  misc_feature (439)..(439): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggtacttttaatatggtctcgtggtaccaatacctccaggcaaacgcccccaatcatacttatgaggcactaagcggccctcgtaggggtttctagtcgcttctcgtggctccaagtctggacaacacggccctccctgaccctatcctcgtcggccctccagcctgacgacgagctgtattattattgctgctcatntgcagtagtagtagttacgtttggaggttcgggacggggacaggtcgacgtgtaggcacgcccgaggccgtcgccccgtcggtctacgttccgtcgtccccg

SEQ ID NO: 7023 - DNA, 522 bp, Homo sapiens
  misc_feature: GYAE6OF02JFS2M.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctgtggtaccaatacctcccaggcaaagcccccaaactcatacttatgaggcactaagcggccctcaggggtttctagtcgcttctctggctcaagtctgcaacacggcctccctgaccatctctggcctccacgcctgacgacgacggctgattattattcgctcgctcatatgcagatagtagttactttgaggttcggcggggtacaggtcgaccgtcggtaggtcacgcccgaagctcgcccttcggtcacgtcgtctccccg

SEQ ID NO: 7024 - DNA, 563 bp, Homo sapiens
  misc_feature: GYAE6OF02JHXBA.23.71.G05.1.454.CMB.1.raw
  modified_base (251)..(251): a, c, t, g, unknown or other
  misc_feature (251)..(251): n is a, c, g, or t
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatcctccagcaaacgccccaaatcatacttangaggcactaagcggccctgaggggtttctagtcgtcttctctggctccaagtctggcaacncggcctcctgacctatcctctggccctccagcctcgacgacgaggctgattattattgctgctcatatgcagtatagttagttacgtttgacgggttcgggacgggggtacctaagggttcgtaccggtcggttacggtccaggccccgtaaggtccgtaccggcccccgttcgggtaccctacgttccgtcgttacccccg

SEQ ID NO: 7025 - DNA, 558 bp, Homo sapiens
  misc_feature: GYAE6OF02I6ND8.23.71.G05.1.454.CMB.1.raw
  modified_base (359)..(359): a, c, t, g, unknown or other
  misc_feature (359)..(359): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaagcccccaaatcatacttatgaggcactagcggccctcgagggtttctagtcgcttctcgtgctcaagtctggcaacncgcctcctgacccatctctcggcctccagcctgacgaccgagctgattattacgttgctgctacgtatagtcgactagtactagttagttacgtttgacgggttcggacgggggtaccaagggttcgaaccggttcggtaaggctacggcccgtaaggccttaccggccccctaggtcctactccgttaccgttccccg

SEQ ID NO: 7026 - DNA, 594 bp, Homo sapiens
  misc_feature: GYAE6OF02FJKM6.23.71.G05.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttgggacttttaatatggtctcgtggtaccaattacctcccaggcaaagcccccaaatcatactttangaggcactaagcggccctgaggggtttctagtcgcttctctggctaccagtctggcaacncggcctcctgaccatctctcggccctcagcctgaccgacgaggctgtacttattattgcttgcttcattatcgctaggtactagttacgtttacgttttagggacgggtttccggggacgggggtaacctaaggggttcggaccgtcgggttaacggtacaccggtccccgaaaggtccctaccggtcccccgttagggtcctacccgttccgttcccggttaccccccg

SEQ ID NO: 7027 - DNA, 575 bp, Homo sapiens
  misc_feature: GYAE6OF02JI1PV.23.71.G05.1.454.CMB.1.raw
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
tcagacgcgagtatcacgaccggtgctcgatttagtgtcgtcgcaagagagagggggggggtcggacaagaggcagcgctctcgggacgtctccaccatggcctgggctctgctgctcctcactctcctcactcaggacacagggtcctgggcccagtctgccctgactcagcctgcctccgtgtctgggtctcatggacagtcgatcaccgtctccctgcactggaacccgcagtgatgttcgggacttttaatatggtctcgtggtaccatacctcccaggcaaagcccccaatccatacttatgagggccaacgtaagccggtccctcgacggggtttctacggtcgctttctcgtggtcctccaagtcctggacaacgaccggcctccctgaccctatctctcggcccttcagtccctgaccgcgaggctgacttattnttgctgctntactatgacagattagtagttcttggaggttcgggacgggggactagggtcgacggttcggtcggtagtccgacccgtaaggtccctaccggcccccgttacggtccctacgttccgttcccg

SEQ ID NO: 7028 - DNA, 553 bp, Homo sapiens
  misc_feature: GYAE6OF02IXG9Z.23.71.G05.1.454.CMB.1.raw
  modified_base (375)..(375): a, c, t, g, unknown or other
  misc_feature (375)..(375): n is a, c, g, or t
  modified_base (433)..(433): a, c, t, g, unknown or other
  misc_feature (433)..(433): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaactcatactttatgagggcactaagcggccctcaggggtttctagtcgcttctctggctccaagtctggcaacacgcctccctnaccatctctgcctccagcctgacgacgaggctgtattattattgctgctcatatgacngatagttagttactttgtaggttcgggtacgggggacctaagggtgtaccggtcggtaacggtcgacggtcccaagggtcctccggtcccccgttccggtccacgttcctcgttcccccg

SEQ ID NO: 7029 - DNA, 539 bp, Homo sapiens
  misc_feature: GYAE6OF02GAQUB.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaatatggtctcgtggtaccaatacctccaggcaaagcccccaaactcatactttatgagggcactaagcggccctcaggggtttctagtcgcttctctggctccaagtctggcaacaccggcctccctgaccatctctcggcctcagcctgacgacgagctgtattacttattcgctgctcatatgcagattagtagttacgtttgaggttcgggcgggggtaccagggtcgaccggtcggtaggtcgacgcccgaaggctcggtccccttcggtccacgttctcgttccccg

SEQ ID NO: 7030 - DNA, 627 bp, Homo sapiens
  misc_feature: GYAE6OF02HYJB9.23.71.G05.1.454.CMB.1.raw
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaantggtctcgtggtaccaatcctccaggcaaacgccccaaatcatactttangaggcactaacgccggcctgtaggggtttcagtcgcttctctggctaccaagttcgtggacaacgaccggccctcccgtgacctacttcctcgtcggcctccacgccctagacggacgacggtctagtactttattagttcgtctgtcctactattactgaccaagtacgttagttagttacgtttggtacgggttccgggacggggggtaaccaaggggttcggtacccggtacgggttacgggtaccgtaacggtaccccgtaagggtccgtacccggtcccccgttaccggtaccctacccgttccgttcccgttaccccccg

SEQ ID NO: 7031 - DNA, 517 bp, Homo sapiens
  misc_feature: GYAE6OF02IYNQV.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaactcatacttatgaggcactaagcgccctcagggtttcagtcgcttctctggctctagtctggcaacgacgcctcctgacctatctcgtcggtcctccgacgtcctgacgacgaggctagtacttattattgcttcgctcatatgacagtatagtagtactttggaggttcggcggggaacaggtcgacgtgtgtcacgccaagctcgcccgtgtcactctcgtccc

SEQ ID NO: 7032 - DNA, 542 bp, Homo sapiens
  misc_feature: GYAE6OF02F4RVI.23.71.G05.1.454.CMB.1.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaanatggtctcgtggtaccaatacctccaggccaaacgcccccaaatcatactttangaggcactaagcgccctgaggggtttcagtcgcttctctggctcaagtctggacaacncgcctcctgaccatctcncggcctcagcctgacgacgagtctgtattattattgctgtcctanattangacagatagtattactttggacggttcgggacgggggtaccaagggtcgaccggtggtggtacgacgcccgaagggcctccggccccgtcggtaccacctcgtccgttacccc

SEQ ID NO: 7033 - DNA, 778 bp, Homo sapiens
  misc_feature: GYAE6OF02IR8OF.23.71.G05.1.454.CMB.1.raw
  modified_base (324)..(324): a, c, t, g, unknown or other
  misc_feature (324)..(324): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgacgggtcctcgggcccagtctgccctgactcagcctgcctccgtgtctgggtctccgtggacagtcgatcaccgtctcctgcacgtcggaacccgcagtgatggttggtaacttttaatagtggtctcgtcggtaacctaataccctccgaggaccaaacgacccccaaactctaattactttanggacggaccaacgtaacgccggtccctacgtacggggtttactacggtccgtcctttcgttcgtcggtaccctaccgtaaggtccgtacggacctaaaccggtacccggtaccccttccctacgaaccctacgtttccgtccgttccgggaccccttaccgaccgtccgttacgggaacccggacggtacgggtccttagggttaacttttaacgtttacgttcggtacgtttacgaccttaacgttattaccggtcgtacgaagttacgttaaggtttacgttaccggttttggggaaccgggggtttccggggaacccggggggtaacgtaacgggtcgttaacccgggtacggtaacgggttcccaacgggtaacccgtaacgggtccgtaccccggttacccccgtacgggtttaacccacccgttttaccgtccccggtttaacccccc

SEQ ID NO: 7034 - DNA, 638 bp, Homo sapiens
  misc_feature: GYAE6OF02H5HQG.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgccactcggaacccgcagtgatggttgggtacttttaatatggtctcgtggtaccaatacctccaggcaaacgcccccaaactcattactttagtggagggcacgtaaggccggacctcgtaggggtttctagtcgtcttctcgtggctacgtaagtcgtcggacaacgaccgggtcccttccctacgaccacttcctccgtcggtccctccgacgcctacggaccgacggagtctagtactttattacgttgtctgtccttatacttacgtcgacagtagttaacggttagtttacgtttgggaacggggtttccggggacgggggtaacctaagggtcgtaccggttaggttacggacgacgtaccggtaacggtccgtccggtaccccgttcggtacctaccgttccgttccgttacccc

SEQ ID NO: 7035 - DNA, 584 bp, Homo sapiens
  misc_feature: GYAE6OF02IITU6.23.71.G05.1.454.CMB.1.raw
  modified_base (305)..(305): a, c, t, g, unknown or other
  misc_feature (305)..(305): n is a, c, g, or t
  modified_base (434)..(434): a, c, t, g, unknown or other
  misc_feature (434)..(434): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggtacttttaatatggtctcgtggtaccaatacctccaggcaaacgccccaaactcatactttangaggcactaagcggcctcgaggggtttctagtcgcttctctggcctccaagtctggacaacgacggtcctccctgaccatcctctcgcctccacgcctgacgacgaggctgtattattattgtctgctnatatgacagtatagttagttacgtttggtacgggttcggggacgggggtaaccaagggttcgaccggttggtacgggtaccgacggaccccgtaaggtcccgttaccggcccccgttcggtaccctaccgttcccgttccgttccccccg

SEQ ID NO: 7036 - DNA, 525 bp, Homo sapiens
  misc_feature: GYAE6OF02FROBP.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaatcatactttatgagggcactaagcggccctcaggggtttcagtcgcttctctggctccaagtctggcaacacggcctccctgacccatcctctggcctccagcctgacgacgaggctgattattattgctgctcatatgcagatagtagtactttgaggttcgggcgggggacagggtcgacgtcggtaggtcagcccaaggcctcgcccctcggtccactccgtgtccccg

SEQ ID NO: 7037 - DNA, 521 bp, Homo sapiens
  misc_feature: GYAE6OF02GFOS4.23.71.G05.1.454.CMB.1.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatgttgggacttttaatatggtctcgtggtaccaatacctcccaggcaaagccccccaaatcatactttangagggcactaagcggccctnaggggtttctagtcgcttctctggctccaagtctggcaacncggcctccctgaccatcctctggccctccagcctgacgacgaggctgattattattgctgctcatatgcagatagtagttactttgaggttcggcggggacaggtgacgtcgtaggcagcccaaggctcgccccgtcggtcactctcgtccccg

SEQ ID NO: 7038 - DNA, 560 bp, Homo sapiens
  misc_feature: GYAE6OF02IUEAB.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaacgcccccaaatcatacttatggagggcactaagcggccctcgaggggtttcagtcgcttctctgctcaagtctggcaacacggcctcctgaccatctctcggcctccagcctgacgacgagctgtattattattgctcgctcatatgcagtatagttagttacgtttggtagggttcgggacggggggtacctaagggtcgaccggttaggtacggtaccgacggacccgaagggtcctaccggtcccccgtggtccaccgttccgtccgttcccc

SEQ ID NO: 7039 - DNA, 610 bp, Homo sapiens
  misc_feature: GYAE6OF02J2PA4.23.71.G05.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (451)..(451): a, c, t, g, unknown or other
  misc_feature (451)..(451): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaanatggtctcgtgtaccaatacctccaggcaaacgcccccaaatctatactttangaggcacgtaagccggccctacgtaggggtttctagtcgtcttctcgtcggctaccgaagtcgtcggacaaccgcgtccctacccgtgaccctatcctctcggccctcagtccagacgcgaggcttagtattattattcgcttgcttnatgtcgctagagttaacgtagtttaccgtttagacgggttccggggacgggtaaccgtagggttccgaccggttcggtaacggtaccaacggtaccccggtaaggttcccgaccggttccccccgtaggttacccaccgttccgttacccgttaccccc

SEQ ID NO: 7040 - DNA, 524 bp, Homo sapiens
  misc_feature: GYAE6OF02FHQ72.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttggacttttaatatggtctcgtggtaccaattacctcccaggcaaagccccccaaatcatactttatgaggcactaagcggccctcaggggtttctagtcgcttctctggctccaagtctggcaacacggcctccctgaccatctctggcctccagcctgacgacgagctgattattattgctgctcatatgcagatagttagtactttgaggttcggcgggggtaccagggtcgaccgtcggtaggtcagcccgaaggctcgccccgtggtccaccttctgttcc

SEQ ID NO: 7041 - DNA, 575 bp, Homo sapiens
  misc_feature: GYAE6OF02GNU94.23.71.G05.1.454.CMB.1.raw
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgattggttgggacttttaatatggtctcgtggtaccaatacctccaggcaaacgcccccaatcatacttangaggcactaagcgccctgtagggtttctagtcgtcttcnctgctcagtctggcaacnccggcctcctcgacctatctctcggccctccagcctgaccgacgagtctgtattattattgctgctanagtancgtacagacttagttagttacgtttggaggttcggggacgggggtacctaggggtcgaccggttacggtaggtccgacggcccggtaaggtcccgtccggtccccgttcggtaccgtaccgttccgttcccgttacccccg

SEQ ID NO: 7042 - DNA, 647 bp, Homo sapiens
  misc_feature: GYAE6OF02IOWKI.23.71.G05.1.454.CMB.1.raw
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgccctccgtgtctgggtctcctggacagtcgatcaccgtctcctgcactcggaacccgcagtgatggttgggactttttaangtggtctcgtggtaccaataccctccaaggcaaaacgccccaaaactcatactttangaggcactaagcgccctgtagggtttcagtcgtcttctctggccttaccgaagtctacggctaaaaccgccgggtccccttacccgtacgaacctattcctcgtcggaccctccacggtcccgtacgaaccgacggaacggtctcggtaattacgtttattgtcctagtcctactatacgttcgacgtaagtaataggttacgttacgtttaggacgggtttacgggacgggggaaccgtaaggtacgtaccggttacggtacggtaccgacggtacccgaacggtcccgtaccggccccgtacggtcccgtaacgttccgttacccgttaccccc

SEQ ID NO: 7043 - DNA, 796 bp, Homo sapiens
  misc_feature: GYAE6OF02JRY3N.23.71.G05.1.454.CMB.1.raw
  modified_base (120)..(120): a, c, t, g, unknown or other
  misc_feature (120)..(120): n is a, c, g, or t
  modified_base (275)..(275): a, c, t, g, unknown or other
  misc_feature (275)..(275): n is a, c, g, or t
tcagacgcgagtatcacgaccggtgctcgatttagtgtcgtcgcaagagagaggggggggtcacaagaggcagcgctctcgggacgtctccaccatggcctgggctctgctgcctcctcnctcctcctcactcgagacacgtcggtccgtcgggccctagtctccgccctgtacctcacgcctcgcccgttccgtgttcggtcgggtccttccgtaggactacggtcgtactccgtaccgttcctccgtcgacctaccggtaccgggaaccccgngtaggtgtagttgggttacggttaacttttaatgttcggttcctcggtacgtaacctaactaccctccgaggtaacaaccgacccctaactctaacttacttagtacggacgactaacgtacgccggtcctacggttacgggttactacgtccgttcttccgtacgtcgtcctacgtacgtctacggaccaacggccgtccctttccgacgtacctacgttccttaccgtccggtaccctacccgtaccgtccggtaaccggaaccggacggttacggtcttaaggtttactttaagttcgttacgtcttcggtaccttacgacgtttacgtccaagtagttagttaacgggtttattacgggtttagggttacggggttaccggggaacggggtaaccggtacgggttaccggaccggtttacggcggttaaccaccgggtaacccggttaaggttccccgtccccgggttaccccggttaccgtaccttacccgggttccgttaccccggtttcccccg

SEQ ID NO: 7044 - DNA, 550 bp, Homo sapiens
  misc_feature: GYAE6OF02FFWIU.23.71.G05.1.454.CMB.1.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatcggttgggacttttaatatggtctcgtggtaccaatacctccaggcaaagcccccaaatcatacttangaggcactaagcggccctcgaggggtttctagtcgtcttctctggctcaagtctggcaacgcggcctccctgacctagtctctcggcctccacgcctgacgacgaggctgattattatgactgctcatatgcagtatagttagttactttaggacggtttcgggacggggtacctaggttcgaccggtcggtacggcacggcccgtaaggccgtcgtcccccgtggtccacttccgtcgttaccccc

SEQ ID NO: 7045 - DNA, 737 bp, Homo sapiens
  misc_feature: GYAE6OF02IB5EX.23.71.G05.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnagtgatggttggacttttaatatggtctgtgtaccaatacctccaggcaaagccccaaactcatactttatggaggcactaagccggccctcgtaggggtttctagtcgcttctctggcctccgaagtctggcaacgacggtccctccctacgaccctatcctaccgtcggtccctcccgacgtccctacggaaccgacggtaagggccttaggaacttttacttaacgtttcggccgtttacggtaccctttactaacttaacgttgacccgtaagtaacgtttaacggttaacggttttaacgtttttggggttaacgggggtttccggggggtaaccgggggggtaacccggtaaaggggtttaccgggtaacccggggtttaccgggttaacgggttaccgtaacccgggtacccccggtaaacggggtcccttacccgggtaccccccggttccgggttacccctttacccggttacccggttcccgtttaccccccccggg

SEQ ID NO: 7046 - DNA, 581 bp, Homo sapiens
  misc_feature: GYAE6OF02I66RU.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttggacttttaatatggtctcgtggtaccaatacctcccaggcaaacgcccccaaactcatactttatgaggcaactaagccggtccctcgtaggggtttctagtccgtcttctcgtggctccgaagtctggacaacgaccggccctccgtagacctatcctcgtcggccctccacgtcctggaccgacgaggcctaggtacttattattgctgctctatatgacagtatagtagttacttggtaacggttcggacggggtactagggtgaccggtcggtacggtaccacggacccgtaagccgtccgtaccccgtcggtaccaccgttcctccgttaccccc

SEQ ID NO: 7047 - DNA, 622 bp, Homo sapiens
  misc_feature: GYAE6OF02JT3E6.23.71.G05.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (468)..(468): a, c, t, g, unknown or other
  misc_feature (468)..(468): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttggtacttttantggtctgtgtaccatcctccaggcaagccccaaatcatacttatgaggcactagccgtccctgtagggtttcagtcgtcttctctggcctaccgtaagtcctaggcaacgaccggtccctccctgaccctatccttcgtcggtccctcctacggcccttacggaccgaccggaggtccttagtaactttacttagttcggcttacgtcctataacgtntgacctaagtactaagttacgttacgtttggaacgggttccggggaacgggtaccgtaagggtcgtaccggttcggtaacggtccaaggtccccgtaagggtccctacccggtccccgtacggttacctacccgtttccgtcccggttcccccg

SEQ ID NO: 7048 - DNA, 548 bp, Homo sapiens
  misc_feature: GYAE6OF02IS6UA.23.71.G05.1.454.CMB.1.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (414)..(414): a, c, t, g, unknown or other
  misc_feature (414)..(414): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgnagtgatgttgggacttttaatatggtctcgtggtaccaatacctcccaggcaaacgcccccaaatcatacttangaggcactaagcggcctcgagggtttctagtcgcttcnctgctcagtctggcacacgcctcctgaccatcctctcgccctccagcctgacgacgagctgattattattnctgctctatatgctaagtatagtagttacgttgtacgggttcgggacgggggacctaagggtcgaccggttcggtaggtccaggtacccgaaggcctaccggccccgttacggcctacgtccgttcgtcccccg

SEQ ID NO: 7049 - DNA, 540 bp, Homo sapiens
  misc_feature: GYAE6OF02HQSY0.23.71.G05.1.454.CMB.1.raw
  modified_base (307)..(307): a, c, t, g, unknown or other
  misc_feature (307)..(307): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggtacttttaatatggtctcgtggtaccaatacctccaggacaaacgcccccaaactcatactttangaggcactaagccgcctcgagggtttctagtcgcttctctgctcagtctggcacgcgcctcctgaccatctcgtcgcctccacgcctgacgacgagtctgtattattattgtctgtctctatatgcagtatagtagttacgtttgtacgggttcggacgggggtacagggtcgtaccggtcggtaggtcgacgccgaacgtccgtcgccccgtcgtccacttccgtctacccc

SEQ ID NO: 7050 - DNA, 551 bp, Homo sapiens
  misc_feature: GYAE6OF02HKCDN.23.71.G05.1.454.CMB.1.raw
  modified_base (178)..(178): a, c, t, g, unknown or other
  misc_feature (178)..(178): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
tcagacgcgagtatcacgaccggtgctcgatttagtgtcgtcgcaagagagaggggggggtcacaagaggcagcgctctcggacgtctccaccatggcctgggctctgctgctcctcactctcctcactcagacacagggtcctgggcccagtctgccctgactcagcctgcctccgngtctgggtctcctggacagtcgaatcaccgtctcctgcactggaacccnagtgatcgtggacttttaanatggtctcgngtaccaataccnccagcaaacgtccccaaatcagtactttangaggctaataagcgccnagggttctagcgntctntgctccaagtcnggacaacacggccctcngaccatctcgtcgcctcacgcctgacgacgaggctagtattatattgctgctcatangcagtatagtacgttacgtttgtacgggttcggcgggggtaaccgaaggtacgtaccggtcggtaacggtcgacgtacccgaaacggcgtccggtcccccgtccggtacctacgttccgtacgttacccccg

SEQ ID NO: 7051 - DNA, 563 bp, Homo sapiens
  misc_feature: GYAE6OF02JEXDY.23.71.G05.1.454.CMB.1.raw
  modified_base (360)..(360): a, c, t, g, unknown or other
  misc_feature (360)..(360): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtcttgtggtaccaatacctccaggcaaacgcccccaaatcatacttatgaggcactaagcggccctgaggggtttcagtcgcttctctggctcaagtctggcaacncggcctccctgaccatctctggccctccacgcctgaccgacgagctgattattattgctgctcatatgcagtatagtagttacgtttggacgggttcgggcgggggtacctaaggggtcgtaccggtcggttacggtaccacggccccgtaagggccttccggcccccgttccggtcctaccgttccgttcccggttcccccg

SEQ ID NO: 7052 - DNA, 683 bp, Homo sapiens
  misc_feature: GYAE6OF02JZA97.23.71.G05.1.454.CMB.1.raw
  modified_base (254)..(254): a, c, t, g, unknown or other
  misc_feature (254)..(254): n is a, c, g, or t
  modified_base (305)..(305): a, c, t, g, unknown or other
  misc_feature (305)..(305): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcacgtggaacccgcagtcgatggttgggactttttaangtgtctgtgtaccaatcctccaggacaaccgccccaaactccatactttanacgacggactactaacgccggtaccctcggtaggggtttctagtccgtcttctcgtggccctacgtaagtctaggacaaccgtacggtaccctccctgaacctactccgttacgtccggtacccttccgaacgtccctacgggacgtaaccggagtcgttaacgtatttacttagttcgtaccgttacgccttaacgtaagttcgtacgacgttaaagtaccggtttaagttaacggtttccgtttaacggggtaacggggttcccgggaaaccggggtactaacggggtcgttaccggttacggtacggtaccgacggtacccgtacggtcctccggtccccggtaggtccctaaccttcccgttaccgttaccccc

SEQ ID NO: 7053 - DNA, 552 bp, Homo sapiens
  misc_feature: GYAE6OF02HA3NM.23.71.G05.1.454.CMB.1.raw
  modified_base (253)..(253): a, c, t, g, unknown or other
  misc_feature (253)..(253): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatgttgggtacttttaanatggtctcgtggtaccaatacctcccaggcaaacgcccccaaatcatacttatgaggcactaagcggccctgaggggtttctagtcgcttctcgtggctccaagtctggcaacgacggcctccctgaccatctctcggccctccagcctgacgacgagctagattattattgctgctcatactgctagatagttagttactttggagggttcgggcgggggtaccaggtcgaccggttcggtaggtccgacgcccgaaggcctcggccccttcggcctaccgttcgtaccgttcccccg

SEQ ID NO: 7054 - DNA, 703 bp, Homo sapiens
  misc_feature: GYAE6OF02G1W7B.23.71.G05.1.454.CMB.1.raw
  modified_base (235)..(235): a, c, t, g, unknown or other
  misc_feature (235)..(235): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccgtctcctgccacgtcggaacccgnagtgatggttggtaacttttaatatggtctcgtgtaccaatacctccaggacaacgccccaaatcatacttagtgacggcaacgtagccgtccctagtacgggtttcagtcgtcttctcgtcggtcctacgtaacgttctaggaccaaaccgccggtccctacccgtacgaaccctacgtccgtaccgtccggacccttccgacgtcccgtacggaaccgtacggacggtcttagtaacttttacttagttcgtccttagccttactaagttagtcgaacgtaagttacgttaagttacgtttaacgtttgggtaacggggtttaccgggggaccgggggtaaaccgtaggggttccggtaaccgggttcgggtaacggttaccgaaccggtacccgggtaacggtcccgttacccggtacccccggttacggttaccctacgttccccggttcccgtttaccccccg

SEQ ID NO: 7055 - DNA, 602 bp, Homo sapiens
  misc_feature: GYAE6OF02I7N16.23.71.G05.1.454.CMB.1.raw
  modified_base (231)..(231): a, c, t, g, unknown or other
  misc_feature (231)..(231): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgnagtgatgttgggacttttaatatggtctcgtggtaccaatacctccagcaaacgccccaaactcatacttatgaggcactagccggccctgtagggttctagtcgtcttcncgtgctcaagtcnggcacacggcctccctgacctagtctcgtcgccctccgacgcctgacgacgaggtctagtactttacgttagttcgtactcgtctcgtattacgtcgactaagtagttagttagttacgtttaggtacggggttccgggacgggggtaaccgtaagggttcgtaaccggtcggttacggtaccgtaccggacccgaacggtccgttccgcccccgttcggtcctaccgttccgttccgttacccccg

SEQ ID NO: 7056 - DNA, 528 bp, Homo sapiens
  misc_feature: GYAE6OF02G6QC8.23.71.G05.1.454.CMB.1.raw
  modified_base (249)..(249): a, c, t, g, unknown or other
  misc_feature (249)..(249): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctcccaggcaaagcccccaaatcatactttatgaggcactaagccggccctcaggggtttctagtcgcttctctggctccaagtctggcaacacggcctccctgaccatctctcggcctccagcctgacgacgaggctgattattattgctgctcatatgcagatagtagttactttgaggttcggcggggaccaaggtgaccgtcggtaggtcaggcccaagcgtccgcccctgggtccacgttcctcgttcccccg

SEQ ID NO: 7057 - DNA, 1017 bp, Homo sapiens
  misc_feature: GYAE6OF02FY23O.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgggtcgtcggccgacgtcgtcgccgtccgtacgtcctacgccgtccgccgtcccgtcggttcgtcgggtcggttcctcggacgacgtcggtacgtactacccgtccgttcccttcgtcgacctacggtaacccggacccgagtacggtagttacggtttggggttaaccggttttaaacttttaagtcgggttcggttaccgttacgggttaacccgaaaccttaaccccgttcccccgaacgggaaccggaaaaccgaaccccccgtaaacccccttaactacttaacttttaacgttaggaacggggtaaccgaaccttaacggaccgggcccccgttacccgtaaggggggttttaccggtttaacgtccggtcctttaccgttcgtccgggggtaccttaccctaaaccggttacggttccgggtaccgaaaccctaacccggggtccccgttcccccttaccggtacccgtaaaccttccgttcccgttaccggggtcccccgttacccgttaaccggcccggttaccggtaaaccggggtaaacccgggtaacccggggtacgtttaccggttaaagttttaaccttttaaacggttttcggtccgtacgttcccgttaccttaacgtttaagttacggacccgtaaaggtaacgtttaacgtttaaaccggtttaacggtttttaaccggggtacggggtttaccggggggtaccccgggggggtaaacggtaaacgggttacgggtacccgggttaccgggttaacgggttaccggaaccgtaccccgggaagggttccgttaccccggtcccccggttcccggttaccgttaccccgtccggtttacccggtttcccccggtacccccc

SEQ ID NO: 7058 - DNA, 567 bp, Homo sapiens
  misc_feature: GYAE6OF02HJV4R.23.71.G05.1.454.CMB.1.raw
  modified_base (309)..(309): a, c, t, g, unknown or other
  misc_feature (309)..(309): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (543)..(543): a, c, t, g, unknown or other
  misc_feature (543)..(543): n is a, c, g, or t
  modified_base (551)..(551): a, c, t, g, unknown or other
  misc_feature (551)..(551): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcacgtcggaaccccgcagtgatggttgggtaacttttaatatggtctcgtggtaccaatacctccagcaaacgcccccaaatcatacttangaggcactaacgccgcctcgagggtttcagtcgcttctctggctcaagtctggcaacaccggcctccctgaccctatcctcgtcgcctccacgccctaggacgacgagtctagtatttattattgcgtgccttanatangacagattacgttattacgtttggacgggttcgggcggggtacagggtcgtacgtcggtaggtaccgacgccgtaaggccgtcccggtaccccgnggttcccncgttctcccgtccccg

SEQ ID NO: 7059 - DNA, 574 bp, Homo sapiens
  misc_feature: GYAE6OF02GFKLC.23.71.G05.1.454.CMB.1.raw
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgattggttgggtacttttaatatggtctcgtggtaccaatacctccaggcaaacgcccccaaatcatacttangaggcactaagccggccctgtaggggtttctagtcgcttctcgtggctcaagtctggcaacgcggccctcctgaccatcctctcggcctccgacgcctgaccgacgaggtctagtattattattcgcttgctacattacgtgactagtatagttagttacgtttggacgggttcgggacggggtactagggtcgaccggttacgtacggtcgacggaccgaaggtcctcccggtccccgttagtacctaccgttccgtcgttaccccc

SEQ ID NO: 7060 - DNA, 705 bp, Homo sapiens
  misc_feature: GYAE6OF02GBMKZ.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggtactttaatatggtctcgtggtaccaactacctcccaggcaaacgcccccaaactcatactttatgacggcactaaggccggccctcgtaggggtttcctagtccgtcttcctcgtcggccttacccaaagttccttgggaccctaaaccgaccgggtcccctccccgttcgaaccctacttccgttccgtcgggccccttacccgacggtcccctcggaaccggacggtacggccttaggtatttacgtttagttcgaccgttcgtcctctagttatcgacgtaagtattaacggttagttaccgttttggacggggttccggggaccggggggtaaccctaagggtccggtaccggttaccggttaacgggtcccgtaaccggacccggtaacgggtccggttacccggccccccggttaccgggttacctaccccgtttccggttacccggttacccccccg

SEQ ID NO: 7061 - DNA, 542 bp, Homo sapiens
  misc_feature: GYAE6OF02F6BE6.23.71.G05.1.454.CMB.1.raw
  modified_base (303)..(303): a, c, t, g, unknown or other
  misc_feature (303)..(303): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaacgcccccaaatcatacttangaggcactaagcgccctgagggtttctagtcgcttctctggctccaagtcctggacaacgacggcctcccgtgacctatcctcgtcggcctccacgcctgacgacgagctgattattattcgctgctcatatgacagatagtagttacgtttgacggttcgggacggggtacaggtcgaccggtcgtaggtcacgcccgaggccgtaccgccccgtaggtccacgttcctccgtccccg

SEQ ID NO: 7062 - DNA, 542 bp, Homo sapiens
  misc_feature: GYAE6OF02HKQW8.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaacgcccccaaactcatactttatgaggcactaagccggccctgaggggtttctagtcgcttctctggctcaagtctggcaacacgcctccctgaccatctctcggccctccacgcctcggacgacgaggctgattattattcgctgctcatatgacagatagttagttacgtttgacgggttcggacgggggtacagggtcgacggtcgtaggtcacgacccgaggcctcgcccccgtggtccacgttcctcgttcccc

SEQ ID NO: 7063 - DNA, 655 bp, Homo sapiens
  misc_feature: GYAE6OF02H3AU9.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaatcatacttatgaggcactaagcggccctgaggggtttctagtcgtcttctctggctcaagtctggcaacacggccctcctacgacctatccttcgtccgtccctacccacgtcctacggaccggaacggacggtcctagtaatttagttaacgttcgtacttacggcttacgtaattagtcgacgaacgtattaacggtttacgtttacgtttagggttaacggggttccgggggacgggggtaaccgaagggttaccgtacccgggttagggtaacggttccggaaaccggacccggtaacgggtaccgttccccggtaccccgttcggttacctacccgtttccgtcccgttaaccccccg

SEQ ID NO: 7064 - DNA, 566 bp, Homo sapiens
  misc_feature: GYAE6OF02JM6YZ.23.71.G05.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
tcagacgcgagtatcacgaccggtgctcgatttagtgtcgtcgcaagagagaggggggggtcggacgaagaaggcgagcgctctcgggacgtcgtccaccatggcctgggctctgctgctcctcactctcctcactcaggacacagggtcctgggcccagtctgccctgactcagcctgcctccgtgtctgggtctcctggacngtcgatcacgtcncctgcnctggaacccgnagtgatgttgggacttttaatatggtctcgtgtacaatacctccaggtcaagccccaaactcatacttatcgaggcactaagccgccctctaggggttctagtcgcttctctggctcctaagtcttggacaacgacggcctccctgaccctatctacgtcgtcctccacgcctcgacgtaccgaggctgacttattagttgtctagtcctatatattgcagtattagtagttactttagtacgggttcggtcgggggaccgtaaggtcgtacggtcggtacggtcgacgtccgtaaggcgtcgtcccctcggtactccgtcgtccgtccccg

SEQ ID NO: 7065 - DNA, 722 bp, Homo sapiens
  misc_feature: GYAE6OF02J0V6W.23.71.G05.1.454.CMB.1.raw
  modified_base (260)..(260): a, c, t, g, unknown or other
  misc_feature (260)..(260): n is a, c, g, or t
  modified_base (320)..(320): a, c, t, g, unknown or other
  misc_feature (320)..(320): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctcgccctgacctcagcctgcctccgtgtctgggtctccgtggacagtcgatcaccgtctcctgccacgtggaacccgcagtgacttggttgggtaacttttaanagtggtctcggtgtaaccaatacctcccgaggacaaacgcccccaaactctatactttangaggcactagccgcctcgagggtttcagtcgtcttctcgacggtcctaccgtaagtccgtcggacctaaacgccggtaccctccctagaccctattcctcgtcggcccttacgaccgtcctacggaaccggacgtacgggtccttaggttaacttttacgttcgttacggtccttacggtcccttacgtaattacgttacggacctaagtacgtttaacgttaacggtttacggtttaacgggtacgggtttcccggggggacgggggttaaccctaaggggttccgaaccgggtttacggtaacggggttccgaacggtaccccggtaacgggtcccgtttaccccgggtcccccgtaccgggttaccgtaccgtttccggttacccggtttacccccccg

SEQ ID NO: 7066 - DNA, 691 bp, Homo sapiens
  misc_feature: GYAE6OF02JVYB8.23.71.G05.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacaggtcctgggcccagtctgccctgactcagcctgcctccgtgtctgggtctcctggacagtcgatcaccgtctcctgcactggaacccncagtgatgtggacttttaangtggtctgtgaccaatcctccgagcaaacgccccaaatcatacttatgaggcactaacggcgccctgtacgggtttctagtccgtcttctcgtcggtctaccgaagtctcgggacctaaacgccgggtacctcccgtagaaccccgtatccctcgttcggcccttccgacgtcccgtacggaacggaccgtacggtctacgttacttaacttttacgttacgtcgttacgtaccttacgtaactacgttacgtaaccgtagtaagtttaacgttaacggttaccgtttgggtacggggtttaccggggacgggggtaaccttaaggggtaccggttacccggtacggtttaacgggtaccgtaccggaacccgtagggtacccgttcccggtacccccggttcgggttccctaaccgttcccggtacccggtttcccccccgg

SEQ ID NO: 7067 - DNA, 539 bp, Homo sapiens
  misc_feature: GYAE6OF02HOX8N.23.71.G05.1.454.CMB.1.raw
  modified_base (431)..(431): a, c, t, g, unknown or other
  misc_feature (431)..(431): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaatatggtctcgtggtaccaatacctccaggcaaacgccccaaatcatacttatgaggcactagcgcctcgagggttctagtcgtcttctctcgctaccaagtctggacaacgacggcctacccgtgacctatctctcgcctccacgcctgaccgacgagtctgattatagttgctgctcatangcagatacgagttacttgtagggttcgggacggggtactaaggtcgtaccggtcggtaggtccgacgccgtaggcctccgcccgtcggtcctactcgtccgtaccccg

SEQ ID NO: 7068 - DNA, 550 bp, Homo sapiens
  misc_feature: GYAE6OF02IKJ9Q.23.71.G05.1.454.CMB.1.raw
  modified_base (229)..(229): a, c, t, g, unknown or other
  misc_feature (229)..(229): n is a, c, g, or t
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgtggacttttaatatggtctcgtgtaccaatacctccagcaaagccccaaatcatacttangaggcactaagcgcctgagggtttctagtcgcttctctggctcaagtctgcaacgacgcctccngaccatctctcggcctccagcctgacgagagctagattattattgctgctcatatgacagtatagtagttactttggacgggttcgggacgggggtaacaagggtcgaccggttcggtaacggtcgaacggtccccgaagggtccctccggtcccccgttcggtactaccctccgttccgttacccccc

SEQ ID NO: 7069 - DNA, 554 bp, Homo sapiens
  misc_feature: GYAE6OF02G7LMQ.23.71.G05.1.454.CMB.1.raw
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
  modified_base (426)..(426): a, c, t, g, unknown or other
  misc_feature (426)..(426): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnagtgatgttggacttttaatatggtctgtgtaccaatacctccagcaaacgccccaaatcatacttangaggcactaagccggccctcgtaggggtttctagtcgtcttctctgctcagtctggcaacnccgcctcctgaccatcctcgtcgcctccgacgcctgaccgacgaggctgattattattgctgtctnatatgactagatagttagtacgtttgtacgggttcgggacgggggtacctagggtcgtaccggtaggtacggtcgacggacccgtaggcctccggtccccgtcgtcctaccgttccgtccgttccccg

SEQ ID NO: 7070 - DNA, 585 bp, Homo sapiens
  misc_feature: GYAE6OF02IT41E.23.71.G05.1.454.CMB.1.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
  modified_base (411)..(411): a, c, t, g, unknown or other
  misc_feature (411)..(411): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttgggtacttttaatatggtctcgtggtaccaatacctccagcaaacgcccccaaatcaatactttagngaggcacgtaagccggccctcgtaggggtttctagtcgtcttcncgtggcctcaagtctggcaacgcgcctccngaccatctctgcctccgagcctagacgacgngctagtattagttattcgctgtctctatatgactagattacgtagttacgttgggtacgggttcgggaccgggggaactagggtcgtaccggttaggtaggtaccgacgtacccggtaaggtcccgtacccggtccccggttcggtaccctaccgttcccgtaccgttaccccc

SEQ ID NO: 7071 - DNA, 579 bp, Homo sapiens
  misc_feature: GYAE6OF02GSHFN.23.71.G05.1.454.CMB.1.raw
  modified_base (358)..(358): a, c, t, g, unknown or other
  misc_feature (358)..(358): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggacttttaatatggtctcgtggtaccaatacctccaggcaaagcccccaaatcatacttatgaggcactaagcgccctgagggtttcagtcgcttctctggctcaagtctggcaacncggtcctcccgtgacccatccgtctcggcctccagtcctgacgacgaggctgtattattattgctgctgtatactgtcagtattagttagttacgtttaggtacgggttcgggacgggggtaccgtaagggttcgtaccggtacggttacggtccgacggtacccgaacggtccgtaccggtccccgttccggtccgtaccgttccgttccggttcccccg

SEQ ID NO: 7072 - DNA, 515 bp, Homo sapiens
  misc_feature: GYAE6OF02GVAJ5.23.71.G05.1.454.CMB.1.raw
tcagacgcgagtatcacgaccggtgctcgatttagtgtcgtcgcaagagagagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaactcatactttatgagggcactaagcggccctcaggggtttctagtcgcttctctggctccaagtctggcaacacggcctccctgaccatcctctggcctccagcctgacgacgaggctgattattattgcttgctcatatgcagatagtagtactttgaggttcggcgggggacaaggtgacggtcgtaggtcagcccaaggcctcgcccctcggtcactctgttcc

SEQ ID NO: 7073 - DNA, 519 bp, Homo sapiens
  misc_feature: GYAE6OF02FG02V.23.71.G05.1.454.CMB.1.raw
  modified_base (228)..(228): a, c, t, g, unknown or other
  misc_feature (228)..(228): n is a, c, g, or t
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (414)..(414): a, c, t, g, unknown or other
  misc_feature (414)..(414): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttgggacttttaatatggtctcgtggtaccaatacctcccaggcaaacgcccccaaatcatacttangaggcactaagcggccctcgagggtttcagtcgcttctgtggctcagtctgcacncgcctcctnacatctcncggcctcagcctgacgacgagctgattattattgctgctnatatgacagatagttagtactttgaggttcggacggggactaggtcgaccgtgtacgtcacgccctaaggcctaccggcccctcggtcaccgttctcgttccccc

SEQ ID NO: 7074 - DNA, 559 bp, Homo sapiens
  misc_feature: GYAE6OF02G3D76.23.71.G05.1.454.CMB.1.raw
  modified_base (364)..(364): a, c, t, g, unknown or other
  misc_feature (364)..(364): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaagcccccaaatcatactttatgaggcactaagcggccctcgaggggtttctagtcgcttctctggctccaagtctggcaacncggcctccctgacccatcctctcggcctccacgcctgacgacgaggctgtattattattgctgctcatatgcagtatagttagttacgtttgtaggttcgggacgggggtaccgtaagggtcgtaccggtcggtcggtaaaacgcggacccgaacggcgtcgtccccgtcggtcctaccgttccgtcgttccccc

SEQ ID NO: 7075 - DNA, 597 bp, Homo sapiens
  misc_feature: GYAE6OF02FNE1U.23.71.G05.1.454.CMB.1.raw
  modified_base (394)..(394): a, c, t, g, unknown or other
  misc_feature (394)..(394): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggacttttaatatggtctcgtggtaccaatacctccaggcaaacgcccccaaatcatactttatgaggcactaagcggccctcgaggggtttctagtcgtcttctctggctcaagtctggacaacacgcctcctgaccatctctcggcctccncgcctgacgacgaggctgtattattattgctgctatatatgacagtacttagttacgttacgtttggaacgggtttcgggacgggggtaacctaagggtacggtaccggtacggtaacgggtcgtaaccggtcccgtaaagggtcccgttaccggccccccggttacggtaccctacccgttccgttccggtttaccccccgg

SEQ ID NO: 7076 - DNA, 632 bp, Homo sapiens
  misc_feature: GYAE6OF02IWWU8.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggacttttaatatggtctcgtgtaccaatacctccagcaacgccccaactcatacttatgaggcactagcgcctgagggtttctagtctcttctctggtctaccaagttcctaggcaacgaccggtccctccctcgaccattcctctcggccctccgacgtcctgacggacgacggtctagtatttattagttcgtcgtgtcctactaatagtacgacgtaagtagttacgtaaggtttaccgttttagggtacgggtttccggggacgggggtaacctaagggtccggtaccggttacggtaacgggtccgaacgggacccgtaacgggtccgttaccggtccccccgttacgggttacccaccggtttcccgttcccgtttaccccccg

SEQ ID NO: 7077 - DNA, 591 bp, Homo sapiens
  misc_feature: GYAE6OF02F9DVP.23.71.G05.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttggacttttaatatggtctcgtggtaccaattacctccaggcaaagcccccaaatcatacttangaggcaactagcgccctgtagggtttcagtcnttcnctgctcagtctgcaacncgcctcctgaccntccnctcggcctcgacgtcctgacgacgagctagattattagtcgctgtctctatatcgacgtaagtacttaaggttacgttacgtttgggaacgggtttccggggaccgggggtacctaaggggtcgtaccggtcggttaacggtaccgtaacggaccccgtaagggtcccttcccggcccccgttacgggccctaccggtcccgttccggttacccccccg

SEQ ID NO: 7078 - DNA, 579 bp, Homo sapiens
  misc_feature: GYAE6OF02F5VQ7.23.71.G05.1.454.CMB.1.raw
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttaggacttttaatatggtctcgtggtaccaatacctccaggcaaacgcccccaaatcatacttangaggcactagcgccctgagggtttctagtcgtcttctctgctcaagtctggcacncgcctcctnaccntctcgtcgtccctcacgcctgaccgacgacggctgtattattattgcttgctcatatgcaagtattagtacgttacgtttggacgggtttccgggacgggggtaacctaagggttacggacccggttcggtaacggtacaaccggtaccccgaaggtcccgtaccggcccccgttacggtccctaccgttccgttcccgttaccccc

SEQ ID NO: 7079 - DNA, 587 bp, Homo sapiens
  misc_feature: GYAE6OF02G65O9.23.71.G05.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggacttttaanatgtctgtgtaccatacctccagcaagccccaaatcatacttangacggcactaagcggcctgagggtttctagtcgcttctctggctcaagtctggcaacncggcctccctgaccatctcgtcggcctccagcctgaccgacgacggctagtacttattattcgcttgaccttcgattacgtgacgtagaattagttaacgttacttttagggacgggtttcgggaccgggggactaacggggttcgaaccggttcgggtaggttaccgacggtacccaagggtcctacccggtcccccggttggttaccctacgttcccgtacccggttaccccc

SEQ ID NO: 7080 - DNA, 554 bp, Homo sapiens
  misc_feature: GYAE6OF02G1SD2.23.71.G05.1.454.CMB.1.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatactttangagggcactaagcgccctnaggggtttcagtcgcttctctggctccagtctggcaacacggcctccctgaccatcctctcggcctccagtcctgaccgacgaggctgattattattgctgctcatatgcagtatagtagttactttggacgggttcgggcgggggtacctaagggtcgaccggtcggtaggtcacggcccgaaggtcctacggtcccccgttcggtcctaccgttccgtccggttcccccg

SEQ ID NO: 7081 - DNA, 696 bp, Homo sapiens
  misc_feature: GYAE6OF02FF67P.23.71.G05.1.454.CMB.1.raw
  modified_base (227)..(227): a, c, t, g, unknown or other
  misc_feature (227)..(227): n is a, c, g, or t
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctctgcactggaacccnagtgatggttggactttaatatggtactgtcggttaccaattacctcccgaggacaaacgccccccaaatcatacttangtaggcacaagcgcctgagggtttcagtcgnttctctggctcaagtctggacaacgcggaccctcccgtagaccctatcctctcggcccttccgacgtcccgtacggaaccgtacggagggtcttaggtaactttaacgtttagttcgtccttaggtaccttaccgtaagttacgtcggtacctaagggttaactttaacggtttaaacggtttaaccgtttttaggggaacgggtttacccgggggacggggggtaaccctaaagggggttccgaacccgggtttccggttaacgggtcccgaaccgggtacccccgtaaacgggtccccttcccgggtaccccccgttggggttacccacccgttccgttacccggtttaaccccccc

SEQ ID NO: 7082 - DNA, 622 bp, Homo sapiens
  misc_feature: GYAE6OF02F9FYS.23.71.G05.1.454.CMB.1.raw
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaatatggtctgtgtaccaatacctccaggcaaacgccccaaatcatacttangaggcacgtagccggccctcgtagggtttctagtcgtcttcgtctggctccaagtctggacaacgccggcctacccgtcgacctatcctcgtcggccctaccacgtccctacggaccgacggacggtcgttacgtatttaacgttagttcgtcttcgtcctactattagtcgacgtagtaactttaggttaacgttacgtttagggtacgggttaccgggacgggggtacctaaggggtcgtaccgggtacggtaacggtccgaccgtaccgtacggtcctcccggtaccccggtcggtaccgaccgttccgttccgtcccccg

SEQ ID NO: 7083 - DNA, 768 bp, Homo sapiens
  misc_feature: GYAE6OF02JIAXG.23.71.G05.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
tcagacgcgagtatcacgaccggtgctcgatttagtgtcgtcgcaagagagagggggggtcgacaagaggcagcgctctcgggacggtctccaccatggcctgggctctgctgctcctcactctcctcactcaggacacagggtcctgggcccagtctgccctgactcagcctgcctccgtgtctggtctcctggacngtcgatcaccgtntcctgccactcggaacccgcagtgatcggttgggaacctttttaatatcgggtacttcggtaggtaccaataccctcccgagggaccaaacgacccccctaaaatccgtaattaaccttttatacggacggacctaacttaacggccgggccccttacgacggggggtttttactaacggtccggtcctttcgtccgttacgggccttaccgtaaaggttccgttagggtcctaaaaccggcccgggtaccccttcccctacggtaacccaacgtttcctccgttcgggacccttcccacggtacccctcgggaccggaaccggtagggtacccttaggtaacttttaaacgttcgtttagcccgttaggccttaacctagttaacttcgaccggtaagtagttacgttaacggttaccgttttagggtaacgggttcggggacccggggggtaacctaacgggtcggttaacccgggtcggttacggttacacgggtaccccaaggtccgtaccggtccccgtcggttaaccgtccgttacctccgtttacccccg

SEQ ID NO: 7084 - DNA, 681 bp, Homo sapiens
  misc_feature: GYAE6OF02F1LSE.23.71.G05.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcacgtggaacccgnagtgatggttggactttaatatggtctcgtggtaccaatacctccaggcaaacgcccccaaactcatacttanggaggcactaagcgccctgtaggggtttctagtcgcttctcgtggctccaagtctgcaacgacggccctccctgaccatctctcgccctcgacgcctcgacgacgagctagtattattagttcgcttagtctaccgtattacgtcggactaagtacgttaacgttaacgttttacggttttaggggtaccgggtttccgggggtaccgggggggtaaacccggtaaggggtttaccgggtacccgggttaaccgggttaacggggtaccctaacccggggtacccccggtaaagggtccccgttaccccgggttccccccccgtttacggggttaccccttacccggtttaccccggttacccggtttcccccccccgg

SEQ ID NO: 7085 - DNA, 716 bp, Homo sapiens
  misc_feature: GYAE6OF02JZP5C.23.71.G05.1.454.CMB.1.raw
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccgtctcctgcactggaacccgcagtgatgtggacttttaanatggtctcgtgtaccatacctccagcaacgccccaaactcatacttangaggcacgtagcgccctgtagggtttctagtctctctcctggcctaccgaagttcctggacccaaacgtacggtcccctcccgtaggaaccctattcctcgttcgggaccccttaccgacggtcccttacggaaccggaccggtaacgggccttacggtaagttttattacgtttcgacgtttcgccttacctaaattcgtacgtaccgtaggtaactttacgggttaagtttacccgttttgggtaacgggtttcccggggaccggggggtaacccgttaaagggtcccggtacccgggttacggtttaacgggtacctacgggtaacccccggttaaggtcccggtttacccggttaccccccggtaccggttttacccggaacccgttttccccgttcccggggttttaccccccccg

SEQ ID NO: 7086 - DNA, 619 bp, Homo sapiens
  misc_feature: GYAE6OF02I7S1L.23.71.G05.1.454.CMB.1.raw
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (488)..(488): a, c, t, g, unknown or other
  misc_feature (488)..(488): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaaccccgcagtgattggttacgggtaactttttaatagttggtccttcggttacggttaaccaactaccctccccgaaggaccaaaaccgacccccctaaaactctaacttaactttaagtggacgggaccaacgtaacgccggtccctacgtacggggtttctacgtcgtcttctcgtcgctacagtctggacacgcgcctcctnaccatctctcgcctacngcctgacgacgngctgtatatattncgtntctacatatcgntagtagttacgtagttacgtttggacgggttcgggaccgggggtaactaagggtcgtaccggtggttacggctaaccggacctacgggtccgccgtccccggtggtacctaccgttccgtacccgttcccc

SEQ ID NO: 7087 - DNA, 875 bp, Homo sapiens
  misc_feature: GYAE6OF02HFVKB.23.71.G05.1.454.CMB.1.raw
  modified_base (228)..(228): a, c, t, g, unknown or other
  misc_feature (228)..(228): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaaccnagtgatggttaggtacttttaatagtggtctcgtggtacaatacctccaggcaaacgccccaaatcattacttagtgaggcactaagccgcctcgagggtttctagtcgtcttcgctcggtcctccgaagtctacgggtaccaacgtaccggccccttcccgtacggtaaccctaacttccttccgtaccgggtcccctcccgtaccggtaccccgttacggaaccggtaaccggtacgggtacccttaagggttaacttttaaaggttttaccgttacgtaccccggttcgtacccgtttaaccgtaacgttaactttaccgggtaacccgttaaaagggttaaaccgttttaaagggtttaaacggttttttaacccgggtttttacggggtttaaaccgggggggttttacccgggggtaaaccccggggggggggttaaacccgttaaacgggggtttcccgggttaaacccggggttttacccggggttaacggggttacccgggttaacccgggtaacccccgggtaaaaccgggtttccccggttaacccccggggttccccccccggttacccgggtttacccccggttaaccccggtttcccccgggtttaccccggtttttaacccccccccccggg

SEQ ID NO: 7088 - DNA, 692 bp, Homo sapiens
  misc_feature: GYAE6OF02H3QYY.23.71.G05.1.454.CMB.1.raw
  modified_base (300)..(300): a, c, t, g, unknown or other
  misc_feature (300)..(300): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccgcagtgatggttgggacttttaatatggtctcgtgtaccaatcctccaggacaaacgccccaaatcattacttngaggcataagcgcctgtagggtttctacgtcgtcttctcgtggcctacaagttctggaccaacgtaccggcctccgtagaccctatccttccgtcggtcctcccgaacgtccgtcggaaccgacggacggtactacgtacgtttaacttacgttcggtccttcgtaccttactaacgttagttacgcgtaaacgtacgttaacggttaacgtttacgttttagggttaacgggggtttaccggggaaccggggggtaaaccgtaacgggtaccgggtaaccgggttaccgggttaacgggtaaccgtaacgggaccccggtaaacgggcccgttacccgggtcccccgttaccggttacccgtaaccgttcccgttaccgttaacccccccg

SEQ ID NO: 7089 - DNA, 599 bp, Homo sapiens
  misc_feature: GYAE6OF02GMJNK.23.71.G05.1.454.CMB.1.raw
  modified_base (232)..(232): a, c, t, g, unknown or other
  misc_feature (232)..(232): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctcgccctgactcagcctgcctccgtgtctgggtctcctggacagtcgatcaccgtctcctgcacgtcggaacccnagtgagttggttggtaacttttaatattggtctcgttggtaccaacttacctccaggaccaaacgccccccaaaatcaattactttatggacggcaactaacgccggtccctagtacggggttttcagtcgcttctcgtcgctcagtctggcaacncgcctcctgacctntctcgtcgcctcngcctgacgacggtgctagattattatgctnctactntatgtcagtagttagtacgttacgtttgacgggttccgggagggggtaaccctaagggtacggaccgttcgggtaacggcctaaccggacccgtaaggtcccgtcgtccccccggttaggtcctaacccgttcgttccccgttacccc

SEQ ID NO: 7090 - DNA, 561 bp, Homo sapiens
  misc_feature: GYAE6OF02G5MYA.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctgtggtaccaatacctccaggcaaacgcccccaaactcatacttatgaggcactaagccggccctcgaggggtttctagtcgcttctctggctccaagtctgcaacgcggcctcctgaccatcctcgtcggccctccgacgccctacgacgaccgaggccttggtaattattattgctgctatatatgcagtatagtagttactttggacggttcgggacggggtacagggtcgaccggtggtacggtcgacggaccgtaacggtcgtaccgtccccgtcggtccaccgttcgtccgtcccccg

SEQ ID NO: 7091 - DNA, 605 bp, Homo sapiens
  misc_feature: GYAE6OF02HDA2E.23.71.G05.1.454.CMB.1.raw
  modified_base (371)..(371): a, c, t, g, unknown or other
  misc_feature (371)..(371): n is a, c, g, or t
  modified_base (449)..(449): a, c, t, g, unknown or other
  misc_feature (449)..(449): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggacaaacgcccccaaactcaatactttatgaggcacgtaagccggccctcgtagggttctagtcgtcttctctggctccaagtcgtgacaacncgcctccctgaccatcctctcggccctccacgtcctgaccgacgaggctagactttatagttgcttgcctacatactnacgtagaatacgttaagttacgtttagggtagggttacgggcgggggaaccgtagggtacgtaaccggttccgggtaaggttaccgacggtacccgtaacgggcccgttcccggtccccgtccgggttcctaccgttacccttccggttacccccc

SEQ ID NO: 7092 - DNA, 736 bp, Homo sapiens
  misc_feature: GYAE6OF02JI610.23.71.G05.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatggttggtactttaanatggtctcgtgtaccaatcctccagcaaacgccccaatcatacttatgaggcactaacgccgcctagtacgggtttctagtcgtcttctcgtcgtcctaccgtaagtcgtacggaccaaaccgtccggtccccttcccgtacgtaccctacgttccgtccgtccggtaccccttccgaacgtccccgttagggaacccgtaccggtacggtccgttagttaacttttagttaacgttcgtaccttacggtccttaactaatttacgtaaggtaacgttaaagttacgggtttagtttaacccgttttaggggtaaaccggggtttccgggggtaaccggggggtaaccttaaagggggtcccgttaacccgggttcgggtttaacgggtcccgaaccggtaccccggtaaggtcccggttaccccggtacccccgttagggttccccgtaaccgtttccccggttcccggttaccccccgttcccg

SEQ ID NO: 7093 - DNA, 812 bp, Homo sapiens
  misc_feature: GYAE6OF02HSMA1.23.71.G05.1.454.CMB.1.raw
  modified_base (309)..(309): a, c, t, g, unknown or other
  misc_feature (309)..(309): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttgggtacttttaatatggtctcgtggtaccaatacctccgaggacaaacgccccaaactctatactttangaggcactaagccggccctcgtaggggtttctagtccgtcttctcgtcggcctaccaagtccgtaggaccaaacgtccggtacccttcccgtacgaaccctacttcccgttaccgtccggtaccccttacccgacgtaccccgttaggaaacccggtaccggtaacgggtaccttaacggttaaacttttaacggtttaacgtttcggtaccgttcggtacccttaacgtaacgttaacgttcggaaccgttaaaggtaacgtttaacggtttaacggttttaaccgttttacggggtaaaccgggggtttcccgggggaaccgggggggtaaaccccgtaaagggggttacccgggtaacccgggtttacggggttaaccgggttacccgtaaccggggtaacccccgttaaacgggtccccgtttacccgggtaccccccccgggttacggtttaccccgtaacccggttttccccgttaccccggttttaaccccccccg

SEQ ID NO: 7094 - DNA, 719 bp, Homo sapiens
  misc_feature: GYAE6OF02IFSFS.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgttctcctgcacgtacggaacccgcaggtgtagttggttagggtaactttttaaatagttcggttcttcggttacggtaacctaaactacccctcccgaaggaccaaaaccgtaccccccaaaacttctaacttaacttttagtacggaacgggtactaacgtaacggccggtacccgtaggtacgggttttactacgtccgtcttccgtcgtcggtccttaccgtaacgttccgtggaccaaccgtaccggtccctcccgtacgaacctacttccgtcgtacgtccctccgacgtcctacggacggacgacggtctagtactttacttagttcgcgttcgtactataagtatcgactaaggtaactagttacgttacgtttagggtacggggttcggggaccggggtaacgtacgggtcgtacgggtcggtaacggtaccgtaaccggccgtaacgtccgttacccggtccccgttaccggtcctaccgttccgttcccgttaccccg

SEQ ID NO: 7095 - DNA, 601 bp, Homo sapiens
  misc_feature: GYAE6OF02IPSZM.23.71.G05.1.454.CMB.1.raw
  modified_base (308)..(308): a, c, t, g, unknown or other
  misc_feature (308)..(308): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggtacttttaatatggtctcgtggtaccaatacctcccaggcaaacgcccccaaatcattacttangagggcactaagcgccctacgagggtttctagtcgcttctctggctccagtctggacaacgcggcctccgtgacctatcctcgtcggccctccgagccctaggaccgacgaggctagtacttattaacgttgaccttgccttctatagttcgacgtagtaatagttaagttactttaggacgggttcgggaccgggggtactaagggtcgaccggttcggtaacgggtccacggacccgtaacggcctccggtacccccgttcggtacctaccgttccgttccgttacccccg

SEQ ID NO: 7096 - DNA, 557 bp, Homo sapiens
  misc_feature: GYAE6OF02HFZ9L.23.71.G05.1.454.CMB.1.raw
  modified_base (250)..(250): a, c, t, g, unknown or other
  misc_feature (250)..(250): n is a, c, g, or t
  modified_base (441)..(441): a, c, t, g, unknown or other
  misc_feature (441)..(441): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaanatggtctcgtggtaccaatacctcccaggcaaacgcccccaaactcaatactttatgagggcactaagccgccctgaggggtttcagtcgcttctctggcctccaagtctggcaacgacggccctccctgaccctatcctctcggccctccacgcctgaccgacgaggctgatttattattgctgctcatngctagatagtagttactttgagggttcgggacgggggtactaagggtcgaccggtcggtaggtcgacggacccgaaggcctccggcccccgtggtccaccgttcgtccgtcccccg

SEQ ID NO: 7097 - DNA, 705 bp, Homo sapiens
  misc_feature: GYAE6OF02HWGU5.23.71.G05.1.454.CMB.1.raw
  modified_base (418)..(418): a, c, t, g, unknown or other
  misc_feature (418)..(418): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctcgggcccagtctgccctgactcagcctgcctcgtgtctgggtctcctggacagtcgatcaccgtctcctgcactcggaacccgcagtgattggttgggtacttttaatatggtcttcgtggtaccaactacctccaggaccaaacgcccccaaaactcaacttactttatgaggtcacgtaagccggccctagtacggggtttctagtcgtcttccgtcgtggccttacgaagtcgtacggaccaaacgcccggtcctcccgtagaaccctnttcgtaccgtcggaccctccgaacgtcccgtacggaacccggtaacggacggtaccgttagtaacgttttattaacgttcggtcctcgtccttacctatacgtcgacctaagtacgttaacggttacgttaacgtttcggtaacggggttccgggaccggggggtaaccgtaacgggttacggtacccggttacggttacgggttaccgaacggtaaccccggtaacggtccgtacccggtaccccggtcggttacccgtaccgttcccgttaccggttccccccgg

SEQ ID NO: 7098 - DNA, 528 bp, Homo sapiens
  misc_feature: GYAE6OF02G11YL.23.71.G05.1.454.CMB.1.raw
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttangaggcactaagcgcctgaggggtttcagtcgcttctctggctccaagtctggcaacncggcctcccngaccatcctctggcctccagcctgacgacgaggctgattatttntcgctgctacatatgcagtatagtattacgtttgagggttcggcgggggacagggtcgaccggtcggtaaggtcacggccctaaggcctcggccccgtgtccactcgtccgtcccg

SEQ ID NO: 7099 - DNA, 711 bp, Homo sapiens
  misc_feature: GYAE6OF02GUHRV.23.71.G05.1.454.CMB.1.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgnagtgattgttgggtacttttaatatggtctcgtggtaccaaaaatcctccaggacaaacgccccaaatcatacttangaggcactaagccgcctgtagggtttctagtcgcttctctggctcaagtcgtaggacaacgaccggtccctccctacgaaccctactcctacgtcggtccctccgtacgcccgtaggaccggacgaggtccttaggtaactttagtttacgttcgtacttcgtacctactaacgttagtcgaacctaaggtacttaaacggtttaacggtttaacggttttagggtaaccgggggttttaccggggaaccgggggggtaacctaaacgggggttcggtaacccgggtttacgggttaacggggtacccaaccgggtacccccggtaaacgggtcccgttaccccggtaccccccggttcggttaaccccgtacgtttaccccgttacccgtttaacccccccg

SEQ ID NO: 7100 - DNA, 639 bp, Homo sapiens
  misc_feature: GYAE6OF02GKZR1.23.71.G05.1.454.CMB.1.raw
  modified_base (619)..(619): a, c, t, g, unknown or other
  misc_feature (619)..(619): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcaggtgattggttgggtacttttaagtatggtctcgtaggtaaccaactacctccgaggaccaaacgcccccaaatctaacttacttagcggaggcaacgtaacggccgccctggtacgggtttcagtcgtcttctcgtcggctactagtctggacaacgaccggtcctccgtcgacctatcctcgtccggccctacgccgtcctcgaccggacgacggcttagtacttattacgttgtccttgtcttactaatgtcgtacgtaagtagttaacggttagtttacgtttagggacgggttcggggacgggggtaacctagggtcggtaccggtacggtaacggtcgaaccggtaccggtacggtccgtacccggtccccgtacggtaccncgttcccgtacccgttcccc

SEQ ID NO: 7101 - DNA, 642 bp, Homo sapiens
  misc_feature: GYAE6OF02J0RHK.23.71.G05.1.454.CMB.1.raw
  modified_base (306)..(306): a, c, t, g, unknown or other
  misc_feature (306)..(306): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgagtgttgggtacttttaatatggtctcgtggtaccaatacctccagaccaacgcccctaaactcatacttancgaggctacgtaacgccggtcctacgtacgggtttctacgtcgtcttacgtctcggtctcctaagtctcggcaacgaccggcctcctcgacctactcgtctcggccctccgacgtccacgaccgacgacggtctaggtaacttagttacgttcgtacttacgtccgttccaattcgtacgactacgtaagtttacggtaaggtttacgtttacgggtacgggttcggggacccggggtaagaacgggtcgtaaccgggttcggtaacggttacgacggtacccgaacgtccgtaccgtccccggtccggttactaccgttccgaccgttacccccg

SEQ ID NO: 7102 - DNA, 643 bp, Homo sapiens
  misc_feature: GYAE6OF02GJD66.23.71.G05.1.454.CMB.1.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccnagtgatggttggtacttttaatatggtctcgtggtaccaatacctccaggcaaacgccccaaatcatacttangaggcactaagcgcctcgagggtttctagtcgtcttctctcggtctccgtaagtctggaccaacgaccggtccctacccgtcgaaccctattcctcgtcgggccctaccgacgtccgtcgaaccggacgtacggtctacgtatttattacgtttcgccgttcgcctactaatagtcgcaagttactaggttacgttacgtttcgggacgggttcggggacccgggggtaactaacgggtcgtaccgggttacggtaacgggtaccaaccgggtcccgaaggtcccgtacccggttcccccgttacgggtaccctacgtttcccgtcccgtttaccccccg

SEQ ID NO: 7103 - DNA, 521 bp, Homo sapiens
  misc_feature: GYAE6OF02FMU2O.23.71.G05.1.454.CMB.1.raw
  modified_base (229)..(229): a, c, t, g, unknown or other
  misc_feature (229)..(229): n is a, c, g, or t
  modified_base (330)..(330): a, c, t, g, unknown or other
  misc_feature (330)..(330): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (414)..(414): a, c, t, g, unknown or other
  misc_feature (414)..(414): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaatatggtctcgtggtaccaatacctccaggcaaacgccccaaatcatacttatgaggcactagcgcctgtagggttctagtcncttctcgtgctcagtctgcacgcgcctcctnaccatctcncgcctcngcctgacgacgagctgtatattatgctgctcatatgnaagtatagtagttacgtttggacggttcgggacggggacagggtcgacggtcggtaggccgacgaccgaacggcctccgtccccgtcgtacctctcctcgtaccccg

SEQ ID NO: 7104 - DNA, 734 bp, Homo sapiens
  misc_feature: GYAE6OF02GVAA7.23.71.G05.1.454.CMB.1.raw
  modified_base (229)..(229): a, c, t, g, unknown or other
  misc_feature (229)..(229): n is a, c, g, or t
  modified_base (382)..(382): a, c, t, g, unknown or other
  misc_feature (382)..(382): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttgggacttttaatatggtctcgtggtaccaatacctccagcaaacgcccccaaatcatacttatgaggcactaagccggccctcgaggggtttctaggtcgcttctcgtggctcaagtctaggcaacgacggcctcctgacctntcctcgtcggcctccgacgtcccgtaggaaccgacggaggtccttaggtaactttaagtttaacgtttcgaccgtttacgtccgttactaactttatcgggtacgtaaacgtacgtttaacggttaacggttttaaccgtttttaggggtaacggggttttcccggggggaacccgggggggtaaccgtaaaacgggggttccgggttaacccgggtttcggggttaaaccggggttaccggtaaaccgggtacccccggtaaacggggttcccgttaccccggggtaccccccccggtttacgggtaaccccgtaacccgttttcccggttaccccggtttaccccccccg

SEQ ID NO: 7105 - DNA, 628 bp, Homo sapiens
  misc_feature: GYAE6OF02JAI5B.23.71.G05.1.454.CMB.1.raw
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttanatgtctcgtgtacaatacctccaggcaagccccaancatacttangaggcactaagcgccctgtacgggtttctacgtcgtcttctctggctccagtctggcaacgacggcctccctcgacctactcctcgtgtccctccgacgctcgacgacgagctgtacttattagttcgcttgtcctacgatagtcgtacgtaagtagttaacggttagtttacgttttaggtacggggttacccgggtcgggggggaacccgtaagggttcgggtaaccggttacgggtaacggtccgtaacgggtaccccgaagggtcccgttacccggtccccccggttccgggttacccgtacccgttcccggttaccgtttcccccccgg

SEQ ID NO: 7106 - DNA, 627 bp, Homo sapiens
  misc_feature: GYAE6OF02IVFJO.23.71.G05.1.454.CMB.1.raw
  modified_base (421)..(421): a, c, t, g, unknown or other
  misc_feature (421)..(421): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgccactcggaacccgcagtgatggttgggtacttttaatatggtctcgtgtaccaatcctccagacaacgccccaaatcattacttagtgaggcacgtagccgcctgtagggtttctagtcgtcttctctcggctacctaagtctggaccaacgccggcctccctcgacctactcctcgtcgcctccacgtcctacgacgacgngcgtagtacttattagttcgtctcgctacgtatagtcacgaagtagtagttaacgttacgtttacgggtacggggttacgggaccgggggtaacgtaacgggtacggtacccggttcggttaacggtccgtaaccgtcccggtaacggtcccgtacccggtaccccgttccggtaccctacccgttaccgttcccgttaccccccg

SEQ ID NO: 7107 - DNA, 533 bp, Homo sapiens
  misc_feature: GYAE6OF02FR5LF.23.71.G05.1.454.CMB.1.raw
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (424)..(424): a, c, t, g, unknown or other
  misc_feature (424)..(424): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttggacttttatatggtctgtggtaccaatacctccagcaaagcccccaaactcatacttangaggcacaagcggccctgaggggtttctagtcgtcttctctggctcaagtctggcacgacggcctcccgtgaccatctctggccctcagcctgacgacgagctgattattattgctgctcatangcagatagtagtacgtttgaaggttcgggacggggaactagggtcgaccgtcggtagcgtacgcccgaagtccgtccgtccccgtcggtccaccgttctccgttccccg

SEQ ID NO: 7108 - DNA, 586 bp, Homo sapiens
  misc_feature: GYAE6OF02G3134.23.71.G05.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttgggtacttttaatatggtctcgtggtaccaatacctcccaggcaaacgcccccaaactcatacttatgaggcactaagccggcctcgagggtttctagtcgtcttctctggctccagtctggcaacgacggcctccctgaccatctcgtcgcctccacgcctgacgtacgaggtctagtattattagttgctgcctacatatcgacagtagtagttagttacgtttggacgggtttcgggaccgggggtaactaagggttccgtaccggttcggtaacggtccacggtacccgtaagggtccgttcccggcccccgttcggtccctacgtttccgtacgttccccg

SEQ ID NO: 7109 - DNA, 648 bp, Homo sapiens
  misc_feature: GYAE6OF02H12AC.23.71.G05.1.454.CMB.1.raw
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgatgttgggtactttttaagtatggtctcggtggtaaccaatacctccaggcaaacgccccaaaactcaattactttagtgaggcaactaagccggcctcgtagggttctagtcgtcttctcgtcgcctacagtctggacacgacgtcctccgtcgaccnttcnccgtggtcctaccacgtcctacggtaccgaacgacggtccgttaggaattttattacgttcgtacttcgtaccttctaattacagtcaagtagttaacgttacgtttacggtttgggtaaccggggttcggggaccgggggtaacgtaagggttccggtaccgggttacggtacggttaccgaacggcccgtaacggtccgttccggtccccggttaccgtcctaccgtttcccgttccgttaccccgg

SEQ ID NO: 7110 - DNA, 576 bp, Homo sapiens
  misc_feature: GYAE6OF02F6JVF.23.71.G05.1.454.CMB.1.raw
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatggttggacttttaatatggtctcgtgtaccaatacctccaggcaaacgcccccaaatcatacttangaggcactaagccggccctcgagggtttctagtcgcttctctgctccaagtctggcaacgacgcctcccngaccatctcgtcgccctcacgcctcggacgacgaggcttcgattattattgctgcttacgatatcgctaagagttaagttacgttactttggtacgggttccggggacgggggtaacctagggtcgtaccggtcggttaaggtccgagtacccggaaggtccgtccgtcccccgttcggtcctaccgttccgtccgttccccccg

SEQ ID NO: 7111 - DNA, 627 bp, Homo sapiens
  misc_feature: GYAE6OF02FRMHM.23.71.G05.1.454.CMB.1.raw
  modified_base (315)..(315): a, c, t, g, unknown or other
  misc_feature (315)..(315): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtcgattggttgggtaactttttaatagttggtctcgtggtaccaactacctccaggcaaacgcccccaaactcatactttangaggacactaagcggccctgtaggggtttctagtcgtcttctctcggctccgaagtctaggacaacgaccggtccctccctcgaccctactcctcgtcggtccctccgacgtcctacgaccggacggacggtctagtaactttattattgcgttgctactatagtgacgtagtagtagttacgttacgtttggacgggttcggggacgggggtaaccgaagggtccgtaccggttacggtacggtaccgacggacccggaaggtccgtcccggtccccgttacggtacctaccgttccgtccgttacccccg

SEQ ID NO: 7112 - DNA, 839 bp, Homo sapiens
  misc_feature: GYAE6OF02HIU85.23.71.G05.1.454.CMB.1.raw
  modified_base (236)..(236): a, c, t, g, unknown or other
  misc_feature (236)..(236): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctcgtgtcgtgggtctccgtggacagtcgactcaccgttctcctgcaccgtaggaacccntaggtgattcggttggtaactttttaatagtggtctcggtacggtaacctaaataccctacccgtaggaccaaaaccgacccccctaaaacgtctaacttactttaagtacggacgggtaccaaccgttaacggcccggtacccttacggtacgggggtttttacctacggtcggtcctttccgtacgtcggtacccttaccgaagttccgtacgggaccaaaccgaccggtccctacccgtacgtaccctacttccgtcgtacggtcccttccgaacgtcctacggaccggaacggtacggacgttaggtaactttacttagtttacggtccgttcggtacccttgtaaacttacgtacggtaccgtaaagtagttttaaaccgggtttacgttttaaccggttttacggggtaccgggggttttacccgggggaaccggggggggtaacccttaagggggttacccggtacccgggttaccgggtttaaccggggtacctacccgggtaaccccggtaacgggtaccccgtttaccccggtccccccggttaaccgggtccccgttaacccgtttaccccggttccccgtttaaccccccg

SEQ ID NO: 7113 - DNA, 584 bp, Homo sapiens
  misc_feature: GYAE6OF02HZIVF.23.71.G05.1.454.CMB.1.raw
  modified_base (431)..(431): a, c, t, g, unknown or other
  misc_feature (431)..(431): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccagcaacgccccaaatcatactttatgaggcacgtaagccggccctgaggggtttctagtcgcttctctgctaccagtctggacacgccggcctacctgaccatctctcgcctccagcctgaccgacgaggctagtatttattattcgcttgcctnatagtgactagattagtagttacgtttaggtacgggttcgggaccgggggaactaagggtccggtaccggttacggtacggtaccacggaccccgtaaggtcccgtaccggtcccccgttcggtacccgtaccgtttccgtcgtttacccccg

SEQ ID NO: 7114 - DNA, 624 bp, Homo sapiens
  misc_feature: GYAE6OF02JBWPP.23.71.G05.1.454.CMB.1.raw
  modified_base (422)..(422): a, c, t, g, unknown or other
  misc_feature (422)..(422): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtcctgggtctcctggacagtcgatcaccgtctcctgcactcggaaccgcagtgattggttggaacttttaatatggtctcgtgtaccaatcctccagcaaacgcccaaatcaatacttatacgacggtctacgtaacgccggtacctcgtaggggtttctacggtcgtctttcctgtcgtctacctaaggtccgtacggaccaaacggtaccggtccctacccgttaggaaccctagttccnccgttacggcccttcgacgccgtcgaacgtacggagtcgtagtacgttaattacgttcgtctacgtctcgactagtcgacacgtagtacgtagttacgttagtcggttacggacgggtacgaaggtcgtacgtacgtacgtacgacggtaccgaacgtccgtaccgtccccggtacgtccgtaactccgtaccgttaccccg

SEQ ID NO: 7115 - DNA, 555 bp, Homo sapiens
  misc_feature: GYAE6OF02GQAM3.23.71.G05.1.454.CMB.1.raw
  modified_base (229)..(229): a, c, t, g, unknown or other
  misc_feature (229)..(229): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgattggttggtacttttatatggtctcgtgtaccataccnccagcaacgccccaatcaatacttangaggcactaagcgcctnagggttctagtcncttctctgctcagtctggcaacgcgcctccctnacctatcctcncgcctcngcctgacgacgagctagtattattagtcgtctcgactcatagtcgagtaagtagtagttacgttacgtttagggacgggttcgggaccgggggtaactaagggtcggaccggttggacggtcgacgtaccgacggtcttccggcccgtacggtcctcgttccgtcccgttaccccg

SEQ ID NO: 7116 - DNA, 854 bp, Homo sapiens
  misc_feature: GYAE6OF02JTTKK.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgagttggttagggtaactttttaatagttcggtacgttccggttaggtaacctaaactaccctcccgaacggacctaaaaccgaccccctaaaacttcaacttactttataggacgggtaccaacgtaacggtcccggcccttacggtacggggtttacctaggttccgtaccttcgtacgtcggtacctaccgtaagtccgtaggtacccaacggtacccgtccccttacccgtacgtaaccctacttccgtcgtccggtacccctaccgacgtacccgttcggaaccgaccggtaacgtccgttagtaacttttaattacggttcgaccgtttcgtacccgtagtaacttaacgttcggaaccttaaggtaacgttttaacgggttaaccgtttttaacggttttaggggtaaccgggggttccggggtaaacccgggggggttaaccgtaacgggggtttacccgggtaaccggtttaacccggggttaaccgggttaccgtaaacccgggggtaaccccggttaaaccgggttccccgtacccccgggttacccccgtttacgggttaccccgttaacccggttttccccggttacccccggttttaaccccccc

SEQ ID NO: 7117 - DNA, 663 bp, Homo sapiens
  misc_feature: GYAE6OF02FWD63.23.71.G05.1.454.CMB.1.raw
  modified_base (231)..(231): a, c, t, g, unknown or other
  misc_feature (231)..(231): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagacgcgagtatcacgaccggtgctcgatttagtgtcgtcgcaagagagagggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttgggacttttaatatggtctcgtggtaccaatacctccagcaaacgcccccaaactcatacttatgaggcactagcgccctcgagggtttctagtcgcttctctggctcagtcngcacncggcctccnaccatcctctcggccctccgacgtccgtacgaccgaccggagtccgtagtaactttatttaacgttcgacttcgccttacgtatttaacgtcgacgtagtagttaacggttaacgtttacgttttagggaacggggtttaccgggggaccgggggggtaaacctacggggttaccggtacccggtttaccgggtaacgggtacccgtaacggaaccccggtaagggtcccttccccgggtccccccgttaccgggtacccttacccggttcccgttcccggtttaaccccccccg

SEQ ID NO: 7118 - DNA, 705 bp, Homo sapiens
  misc_feature: GYAE6OF02H1NLM.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctctgcactggaaccgcagtgatgttggtacttttaatatcggtctcgtggtacaatacctccaggacaaacgccccaaactcaactactttatggaggcacgtaagcggtccctgtacggggttctaggtcgtcttctcgtacggtcctaccgaagttctacggacctaaaccgaccggtcctccctaggaaccctactccttccgtcgtaccctccgtacgccgttacgaccggaacggtacgggtctacggtatttaacgttaacgttcgtacgtcgtcctactaactacgtacgtacgaagtaacgttaacggttaagttaacgttttggtaacggggttaccggggtaaccggggggtaaccgtaacggggtaccgtacccgggtttacgggtaacggtaccggtacggtaccccgaaacgggtcccgttacccggtcccccgtaccggtttacccgtaccgtttcccgttacccggtttacccccccgg

SEQ ID NO: 7119 - DNA, 604 bp, Homo sapiens
  misc_feature: GYAE6OF02IQJ6F.23.71.G05.1.454.CMB.1.raw
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggtactttaatatggtctcgtgtaccaatacctccagcaacgccccaactcatacttatgaggcactaagccgcctcgagggtttcagtcgcttctctcggctacaacgttcngcaacncggcctccngacccatcctcgtcggccctccacgcctggaccgtacgcggtctagatttattattgctgtcctctatatggacaagtagttagtacgttagttttcggaagggtttcggggacggggggtaaccgtaagggttccggtaaccggttccggtaacgggttaccgacggtaacccgtacggtccggttcccgcccccggttcggtacctaccgttccggttacccgtttacccccg

SEQ ID NO: 7120 - DNA, 733 bp, Homo sapiens
  misc_feature: GYAE6OF02IQDYF.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttggtactttaatagtgtctcgtcggtaccaatacctcccaggcaaacgcccccaaactctatacttatggaggcacgtaacgccgtccctcgtacggggtttctacggtcgtcctttctcgtcggccttaccgtaagttccgtaggacctaacgtacccggtccccttacccgtcgtaaccctacttccctccggttccgggtacccctacccgtacggtaccccgttcggaaccggtaccggtaacggtcgttacggtaacttttacgtttacgtttcgtacttcggtccttaccgtagttacgtcgacgtaacgtagttaacgttacgtttacgtttagggtacggggtttacggggaccggggggtaaccgtaacggggtcgtacccggttacggggtacgtaccgtaccgggacccgttaacgggtcccgttacccgggtccccccgttacggttaccctacccgtttcccggttacccggttccccccg

SEQ ID NO: 7121 - DNA, 627 bp, Homo sapiens
  misc_feature: GYAE6OF02JILJ6.23.71.G05.1.454.CMB.1.raw
tcagacgcgagtatcacgaccggtgctcgatttagtgtcgtcgcaagagagagggggggtcgacaagaggcagcgctctcgggacgtctccaccatggcctgggctctgctgctcctcactctcctcactcaggacacaggtcctgggcccagtctgccctgacctcagcctgccctccgtgtcctgggtctcctggacagtcgatcaccgtctcctgcctactcggaacccgcagtcgatggtgggtacttttaatatggttctcgtcgtaccaatacctccagtcaaacgcccccaaactcaactacttactagtacggactacgtaagccggccctagacgggtttctacgtcgtcttctctggtcctcctaagtcctggacaacacggtcctaccctgacccatcctacgtcgtaccctccgacgcctcgaaccgaccgaaggcctagtaacttactttagttacgtcgtacgtactcgtaatagttgcctaagtaccttagttacgttaacgtttgtaacgggttcgggaccgggggtacagggtcgtaccggtcggtaacggtcacggacccagtccgtaccgtccccgttcgtaccgtaccttccgtaccgttacccccg

SEQ ID NO: 7122 - DNA, 577 bp, Homo sapiens
  misc_feature: GYAE6OF02GTIKY.23.71.G05.1.454.CMB.1.raw
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtgtaccaatacctcccaggcaaagcccccaaatcatacttangaggcactaagcggcctcaggggtttctagtcgcttctctggctcaagtctggcaacncggcctcctgaccatctctcggccctcacgcctgaccgagaggctagtattattattgctgctacattactgactagtattagtagttacgtttgaagggttcgggacgggggtaacctaagggtcggtaccggttacggtacggtaccgaacggtcccgtaagggtcctacccggtcccccgttcggtaccctaccgttccgttaccggttacccccc

SEQ ID NO: 7123 - DNA, 663 bp, Homo sapiens
  misc_feature: GYAE6OF02HGSF5.23.71.G05.1.454.CMB.1.raw
  modified_base (229)..(229): a, c, t, g, unknown or other
  misc_feature (229)..(229): n is a, c, g, or t
  modified_base (302)..(302): a, c, t, g, unknown or other
  misc_feature (302)..(302): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggacttttaatatggtctcgtggtaccaatacctccaggcaaacgccccaaatcaatacttangaggcactaagcgcctgagggtttctagtcgtcttctctcggctcagtctggcaacgccggtcctcctcgaccactctcgtcggccctccgacgtccctaggaaccgtacggaggtcctagtaactttacgttattcggcttcggtccttactaagttactcgtaaccgtaagtacgttaaggttacgtttacgttttagggtaacggggtttaccgggaaccggggggtaacctaacggggttacggtaacccggtttacgggttaacgggtaccgaaccgggtaccccgtaacgggtcccgttacccggtcccccggttacggttaccctaccgtttcccgttacccgtttaccccccg

SEQ ID NO: 7124 - DNA, 702 bp, Homo sapiens
  misc_feature: GYAE6OF02IYVR0.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatggttggtacttttaatatggtctcgtggtaccaatacctccaggacaaacgccccaaactcaacttactttagtgacggacacgtaacggccgtccctacgtagggtttctagtcgtcttctcgtgcctactaacgtctggacaacgaccggtcctacccgagtacctactccgtacgtcggtccctaccacggtccctacgacccggtacggacggtacgttagttaactttagtttaacgttcgtacgttcggtccttaccgttaatacgtacgaccgtaagttaacgttaaggtttacggtttaacgtttggggtaacggggtttcccggggaacgggggtaaccgtaagggttaccggtacccggttacgggttacgggttaccgaccggtacccgtaacggtcccgttaccggtcccccgttacgggttaccctaccgtttaccgttcccgttaacccccg

SEQ ID NO: 7125 - DNA, 589 bp, Homo sapiens
  misc_feature: GYAE6OF02F7JSC.23.71.G05.1.454.CMB.1.raw
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactggaacccnagtgatgttaggtacttttaanatgtctcgtagtaccaatcctccagcaagccccaatcatacttangaggcacgtaagccgcctgtagggttctagtcgtcttctcgtcgctcgagtctaggcaacgacgcctcctgaccatcctctcggccctcagcctgtacggacaggctgtattattattcgctgcctcatatacgcaagtattagttaagtttacgtttgggacgggtttccgggggacggggtaaccgtaaggggttccgtaccgggttacggttaagggtccgtaaccggacccgtaagggtccttcccggacccccgttggtccctacccgtttccgttaccccgttcccccg

SEQ ID NO: 7126 - DNA, 696 bp, Homo sapiens
  misc_feature: GYAE6OF02JWXC7.23.71.G05.1.454.CMB.1.raw
  modified_base (233)..(233): a, c, t, g, unknown or other
  misc_feature (233)..(233): n is a, c, g, or t
  modified_base (446)..(446): a, c, t, g, unknown or other
  misc_feature (446)..(446): n is a, c, g, or t
  modified_base (488)..(488): a, c, t, g, unknown or other
  misc_feature (488)..(488): n is a, c, g, or t
tcagacgcgagtatcacgaccggtgctcgatttagtgtcgtcgcaagagagagggggggggtcgacaagaggcagcgctctcgggacgtctccaccatggcctgggctctgctgctcctcactctcctcactcaggacacagggtcctgggcccagtctgccctgactcacgcctgcctccgtgtcgtgggtctcctggacagtcgatcaccgtctcctgcactcggaacccncagtgagtggtaggtacttttaatagtgtctgtgtacaactacctccagcaacgaccccaactcactattatgacggacactacgcggccctcgtacgggtttctaggtcgtacgttctacgtcggtctaccagtacgtacggcaacaccggtaccctcccgtacgaccctatccttacgtcggtccctcgtacgccgtcgaccggaaccggnggtactgtactttagttcttacgtctcgtctacgtatacgtnactaggtaacgttacgttaattccgttttagggtaacggggtttaccggggaacccggggggttaaccgttaaacgggggttcccgtaaccgggttacgggtaccgggttaaccggtaaccggtaccccgttaacgggcccggttaacccggtcccccggttacccggtaccggtacccgtttcccggttacccgtttaacccccccg

SEQ ID NO: 7127 - DNA, 558 bp, Homo sapiens
  misc_feature: GYAE6OF02IKQDT.23.71.G05.1.454.CMB.1.raw
  modified_base (302)..(302): a, c, t, g, unknown or other
  misc_feature (302)..(302): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatgttgggtacttttaatatggtctcgtggtaccaatacctccagcaagcccccaaatcatacttangaggcactaagcgcctgagggtttctagtcgcttctctggcctcgaagtctggacaacgccggcctccctgaccatctctcgcctcacgcctgacgacgagctgtattattattgtctgtctctatatgcagtatagtagttacgttggtacgggttcgggaccgggggactaagggtcgtaccggttcggtaggtaccgacggtacccgaggtccgtccggcccccgttcggtcctacgttccgttccgtccccc

SEQ ID NO: 7128 - DNA, 690 bp, Homo sapiens
  misc_feature: GYAE6OF02JPVLW.23.71.G05.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (298)..(298): a, c, t, g, unknown or other
  misc_feature (298)..(298): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggacttttaanatggtctcgtgtaccaatcctccaggcaaacgccccaaatcatacttangaggcactaagccgcctgagggtttcagtcgcttctcgtggtcctaccgtaagtccgtgggaccaaacgaccggtcccttaccccgtaggaacccctattccgtttccgtccgggtcccttacccgaagtcccgttcggaaccggaccgggtaacggtccgttaggtaactttttaacttacgtttcggtaccttcggtaccttactaacgttacgttcgaccgtaaagtacgttaggttaacgtttacgttttggtaacggggtttcgggaacggggggtaacctaaggggttcgtaaccgggttacggtacgggttactaccgggacccgtaagcccgttccggtaccccccggttaggttaccctaccggttccgtccggtttcccccg

SEQ ID NO: 7129 - DNA, 784 bp, Homo sapiens
  misc_feature: GYAE6OF02IP02S.23.71.G05.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctcgccctgactcagcctgcctcgtgtctgggtctcctggacngtcgatcaccgtctcctgcactggaaccccnagtgatggttggtaacttttaatagttggtcttcggtggtaaccaactacctacccaggacaaaccgacccctaaactctaattactttagtggaacgggctaacgtaacgccggtcccttacgtacggggtttcttacggtcgtctttcgtcgttcggtaccctaccgtaagttccgtaggtacccaaaccgaccgggtcccttaccccgttacggaaccctaaccgttccttaccggtccggtaccccttcccgtaaccgtccccggtaacggaaccgggtaaccggtacggtaccttagggttaaacttttagttttacgttacggtccgttaccgttcgttaaccttaagttacgtcgtacaaggtttaacgtaaacggtttacgtttaaccgtttagggtacggggttaccggggaaccggggggttaacctaacggggtcggtaaccgggttaccggtacggtacccggtaacggtaccccggtaaggttccctaccggtcccccggtcgggttaaccctaccggttccggttcccggttacccccg

SEQ ID NO: 7130 - DNA, 523 bp, Homo sapiens
  misc_feature: GYAE6OF02FOJP0.23.71.G05.1.454.CMB.1.raw
  modified_base (303)..(303): a, c, t, g, unknown or other
  misc_feature (303)..(303): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagccccccaaatcatactttangaggcactaagcggccctcaggggtttcagtcgcttctctggctccaagtctggcaacacggcctccctgaccatctctggcctcagcctgacgacgacgctgattattattgcctgctcatatgcagatagtagtcgtttgaggttcgggcggggaccaggtcgaccgtcggtaggtcacgcccgaggcctcgccccgttggccacgtcctcgttcccc

SEQ ID NO: 7131 - DNA, 547 bp, Homo sapiens
  misc_feature: GYAE6OF02FJCVW.23.71.G05.1.454.CMB.1.raw
  modified_base (309)..(309): a, c, t, g, unknown or other
  misc_feature (309)..(309): n is a, c, g, or t
  modified_base (439)..(439): a, c, t, g, unknown or other
  misc_feature (439)..(439): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgcagtgatggttgggacttttaatatggtctcgtggtaccaatacctccaggcaaacgccccccaaactcaatactttangagggcactaagccggcccttcgaggggttttctaggtcgctttctctgctcagtctggcaacacgcctcctgaccatcctctcggcctccagcctgacgacgaggctagattattattgctgctcatangcagatagttagttacgtttgagggttcgggacggggtaccaggtcggaccgtcggttaggcagcccgaaggcctccgccccgtcggtccacgttcctcgttcccccg

SEQ ID NO: 7132 - DNA, 553 bp, Homo sapiens
  misc_feature: GYAE6OF02ITBEQ.23.71.G05.1.454.CMB.1.raw
  modified_base (251)..(251): a, c, t, g, unknown or other
  misc_feature (251)..(251): n is a, c, g, or t
  modified_base (355)..(355): a, c, t, g, unknown or other
  misc_feature (355)..(355): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatcctccagcaaagccccaaatcatacttatgaggcactaagcggccctgagggtttctagtcgcttctctgctcaagtctgcaacnccggtcctccctgacctatcctctcggccctcagcctgacgcgagctagattattattgctgctcatntgctagnttagtagttacgtttgacgggttcggacgggggtaccaagggtcgtaaccggttcgtaacggtccaggtaccccgaaggtccctccggcccccgtcggtccgaccttccgtccgttacccccg

SEQ ID NO: 7133 - DNA, 601 bp, Homo sapiens
  misc_feature: GYAE6OF02HVP0T.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgagttggttagggtaactttttaatagttggttcttacggtggtaccaataccctccgaggaccaaacgacccccaaactctattactttatggagggacaactaacgccggccctcgtacggggtttcagtcgtcttctctggctccaagtctggacacgacggcctccagaccatcctcgtcgcctcgacgtcctagacgagacggtctagtactttattattcgtctcgctactatgtgcagtagtaagttagttacgtttgggtacgggttcgggacggggtactagggtcgtaccggtcggtaggtccgacgacccgaaggtccgtccgtaccccgtagtcctaccgttcctccgtccccg

SEQ ID NO: 7134 - DNA, 632 bp, Homo sapiens
  misc_feature: GYAE6OF02I6ED6.23.71.G05.1.454.CMB.1.raw
  modified_base (230)..(230): a, c, t, g, unknown or other
  misc_feature (230)..(230): n is a, c, g, or t
  modified_base (377)..(377): a, c, t, g, unknown or other
  misc_feature (377)..(377): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttgggacttttaatatggtctcgtgtaccaatacctccaggcaaacgcccccaaactcattactttatcgaggacaacgtaacgcggccctcgtaggggtttcagttcgcttctctggcttaccaagtctaggacaacnccggtcctcccgtgaaccctattcctcgtcggtccctccacgtcccgtacgaccggaccgaggctacgtatttagttactttcggcttcgtcctcgtaatacgtcgactagtagttaagttacgttacgtttagggtacgggttccgggacgggggacctaagggtcggtaccggttcggtaacggttcgacggtacccgaaggtccgtccggtcccccgtcggttcccgtacccgttccgttccggttcccccg

SEQ ID NO: 7135 - DNA, 540 bp, Homo sapiens
  misc_feature: GYAE6OF02GD4ZW.23.71.G05.1.454.CMB.1.raw
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
  modified_base (431)..(431): a, c, t, g, unknown or other
  misc_feature (431)..(431): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatacttangaggcactaagcggccctcgagggtttctagtcgcttctctggctcaagtctggcaacncggcctccctgacccatcctctcggccctccagcctgacgacgaggctgtattattattgcttgctcatngcagtatagtagttatttggacggttcgggacgggggacaagggttcgaccggtggtacggtcacggcccgaaggcctcgccccgtggcctacttccgtcgttcccccg

SEQ ID NO: 7136 - DNA, 779 bp, Homo sapiens
  misc_feature: GYAE6OF02GO7HK.23.71.G05.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccncagtgattggttaggtacttttaatagttggtctcggtacggtaaccaactaccctcccgaaggaccaaaccgacccccctaaactcctaacttaacctttagtcggacgggtacctaacgtaacggccggtacccttcggtaacgggggttttctacggttccgtacctttcgtccgtcggtaccttaccgtaacggttccgtacgggtaacccaaccggtacccgggtcccttaccccgtacggaaccctacgttcctaccggtcgggtccctacccgaacggtcccgtacggaacccggtacggacggtccttaggtacttttagttacgttcgtcgttcgtacctacgtagttacgtcgtacgaacgttaagttacggttaacgtttacgttttacggggtaacggggttacccggggtaacggggggtaaccgtaggggttaccggtaccggttacggtaacgggtaccgaaccggtacccgtaaggtcccgttacccggtcccccgttaggtaccctaccgtttcccgtacccggttaccccc

SEQ ID NO: 7137 - DNA, 548 bp, Homo sapiens
  misc_feature: GYAE6OF02GSWHH.23.71.G05.1.454.CMB.1.raw
  modified_base (233)..(233): a, c, t, g, unknown or other
  misc_feature (233)..(233): n is a, c, g, or t
  modified_base (360)..(360): a, c, t, g, unknown or other
  misc_feature (360)..(360): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgnagtgatggttgggtacttttaatatggtctcgtggtaccaatacctccagcaaacgcccccaaactcatacttatgaggcactaagccggccctcgtagggtttcagtcgcttctctggctcagtcngcaacgcgcctccnaccntctctcgccctcngcctgacgacgnggctgatttatnttnctncctnatntgcagtatagtattcgttgagggttcggcgggggtaacaggtcggaccggttcggacggtaccacggaccctagggtccctcggcccccgttcggccctacgttccctacgttacccccc

SEQ ID NO: 7138 - DNA, 602 bp, Homo sapiens
  misc_feature: GYAE6OF02I6Q4N.23.71.G05.1.454.CMB.1.raw
  modified_base (230)..(230): a, c, t, g, unknown or other
  misc_feature (230)..(230): n is a, c, g, or t
  modified_base (314)..(314): a, c, t, g, unknown or other
  misc_feature (314)..(314): n is a, c, g, or t
  modified_base (396)..(396): a, c, t, g, unknown or other
  misc_feature (396)..(396): n is a, c, g, or t
  modified_base (464)..(464): a, c, t, g, unknown or other
  misc_feature (464)..(464): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccncagtgtatggttggtaacttttaatagttggtctcggtggtaaccaataccctcccgagacaaacgccccaaatcattacttangaggcacgtaagccgcctcgtagggtttctagtcgtcttctcgtggcctcagtctggaccaacgcggccctccgtgaccctntccgtctcggccctccacgccgtagaccgtacgaggtctagtaattattattgtctcgtctcacttancgacagtagtacgtagttacgtttggtacgggttacgggcgggggtaacagggtcgtacggtccggtaaggtccacggacccgtaacggtcgttcccggccccgttcggtaccctccgttccttccggttaccccccc

SEQ ID NO: 7139 - DNA, 126 bp, Homo sapiens
  misc_feature: GYAE6OF02IA2LW.23.71.G05.1.454.CMB.1.raw
  modified_base (119)..(119): a, c, t, g, unknown or other
  misc_feature (119)..(119): n is a, c, g, or t
  modified_base (124)..(126): a, c, t, g, unknown or other
  misc_feature (124)..(126): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcnctctnnn

SEQ ID NO: 7140 - DNA, 760 bp, Homo sapiens
  misc_feature: GYAE6OF02HMSOY.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccgtctcctgcactcggaacccgnagtgagttggttgggtaacttttaatagtggttccgttcggtacggtacctaaactacctacccgaacggtaccaaaccgacccccctaaaactcctaattaactttagtacgggaacggtacctaacgtaacgcccgggtaccccttacggtacggggtttactacggtccgttacgttcgtcgtcggtcctaccgtaacgttccgtaggacctaaaccgaccggtcccctacccgtacgaacctactcccgtacgtcggtacccctccgacgtccgtacggaccggaccggtaggtccttaggtaactttagttacgttcggtacttcggtaccttactaattaacgtgtaaccgtaagtaacgttaagtttaacgtttacgtttacgggacggggttcccggggacggggtaacgttaacgggcggttaacccggttcgggtacggaccgtaacggtacccgtaacggtcccgtaccccggtcccggttaccgttacccgaccgttcccgttacccgttacccccg

SEQ ID NO: 7141 - DNA, 597 bp, Homo sapiens
  misc_feature: GYAE6OF02I08O5.23.71.G05.1.454.CMB.1.raw
  modified_base (302)..(302): a, c, t, g, unknown or other
  misc_feature (302)..(302): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccgtctcctgcactcggaacccgcagtgatggttaggtacttttaatatggtctgtcgtaccatacctccagcaacgcccaaatcatattangaggacacagcgcctgtagggttctagtctcttcgtcgtgtctaccgtaaggtctggaccaacgtacggtcctaccctacgacctactcctcgtcggtccctcgacgtcctaggaccggacgacggtctacgtattagttagttgtactgtactagtatactgtacagtaacgttagttaacgttacggtttaggtcggggttacgggacggggaccgtaagggtcggtacggtcggtacggtccgacggaccgacgtccgtaccgcccgttcgcctaccgtccgtacccgtccc

SEQ ID NO: 7142 - DNA, 554 bp, Homo sapiens
  misc_feature: GYAE6OF02IW0EB.23.71.G05.1.454.CMB.1.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
  modified_base (360)..(360): a, c, t, g, unknown or other
  misc_feature (360)..(360): n is a, c, g, or t
  modified_base (427)..(427): a, c, t, g, unknown or other
  misc_feature (427)..(427): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatgttggtacttttaatatggtctcgtgtaccaatacctccaggcaaacgaccccaaactcatacttangaggcactagcgcctgagggtttctagtcgtcttctctcgctcaagtctgaacaacnccgcctcctcgaccactctctcgcctccacgtcctcgacgacgagactgtaattattattgctgctnatatgctagagttagtacgttacgtttggtacgggttcgggacgggggtaactagggtcgtaccggtggtacggtcgacgtacccgaggctcccggcccgttcgcctacgttccgtaccgttacccc

SEQ ID NO: 7143 - DNA, 636 bp, Homo sapiens
  misc_feature: GYAE6OF02FI5AQ.23.71.G05.1.454.CMB.1.raw
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaaccccnagtgattggttggtacttttaanatggtctcgtgtaccaatacctccaggcaaagcccccaaatcatacttangaggcacgtaagcggccctcgtaggggtttcagtcgtcttctctggctacctaagtctaggacaaacgaccggcccttcccgtacgacccattccgtacgtcggtaccctcctacgcccgtaggaccgtaccgaggtaccgtagtaattattagttcgcttgtactcgtaactacgtgacgtacgattaggttaagtttaacgttggtacgggttccggggtacgggggacctaacgggtcggaccggttcggtaacggtccgtacggacccgtaaacggtccgtaccggcccccgttacggtccctaaccgttccgttcccgttacccccg

SEQ ID NO: 7144 - DNA, 589 bp, Homo sapiens
  misc_feature: GYAE6OF02HG53U.23.71.G05.1.454.CMB.1.raw
  modified_base (255)..(255): a, c, t, g, unknown or other
  misc_feature (255)..(255): n is a, c, g, or t
  modified_base (435)..(435): a, c, t, g, unknown or other
  misc_feature (435)..(435): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgattggttagggtacttttaanatggtctcgtggtaccaatacctccaggacaaacgcccccaaatcatactttatgacggcactaacgccggcctgaggggtttctagtcgcttcgtcgtcggtctaccagtctaggacaacgccggtccctcccgcgaaccctattccgtcgtcggacctccgacgcctaggaccgacgnggtctgtacttattagttcgtctgtctacagtactgactagtatagtagttacttggtacgggtcggccggggactagggtcgacggtcggtacggtcgacggtacccgaggtccgtccgtccccgtcggtcctaccgttcgttcccgtccccg

SEQ ID NO: 7145 - DNA, 565 bp, Homo sapiens
  misc_feature: GYAE6OF02JF6AX.23.71.G05.1.454.CMB.1.raw
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (437)..(437): a, c, t, g, unknown or other
  misc_feature (437)..(437): n is a, c, g, or t
  modified_base (544)..(544): a, c, t, g, unknown or other
  misc_feature (544)..(544): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgattggttgggtaacttttaatatggtctcgtggtaccaatacctccagacaacgccccaactcatacttatgaggcactaagcggccctcgagggtttctagtcgcttcgtctgctcagtctggcaacacggccnccgtcgacctactctctcggcctccacgcctcggacgacggngcgtagattattcttgtctgcttnatatgacagtatagtattagttggacgggttcggacgggggtacgtaggtcgtaccgtcggttaacggtcacggtaccgacggtaccgtccggccccgtcggtaccncgttccgttccgttacccccg

SEQ ID NO: 7146 - DNA, 783 bp, Homo sapiens
  misc_feature: GYAE6OF02GBQVO.23.71.G05.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacngtcgatcaccgtctcctgcactggaacccnagtgatgttaggacttttaatatggtctcgtggtaaccaatacctccaggcaaacgccccaaatcaatcttangaggcactagcgacctgagggtttctacgtcgtcttcgtctgtcctacctaagtcgtcgactaaaccgaccggtacccttcccgtgaaccccttacgttccctcccgttacggtcccgttacccgaccggaccgttacgaaccggtaaccgggtacggtaccgttacggttctttaaaaaaaaaggttttcgttacgttaccgtacggttccttacgtaacgttaacgttacggtaccgtaacggtaacgttaacgtttaaacggttaaccggttttacgggttaaccggggtttaccgggggtaacccgggggggtaccgggtaaaccgggttaccgggtaacccgggttaccgggttaaccggggttaaccggtaccggtaaccccggtaaccgggttacccggttaccccgggtccccccggtttacccgggttacccggttacccggtttacccgttaccccgggtttaaccccccccg

SEQ ID NO: 7147 - DNA, 578 bp, Homo sapiens
  misc_feature: GYAE6OF02JMBOT.23.71.G05.1.454.CMB.1.raw
  modified_base (459)..(459): a, c, t, g, unknown or other
  misc_feature (459)..(459): n is a, c, g, or t
tcagacgcgagtatcacgaccggtgctcgatttagtgtcgtcgcaagagagagggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatgtctcgtgtaccaatacctccagcaaacgccccaactcattacttatgaggcacaagccggccctctaggggtttctagtcgcttctctggcctaccaagtctcggacaaccgacggtccctcccgtacgaccctatcctcgtcgccctaccacgtccgtacgaccgacgaggtcttgaattttattagttgtcttcgctctatntgactagtattagttagttcgtttgagggttcgggacggggtacagggtcgaccggtggtacggtccgacgtcccgagtccgtcccggaccccgttggtacctcttccgtccgttcccc

SEQ ID NO: 7148 - DNA, 702 bp, Homo sapiens
  misc_feature: GYAE6OF02JPTZX.23.71.G05.1.454.CMB.1.raw
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (425)..(425): a, c, t, g, unknown or other
  misc_feature (425)..(425): n is a, c, g, or t
tcagacgcgagtatcacgaccggtgctcgattagtgtcgtcgcaagagagaggggggggtcgacgaagaggcgagcgctctcgggacggtctccaccatggcctgggctctgctgctcctcactctcctcactcaggacacaggtcctgggcccagtctgaccctgactcagcctgcctccgtgtctgggtcctcgtaggcagtcgatcacgtctctgaccatcggaaccgcagtnagtcgtggacttttaatntggtctgtgtacaactacctccagcaaacgtccccaaatccgaataccttatacggaacggcaactaacgaccggccgtacgtacggggttactggttaccgtcttactcgtcggtctaacctaaggttccgaggtacaaccggtacggccctacgtcgaaccgattcccncgtacgggccttaccacgtacctacgacgaaccggaggtactaccggtattaagttacgttaacgtcgtacgtcctacaacttaagtcgacgtaacgtattaacgtaggttaacctttaggttaccggggttaacgggtaccgggggttaaccgacgggttacggtaaccggttaccgggtaagggttaaccgtacggtaaaccccgaagggtcccgtacccgggtttccccccaaggggtttaccccaacgtttccccggttaacgttaccccccg

SEQ ID NO: 7149 - DNA, 711 bp, Homo sapiens
  misc_feature: GYAE6OF02HZTKH.23.71.G05.1.454.CMB.1.raw
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
tcagacgcgagtatcacgaccggtgctcgatttagtgtcgtcgcaagagagaggggggggtcacaagaggcagcgctctcggacgtctcaccatggcctgggctctgctgctcctcactctcctcactcaggtacacagggtcctggcccagtctgccctgactcagctgcctcgtgtctggtctcctggacagtcgaactccgaccgtctcgtgcctagtcggaacccgcgagtgntggttggtacttttanagtgtcncggtcgactactcctcgaggctaacgcccctaaactcaacttcttacgnggacggtctaacgtaacggtcgtaccccgtagtacggggtttcctacggtctaccgttcctcgtcgtcctacgtagttcgacggtacaaacgccggtcccttaccgtacgaccctagtccgttccgacgttccctaccgcggtcccggttacgaaccggtaccggtacgttacgtacggttaacgttttacgttcgttccgtacgttcgtacgtaacgtctacgtggtacgttaacgtacgttaccgtaagtcccgtttaaggggcccggttaccggggacgggttaaccgttaggtacccgttccgggttacggtaaccggtccgtaaacgggcccgttaaggcccgtttacccggacccggttacggttaccgttccgttccgttaccccgttaaccccg

SEQ ID NO: 7150 - DNA, 603 bp, Homo sapiens
  misc_feature: GYAE6OF02FVCT6.23.71.G05.1.454.CMB.1.raw
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtnatgttggactttaanatgtctgtgtaccaatacctccaggcaaacgcccccaaatcattacttangaggcactaacggcgccctgtacggggtttctagtcgtcttctctggctcagtctggcaacgcgtcctccgtgaccatcctcgtcgccctaccgacgcctcggacgacggaggtctagtatttattacgttgcttcgtctactatacgtcgacagtagttaagttagttacgtttagggacgggtttccgggacgggggtaaccaagggttcgtaccggttacggtcggtaccgtaccggacccggtaaggtcccgttaccggcccccgttacggtcccgtaccgttccgtaccgtttacccccc

SEQ ID NO: 7151 - DNA, 549 bp, Homo sapiens
  misc_feature: GYAE6OF02GY1DF.23.71.G05.1.454.CMB.1.raw
  modified_base (228)..(228): a, c, t, g, unknown or other
  misc_feature (228)..(228): n is a, c, g, or t
  modified_base (299)..(299): a, c, t, g, unknown or other
  misc_feature (299)..(299): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (417)..(417): a, c, t, g, unknown or other
  misc_feature (417)..(417): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgtgcccagtctgccctgactcagcctgcctccgtgtctgggtctcctggacagtcgatcaccgtctcctgcactggaacccnagtgatgttggtacttttaatatggtctcgtggtaccaatacctccaggcaaacgccccaatcatacttangaggcactaagcgcctcgagggtttctagtcgtcttctctgctcagtctgcaacncgcctccngaccatctctgccctcagcctgacgacgagctagtattattactgctgctctatntcgacagtatagtagttactttgggacggttcggggacgggggtacctagggtcgaccggttcggtacggtaccgaggaccccgaaggtcccgtaccggcccccgttaggtccctaccgttccgttaccccg

SEQ ID NO: 7152 - DNA, 749 bp, Homo sapiens
  misc_feature: GYAE6OF02JCYO6.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctctgcacgtcggaacccgcagtgaattggttagggtacttttaagtatggtctcgtcggtaacctaacgtacctccgagaccaacgccccaaactcaacttacttagtgaccggtacaccgtaacgccggtaccttacgtacggggtttctacgtccgtacttccgtcgtagtcctacctaagtcgtacggacctaaacgtccggtcctacccgtacacccgtaacttcgtccgtacggtacccgtaccgtacggtacccgtacggtaaccggaaccggtacggtccgttaacggtaacgtttacgttagttacgtaccggttacgtaccttacgtaacttacgtacgtacgtaacgttaacgttacgttacggtttaccgtttagggttacgggttaccgggtaccgggggtaccgtacgggttaccggtaccggttacggttaccgggtaacgtaccggtaacccgtaaccgggtccgttcccggttaccccgtccggttacccgtaaccgttccggttacccgttacccccgg

SEQ ID NO: 7153 - DNA, 574 bp, Homo sapiens
  misc_feature: GYAE6OF02F8A4V.23.71.G05.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (436)..(436): a, c, t, g, unknown or other
  misc_feature (436)..(436): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaanatggtctcgtggtaccaatacctccaggcaaacgcccccaaatcatacttangaggcacgtagcgccctgaggggtttctagtcgcttctctggctccaagtctggcaacgcggcctccctgacccatcctctcggccctccacgcctgaccgacgacggtctagtattattattgctgcctcatangcaagtattagttagttaccgtttgacgggttcgggacggggtacctaagggtcgtaccggtcggtaggtccaacggtacccgaaggtcccgttaccggcccccgttcggtaccctaccgttccgtccgttacccccc

SEQ ID NO: 7154 - DNA, 699 bp, Homo sapiens
  misc_feature: GYAE6OF02IKHJ5.23.71.G05.1.454.CMB.1.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaatatggtctcgtggtaccaatacctcccaggcaaacgcccccaaatcaattactttanggaggcactaagccggcctgtagggttctagtcgcttctctggcctacaagtctggacaacgaccggtcctaccctgacctatcctcgtcggccctccgaacgtcccgtggaaccgacggacggtcctaggtaattttacttagtttcgccttacggaccttacaattactcgacctaaggttacttaacggtttaagtttaaccgtttagggtaacggggtttacccgggggaaccgggggggtaacctaagggggttccggtaaccccgggtttcggttaaccgggtacccgtaaccgggtaacccccgtaagggtccccgtttacccggcccccccggtttacgggttaccctaacccgttttcccggtaccccggtttacccccccgg

SEQ ID NO: 7155 - DNA, 585 bp, Homo sapiens
  misc_feature: GYAE6OF02IRW02.23.71.G05.1.454.CMB.1.raw
  modified_base (306)..(306): a, c, t, g, unknown or other
  misc_feature (306)..(306): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctcccaggcaaacgcccccaaactcatactttangaggcactaagcggccctcgaggggtttctagtcgcttctctggctccaagtctgcaacacgcctcctgaccatctctcgcctcacgcctgacgacgacgctagtactttattacttgcttcgctactatatcgacagtagtagttacgttacgtttggtacgggtttcgggacgggggtacctaagggtcggtaaccggttcggtaacggtccgtaacggtacccgaagggtcctccggtaccccgttcggtacctaccttccgttccgttacccccg

SEQ ID NO: 7156 - DNA, 664 bp, Homo sapiens
  misc_feature: GYAE6OF02GW48M.23.71.G05.1.454.CMB.1.raw
  modified_base (307)..(307): a, c, t, g, unknown or other
  misc_feature (307)..(307): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttgggtacttttaatatggtctcgtggtaccaatacctccaggcaaacgcccccaaatcatacttangaggcacgtaagccggcctcgtaggggtttctagtcgcttctctggctcaagtctggcaacacggcctccctgaccatctctcggcctcacgcctgacgacgagcctagtattatttagtcgtcgttgccttacattagtgacctaagtagttaagttacgtttaacgttttacgggtacgggtttcccgggggaacgggggtacccgtaaggggttaccggtacccgggttagggttaacgggttaccgtaaccgggtaccccgtaaacggggttccccgttacccgggtacccccccggtttagggttaccccgtaacccggttttcccggttacccgggttttaccccccccgg

SEQ ID NO: 7157 - DNA, 607 bp, Homo sapiens
  misc_feature: GYAE6OF02IISTH.23.71.G05.1.454.CMB.1.raw
  modified_base (253)..(253): a, c, t, g, unknown or other
  misc_feature (253)..(253): n is a, c, g, or t
  modified_base (350)..(350): a, c, t, g, unknown or other
  misc_feature (350)..(350): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggtagggtacttttaanatggtctcgtggtaccaatacctccaggacaaacgaccccaaatacatacttatgaggacaactaagcggccctgtacgggtttctagtactcttcncgtgcctcaagtctggacaacgacggccctccgtgaccatctcgtcgaccctcacgcctagacgacgagctgaatttagtattgctacgtccttcgtaatacgtacgactaagggtacttaacgtaacgttacgtttacggtaggggtttaccgggccgggggtaactaaggggtcgtaaccggtcggtaagtccgacggaacccgtaacggtccgttccgccccggttacgtcccgtacttccgttaccgtccccc

SEQ ID NO: 7158 - DNA, 583 bp, Homo sapiens
  misc_feature: GYAE6OF02FV19C.23.71.G05.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccncagtgatggttgggacttttaatatggtctcgtggtaccaatacctcccaggcaaagcccccaaatcatacttangaggcactaagcgccctgaggggtttcagtcgcttctcgtgctccaatctggcaacncggcctccctgaccatcctcgtcggccctccgacgtcctcgacgacgaggctagattattattgctgcctcatatcgctaagattagtagttactttggacgggttcgggccgggggtaactaagggtccggtaaccggtcggtaacggtaccgaacgggtacccgaacgggtccgtccggcccccgttcggtaccctaccgttccgttccgttaccccccg

SEQ ID NO: 7159 - DNA, 574 bp, Homo sapiens
  misc_feature: GYAE6OF02FQVZA.23.71.G05.1.454.CMB.1.raw
  modified_base (304)..(304): a, c, t, g, unknown or other
  misc_feature (304)..(304): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggacttttaatatggtctcgtggtaccaatacctccaggcaaacgcccccaaatcatacttangaggcactaagcgccctgagggtttctagtcgcttctctgctcaagtctggacaacgccggcctccctgacccatcctctcggccctccacgtccctggacgacgaggtctagtaacttattagttgcttgccttnatntgacagtattagttagttacgtttggacggttcgggacgggggtacaagggtcgaccggtcggtacggtacacggtcccgaagtccgtcccggtccccgttaggtccctaccgttccgtccgttacccccg

SEQ ID NO: 7160 - DNA, 673 bp, Homo sapiens
  misc_feature: GYAE6OF02IT9Q7.23.71.G05.1.454.CMB.1.raw
  modified_base (230)..(230): a, c, t, g, unknown or other
  misc_feature (230)..(230): n is a, c, g, or t
  modified_base (315)..(315): a, c, t, g, unknown or other
  misc_feature (315)..(315): n is a, c, g, or t
  modified_base (498)..(498): a, c, t, g, unknown or other
  misc_feature (498)..(498): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggacccnagtgatggttaggtaacttttatagtggtctcggtggtaaccaactaccctccgaggaccaaaccgcccccaaatcattacttanggacggcaacgtaagccgtcctgtagggttctagtctcttcgtactggcctacaagttcgtacggacaaacgtccggtaccctcccgtagtaccctacgttcctcggtaccgcccctaccgacgtccgtacggaacgacggtcgtctagttactttagttacttcgtacgtcgtctaactatntcgacaagtactagttacggttactttacggggacgggttaccggggacggggtaactacggggttacgtacccggttacggtcgggtactaacccgggtaccgtaaccgggttccgtaccccggttcccccggttaaggtacccgtaacgttcccgtacccgtttaaccccccg

SEQ ID NO: 7161 - DNA, 607 bp, Homo sapiens
  misc_feature: GYAE6OF02F1LPO.23.71.G05.1.454.CMB.1.raw
  modified_base (233)..(233): a, c, t, g, unknown or other
  misc_feature (233)..(233): n is a, c, g, or t
  modified_base (310)..(310): a, c, t, g, unknown or other
  misc_feature (310)..(310): n is a, c, g, or t
  modified_base (428)..(428): a, c, t, g, unknown or other
  misc_feature (428)..(428): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgnagtgatggttaggacttttaatatggtctgtggtaccaatacctcccaggacaaacgccccccaaatcaatacttangaggacactaagccggccctgtaggggtttctagtcgtcttctctcggctaccaagtctagacaaccgaccggccctccctgacccattcctctcggccctccacgccctgacgacgngtctagtattattagttgcttgacctctaattatcgcaagtagttaagttagttacgttttggagggtttccggggacgggggtaaccgtagggtacgtaccggtacggtcggtaccacggtacccgaggtacccgtccggcccccgttccggcctaccgttcctacccggttcccccg

SEQ ID NO: 7162 - DNA, 841 bp, Homo sapiens
  misc_feature: GYAE6OF02JTCEO.23.71.G05.1.454.CMB.1.raw
  modified_base (239)..(239): a, c, t, g, unknown or other
  misc_feature (239)..(239): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctcgccctgactcagcctgcctccgtgtcttgggtctcctggacacggtcgatccaccgtctcctgccacgtcggaaccccgnaggtgacttggttacgggtaactttttaatacgtgggttcctcggttacggtaaccctaactaccccgtaccccgaacggaccaaaaccggccccccctaaaaacttcccgtaatttaacctttttaacgtcgggaacgggtacctaaacccggttaacggccccgggacccccgtttacgggttaacgggggggtttttccttaaaccggttccggttcctttccggttacctcgggtccttacccgtaagtttcccgttcgggaaccctaacccggtacccgggtaccctaccccgtttacgaaccccgtatttacccgtcccggttacgggtccctacccgtacggaccccgttacgggacccgaacggacgttccgtagttactttaagttacttcggtccttacgtcctacgtactactcggtactagtaacgttagttaacgttacgtttaggtacggggtttacgggcgggggtaacccgtaggggtaccggttacggtacccggtagggttaccaaccggtacccggaacggttcccgtaccggtaccccccgttcgggtaacccgttaccgttcccgttacccggttcccccg

SEQ ID NO: 7163 - DNA, 591 bp, Homo sapiens
  misc_feature: GYAE6OF02IK5VA.23.71.G05.1.454.CMB.1.raw
  modified_base (230)..(230): a, c, t, g, unknown or other
  misc_feature (230)..(230): n is a, c, g, or t
  modified_base (336)..(336): a, c, t, g, unknown or other
  misc_feature (336)..(336): n is a, c, g, or t
  modified_base (443)..(443): a, c, t, g, unknown or other
  misc_feature (443)..(443): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggtacttttaatatggtctcgtggtaccaatacctccagacaaacgcccccaaactcatacttatgaggcactagcgcctgtagggtttctagtcncttctctggctcaagtctcggacaacaccggcctccctagacctatctctcggccctccacgtcctacgacgacgacggtctagtattatttagttgtctagtcctntatatcgacagtatagtagttactttaggtacgggtttcgggacgggggtaactaagggtccgtaacggttacggtaaggtaccgacggtacccgtaaggtccgttcccggccccgttccggacctaccgttccgtaccgttaccccc

SEQ ID NO: 7164 - DNA, 1004 bp, Homo sapiens
  misc_feature: GYAE6OF02FI0XS.23.71.G05.1.454.CMB.1.raw
tcagacgcgagtatcacgaccggtgctcgatttagtgtcgtcgcaagagagagggggggttcacaagaggcagcgctctcgggacgtctccaccatggcctgggctctgctgctcctcactctcctcactcaggacacaggtcctgggcccagtctgccctgactcagcctgcctccgtgtctgggtctcctggacagtcgatccaccgtctcctgcaccgtcggaaccccgcaggtcgtattcggttacgggtaacctttttaagtacttcggttaccttccggttacgggttaaccccaacttacccccgtacccccgaacgggtacccaaaaacccggtacccccccctaaaacttccgtaaacgtttaaccttttaacgtacggtaacgggtacctaaaccgttaaaccggtccgggttacccccgttacggtaacgggggtttttacctaaccggttcccggtaccttttccgttaccgttcggtacccgttacccgaaacggtttccgtaccggggtaaccctaaaaccccggtacccgggtcccccttaccccgttacggtaacccccttaacgttccccgttcccggttaccggtcccccgtttacccgaaccggttccccgttaccgggaaacccgggtaaccggtaccgggttaccgttacggttaaaccgttttacgtttaaccggtttccggtaccgtttaccgggttacccttaacgtaacctttacggttaaccgggtacgttaaaccggttaaaacggttttacggttttaaaaccggttttaaccggttttaacgggggtaacccgggttttaccggggggtaacccggggggttaaccctaaaccggggggttccgttaaccccgggttacgggttaacccgggtacccgaacccggttaccccggaaccgggttcccggttaccccggtaccccccgttacgggtaccctaaccccggtttcccgtttcccccgttaacccccccg

SEQ ID NO: 7165 - DNA, 609 bp, Homo sapiens
  misc_feature: GYAE6OF02G0UK3.23.71.G05.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggacttttaanatggtctcgtggtaccaatacctccaggcaaacgcccccaaatcatacttangagggcactaagcgccctgtaggggtttctagtcgcttctctggctccaagtctggcaacncggcctccctagaccctatcctctcggccctccagccctggaccgacggaggtctagtatttattattgctgcctacatactgcaagtatagttagttacgtttgggagggtttccggggacggggggtaacctaacgggttcggtaacccggttcgggttaacggtaccaacggaccccgtaagggtccttacccggtcccccgttacgggttaccctaccgtttcccgtccggtttccccccgg

SEQ ID NO: 7166 - DNA, 678 bp, Homo sapiens
  misc_feature: GYAE6OF02JBZAL.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgactggttaggtacttttaatagtggtctcgtggtaccaatcctccaggcaaacgccccaaatcatacttatgaggtcaactaagccggccctcgtacggggtttctagtccgtacttctcctggcctaccgaagttcctaggacctaaacgccgggtccctcccgtacgaccctaatcctcgtcggccctaccgacgtccgtacgaccggacgacggtctagactttagtttacttcgctgtccttacgtattacgtcgacgtagaacgttacgtaagtttaaccgtttcgggaacggggtttcccggggaacgggggtaacccgtaacgggtcgggtaacccgtaccgggtacggttacgaacccgggtacccgtaagggtccttccccggtacccccggttacgggttcccctaacggttcccgttacccggttaccccccg

SEQ ID NO: 7167 - DNA, 728 bp, Homo sapiens
  misc_feature: GYAE6OF02JIS1E.23.71.G05.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggccccagtctgccctgactcagcctgcctccgtgtctgggtctcctggacagtcgatcaccgtctcctgcactggaaccccgnagtgatgtcggactttaanatggtctcgtgtaccaatacctccaggacaacgcccccaatcatactttangaggcactaagccgcctacgagggtttcaggtctcttactctggcctccaagtctggacaacgacggtacctccgtgaccatcctctcggcctaccagcctagacgacgacgcttagactttacgttatcgtaccgttggaccttacgtaacttacgtacggtaaccctaaggttaacgtttaacgttaacggtttaccgtttttacggggtaaccgggggttttacccggggacccgggggggtaaaacccttaacgggggttacccgttaacccgggttaccggggttttaaacggttaccccgggtaaaccggtacccccggttaaaaccggggttccccgtttaacccgggtcccccccccggtttaacggggtaccccttaacccggttttaccccgtaccccgggtttttaaccccccccg

SEQ ID NO: 7168 - DNA, 567 bp, Homo sapiens
  misc_feature: GYAE6OF02F4S11.23.71.G05.1.454.CMB.1.raw
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgatcaccgtctcctgcactcggaacccgnagtgatggttggtacttttaatntggtctcgtgtaccataccnccagcaacgcccccaatcatacttangnggcacgtagcgcctgagggtttcagtctctctctgctcagtcngacacncgctcgngaccatctctgcctccgacgtcctagacgacgacgtctgtaacttaagttagttcgcttgtcctactatagtcgactaacgagttaacgttacgtttacgttagggtacggttccgggacgggggtaccaagggtcgaccggtacggtaacggtcacggtacccgacggtcctccggcccccgtggtacccacgttccgtcgtaccccc

SEQ ID NO: 7169 - DNA, 545 bp, Homo sapiens
  misc_feature: GYAE6OF02F8O71.23.71.G05.1.454.CMB.1.raw
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (448)..(448): a, c, t, g, unknown or other
  misc_feature (448)..(448): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgccactggaaccccgnagtgatggttggacttttaatatggtctcgtgtaccaactacctccaggacaaacgcccccaatctatactttngaggtcacgtagccgcctgtacgggtttctagtcgtcttctctcgctcagtctgacaacaccgcctcctgaccatctcgtcgcctcngccngacgagngctgattatnttgctcgctactatatgacagtattagtacgttntttaggcggtcgggaccggggactaggtcgacgtcgtagcgacgacccgtaggtccgtaccgccccgttacggtcctaccgttcctccggttccccg

SEQ ID NO: 7170 - DNA, 574 bp, Homo sapiens
  misc_feature: GYAE6OF02GAELO.23.71.G05.1.454.CMB.1.raw
  modified_base (230)..(230): a, c, t, g, unknown or other
  misc_feature (230)..(230): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (420)..(420): a, c, t, g, unknown or other
  misc_feature (420)..(420): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttgggacttttaatatggtctgtggtaccaatacctccaggcaaacgcccccaaactcatactttatgagggcactacgcgcctcgagggtttcagtcgcttcnctgctcagtctgcacncgctccncgacatctctcgcctcagccncgacgacgacggctgattattagttcgctgcctanactatgacagtatagttaagttacgtttggacggttcggggacgggggtaaccaagggttcggaccggttacggtacggtaccgacggtacccgaacggtccgttacccggtcccccggtcggttaccctaccgttccgttaccgttacccccg

SEQ ID NO: 7171 - DNA, 578 bp, Homo sapiens
  misc_feature: GYAE6OF02GWKM5.23.71.G05.1.454.CMB.1.raw
  modified_base (231)..(231): a, c, t, g, unknown or other
  misc_feature (231)..(231): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccnagtgatggttggtacttttaatatggtctcgtggtaccaatacctccagacaacgccccaatcatacttatggacggcactaagccgcctgagggttctagtcgtcttctcgtgctacagtctgacacgcgcctccncacatcctcgtcgcctcncgcctagacgacgngtctagtattattnttgctgtctcatncgacagtagtagttagttacgtttggtaggttcgggacgggggtacctagggtaccggtaccggttacggtacggtacaccgggaccccgtaagggtcccgttacccggccccgttacggtccctaccggttccgttcccgttaccccccg

SEQ ID NO: 7172 - DNA, 785 bp, Homo sapiens
  misc_feature: GYAE6OF02JA9OA.23.71.G05.1.454.CMB.1.raw
tcagacgcgagtatcacgaccggtgctcgatttagtgtcgtcgcaagagagagggggggggtcacaagaggcagcgctcttgggacgtctccaccatggcctgggctctgctgctcctcactctcctcactcaggacacagggtcctgggcccagtctgccctgactcagcctgcctccgtgtctgggtctcctggacagtcgatcaccgtctcctgccacgtcggaacccgcagtgatggttgggtacttttaatagtggtctcgtggtacctaactacctccaggacaaacgcccccaaatcattactttatggaggcacgtaacggccggtccctacggtacggggttttcctaggtccgtactttccgtcgtcggtccttaccgtaagttccgtggacccaaacgacccggtccccttacccgtcgaaccctacttccgtaccgtcggtcccctcccgacggtcccgtacggacccggaaccggtacggtctaggttaactttaagtttacgttggtccttacggtaccttaccgtaattagttacggacgtaagttaagttaaggtttaacggtttaaccggttttacgggttaacgggggtttacccgggggtaaccgggggggtaaccgttaacgggggttaccgggttaacccgggtttcggggttaaacgggttacccggtaaccgggtaaccccgtaacggggtccccgttacccggtccccccgggttaccggttacccgtaacccgtttcccgtacccgttttaccccccccg

SEQ ID NO: 7173 - DNA, 564 bp, Homo sapiens
  misc_feature: GYAE6OF02GJ6YF.23.71.G05.1.454.CMB.1.raw
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggaaagtcgatcaccgtctcctgcactggaacccnagtgagttggttaggtaactttttaanagttggtctcggtggtaaccaactacctccaggacaaacgcccccaactcacttacttagtgaggcacgtaagcgcctcgagggtttctagtcgtcttctcgtgctccgatcngcacncgtcctcctgacnctctctgtccncacgtctcgacgcggcgctgtattagttntgctgctatactngactanagtagtattacgttaggtgggtccgggacggggaccgtaggtacgtccgttaggacggtcgacgtaccgacggtcctccggtcccgtcgtccgtaccgtcgttacccggtccctcccg

SEQ ID NO: 7174 - DNA, 710 bp, Homo sapiens
  misc_feature: GYAE6OF02J3HXQ.23.71.G05.1.454.CMB.1.raw
  modified_base (129)..(129): a, c, t, g, unknown or other
  misc_feature (129)..(129): n is a, c, g, or t
  modified_base (243)..(243): a, c, t, g, unknown or other
  misc_feature (243)..(243): n is a, c, g, or t
  modified_base (340)..(340): a, c, t, g, unknown or other
  misc_feature (340)..(340): n is a, c, g, or t
  modified_base (540)..(540): a, c, t, g, unknown or other
  misc_feature (540)..(540): n is a, c, g, or t
tcagacgcgagtatcacgaccggtgctcgatttagtgtcgtcgcaagagagaggggggggtcacaagaggcagcgctctcgggacgtcgtccaccatggcctgggctctgctgctcctcactctccctnacctcaggacacgagggttcctgggcccaggtcctggccctgactcacgcctgcctccgtgtcgtggtctccgtggacagtcgatcaccgtctcctgactacgtacggacccgnagtgtagttggttacgggtacttttaagcgttcggtctcggtacgtactaactaccctaccgaggacaaaccgacccctaactcgtattaccgtttnacggaacgcaacgtaacggccggtcctacggtagggttcctacgtcgtcttcgttccaggtcctaccgaagtcgtaggccaacgtcggtccctaccgtacggacctctccgtacgtccggacctacgacggcctacggacgtacggtcggtctacgtaacgtttaactcggtaacgtccgtcgactaccggattccggtntaaccgagttacgttaacgttaacggttcgttagggtaacccgggtggggtaaacccgggtaacttaaccgggggtcctacgggttacccggttaacggcgttaacccggacccgtaaggtccctacgggccccgtccgtttaaccccgggttcctccgttaacccccgg

SEQ ID NO: 7175 - DNA, 575 bp, Homo sapiens
  misc_feature: GYAE6OF02HQURH.23.71.G05.1.454.CMB.1.raw
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaaacccgcagtgattggttgggtacttttaatatggtctcgtaggtaccaactacctcccaggaccaaacgcccccaaaactcattactttatgaggcaactaagcggcctgtagggtttctagtcncttctntgctacagtctgcaacgacgcctcctgacctatctctcgcctccacgcctagacgacgaggctgtaattattagttcgtctgtcctagatagtcacgtagtaatagttacttagtttgacgggttcgggacggggtaccaagggtcgtaccggtcggtaaggtccgacgacccgaacggtcctccgtaccccgtcgtaccacgttccctcgtcccccg

SEQ ID NO: 7176 - DNA, 588 bp, Homo sapiens
  misc_feature: GYAE6OF02FZL13.23.71.G05.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
  modified_base (442)..(442): a, c, t, g, unknown or other
  misc_feature (442)..(442): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatgttggacttttaanatggtctcgtgtaccaatacctccaggcaaacgcccccaaatcatacttangaggcactaagccggccctgtagggtttctagtctcttctcgtggctctaagtctggacaacgacggcctccctgacctatcctcgtcgccctccacgtcctaggaccgacggaggtcctagtattattattcgcttgctnatatgcagtatagttagttacgtttggagggttccggggacggggtaacctagggtcgtaccggtcggttaacggtccgacggacccggtaaggtcccgtcccggtcccccgtcgggtacctaccgttccgttcccggttcccccg

SEQ ID NO: 7177 - DNA, 651 bp, Homo sapiens
  misc_feature: GYAE6OF02H57DI.23.71.G05.1.454.CMB.1.raw
  modified_base (252)..(252): a, c, t, g, unknown or other
  misc_feature (252)..(252): n is a, c, g, or t
  modified_base (305)..(305): a, c, t, g, unknown or other
  misc_feature (305)..(305): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggactttttaanatggtctcgtggtaccaatacctccaggcaaacgccccaaatccatactttangaggacactaagcgccctgagggtttctagtcgtcttctctggctaccaagtctcggacaacgacggtccctcctgacctatctcgtgcctcagtcctgacgacggacgcttacgagtttaattaattcggcttcgccttactaattacgtgacctaaggaagtttaacggtaacgttttaccgttttagggtaaaccggggtttaccggggacccgggggggtaaaccaagggggttacgaaccccgggtttcgggtaacggtaccggtaacgacccccggtaaaggtcccgttcgacccccccggttcggtaccctaccgttaccgttcccgtttaaccccccg

SEQ ID NO: 7178 - DNA, 645 bp, Homo sapiens
  misc_feature: GYAE6OF02I0SDP.23.71.G05.1.454.CMB.1.raw
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccncagtgatggttggtacttttaatatggtctcgtgtaccaatacctccagacaacgaccccaatcatacttangaggctactaacgccgcctgtagggtttctagtcgtcttctcgtcgtctaccgtaagtcgtaggactaacgaccggtccctcccgtacgaacctacttcctcgtcgtccctaccgacgtcctaggaccgacggacgtcttagtaacttagttacttcgtacttcgtctactactatcgtactaagtacgtaagttacgttagtttacgggtaacgggttcggggaacggggtacgtaacgggtccgtaaccggttcgggtaacggtccgaacggtacccggtaacggtcccgttaccggccccggttacggtacctacccggttccgttaccccgttacccccg

SEQ ID NO: 7179 - DNA, 819 bp, Homo sapiens
  misc_feature: GYAE6OF02IGCLE.23.71.G05.1.454.CMB.1.raw
  modified_base (179)..(179): a, c, t, g, unknown or other
  misc_feature (179)..(179): n is a, c, g, or t
  modified_base (229)..(229): a, c, t, g, unknown or other
  misc_feature (229)..(229): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgcctgactcagcctgcctcgtntctgggtctcctggacagtcgatcaccgttctcctgctactcggaacccnagtgtacgttggttagggtaactttttaaatgttcggtccgttacgttacggtaaccaaacttacccgtaccccgaaggtacccaaaaaccggtacccccctaaaaacgttcctaactttaaccgtttttaaggtacggtaacggggaccttaaaccggttaaacgggtcccgggtaccccgttacggttaacggggggttttccttaacggttccgtccttttaccgtccgttcggtacccttaaccgttaacggtccgtacgggtaaccaaaccggtacccgggtcccctttacccgtagggaaccccttatacccgtttcccgtacggtcccgttcccgaaccggtaccgttacggaaccggtacggtaaggtccgttagttacgttttattaacgtttcgacgttcgtaccttactacgtacgtcgacgtaagtacgttaacgttacggtttaacttgggttacgggtacggggaccgggttaacgtaggttacggtaaccggttaggtacggtacgacggtacccggtaggtcccgttaccggccccggttaccggtacctaccgttccggtacccgttaccccg

SEQ ID NO: 7180 - DNA, 907 bp, Homo sapiens
  misc_feature: GYAE6OF02J3B9C.23.71.G05.1.454.CMB.1.raw
  modified_base (210)..(210): a, c, t, g, unknown or other
  misc_feature (210)..(210): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctcgggcccagtctcgccctgactcacgtcctcgcccttcgtcgtcgtcggtcctccgtggaccngtcgactccgtaccgtcctccgtcgaccgtaccgttaccggaacccgtcgtaggttacgtagtttacgggtttacggtttaacttttaaggtcgttccggttaccgttacggtaaccgttaacccaaccgttacccccgacccggaaacggtaaaccccaaacccctaaccccgttaaatccttaacgttaccgttagaccgggtacgtacctaacggtaaccggtcccggttacccgtttagggttacgggtttacctcgggttccttacctacggtttaccgacggttacccttaacgtacggtccgttaccggaaccctacccggtcccgttcccctacgtaaccgtcccttacgtccgtcccgtaccgacccgttaccgaccgtaccgtaaccgggaccgttacggtacgttacgttaacttagttacgttcgttacgttccttacgtacctgtaacgtcgttacgacggttaagttaacgtttacgggttaacggtttaaccgggtttacgggggtaccgggggttacccgggtaaccgggtaccgttaaccggggtaccgggttaaccggttaacccggggtaccgtaaccggtcccgggtaaacccgttcggttaacccccggttccccggttaccccggtacccgttcccgtttacccggttttcccccgggacccctttacccccggg

SEQ ID NO: 7181 - DNA, 786 bp, Homo sapiens
  misc_feature: GYAE6OF02GZ2JQ.23.71.G05.1.454.CMB.1.raw
  modified_base (234)..(234): a, c, t, g, unknown or other
  misc_feature (234)..(234): n is a, c, g, or t
  modified_base (334)..(334): a, c, t, g, unknown or other
  misc_feature (334)..(334): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatccaccgtctcctagcacgtcggaacccgnagtgattgttgggtaacttttaatagtcgtctcggtggtaacctaataccctcccgaaggcctaaaacgcccccctaaaagtcctaattaaccttttaanggtaacgggtacaaaccgttaacggcccggtcccgttacgtagggggttttacctaaggttccgtcctttcctcggtcggtacctacccgtaaagtccgtcgggtaacaaaccggtaaccgggtcccttccccgtacgtaaaccctacttacccgtcgttaccgggtccccttacctacggacccgttaaccggaaccggtaaccggaaggtccgttacggtaattttaacgtttaagttccgtacgttcggtcttacgtacttaagtcgtaaccaagttaacgttagtaacgtttaacggtttaggacggggttttaccgggaaccgggggtaacctaaaggggtccgttacccgggttaccgggtacggtaccggaaccggtcccgtaaacggtcccggttacccgtccccggtacggttacccaccgtttaccgtcccggttaaccccc

SEQ ID NO: 7182 - DNA, 706 bp, Homo sapiens
  misc_feature: GYAE6OF02I4IUO.23.71.G05.1.454.CMB.1.raw
  modified_base (201)..(201): a, c, t, g, unknown or other
  misc_feature (201)..(201): n is a, c, g, or t
  modified_base (431)..(431): a, c, t, g, unknown or other
  misc_feature (431)..(431): n is a, c, g, or t
tcagacgcgagtatcacgaccggtgctcgatttagtgtcgtcgcaagagagaggggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccgtctcctgcacgtcggaacccgcagtgattggttgggtacttttaatagtggtctcggtagtaccaagttaccctccgaggtacaaacgacccccctaaactctaattacttagtgaggtacctaactaacggccgtcccgttacgtacgggtttcctagtccgtccgttctcgtcggtcctacctaacgtcgtcggacaacgtccggtccctcccgtanacctacgttcctcgtccggcccttaccgtacgccgttacggaccgaacggtacggctagttaacgttactttagttacggtccgttgtaccctgtacttacgtacgacgtaacgtagtaacggtttacgttacgtttcgggtaacggggttccggggaacgggggtacctaacgggtcgtaacccggttcggtaacggttccgacggacccgtaagggttcccgtacccggtccccgttacggtacctacccgtttaccgtccggttaccccccg

SEQ ID NO: 7183 - DNA, 579 bp, Homo sapiens
  misc_feature: GYAE6OF02HCA7K.23.71.G05.1.454.CMB.1.raw
  modified_base (251)..(251): a, c, t, g, unknown or other
  misc_feature (251)..(251): n is a, c, g, or t
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaanatggtctcgtggtaccaatacctcccaggcaaacgcccccaaatcaatactttangaggcactaagccggccctgagggtttctagtcgtcttctctggcctaccaagtctggacaacncggcctcctgaccatcctcgtcgccctccgagcctgacgacgaggctgtattagttattgctgctctatactgacagtagttaagtagtttacttggtagggttccgggacgggggtacctaagggtcgtaccggttcggtaaggtccaacggcccgtaaggtcccgtaccggtccccgtcggtcctaccgttccgttccgttaccccc

SEQ ID NO: 7184 - DNA, 627 bp, Homo sapiens
  misc_feature: GYAE6OF02HGBVR.23.71.G05.1.454.CMB.1.raw
  modified_base (228)..(228): a, c, t, g, unknown or other
  misc_feature (228)..(228): n is a, c, g, or t
  modified_base (440)..(440): a, c, t, g, unknown or other
  misc_feature (440)..(440): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctggtcctctggacagtcgatccaccgtctcctgcactcggaacccncagtgatggttggactttttaatatggtctcgtgtaccaatcctccaggaccaaacgcccccaaatctatacttagtgaggcacgtaacgccgcctcgtagggtttcagttcgcttctctggcctacaagtctggaccaacgaccggtcctcccgtacgacctatcctccgtcgccctccgacgtcctcgacgacgacggtctagtaatttnttaacgttcgtccttacgtacctctagtctgactaaggttaatagttaagtttacggtttagggtacggggtttccgggaccggggggtaacctaaggggttccgtaaccggtggtaacggtccgacggtacccgaaggtcccgtcccgtaccccgtaggtccttacgttccgttacccgtcccccg

SEQ ID NO: 7185 - DNA, 600 bp, Homo sapiens
  misc_feature: GYAE6OF02IJT0K.23.71.G05.1.454.CMB.1.raw
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgattggttgggtacttttaatagttggtcttcggtacggtacctaataccctcccgaggaccaaacgcccccaaactcattactttagngaggcaactagccgccctgtagggtttctagtctcttctgtgcctacagtcngacacgcgtcctcctgaccntcctctcgcctcgacgtccgtgacgacgagtctagtattattagtcgtctgtcctatatactgactagtagttagtagttacgttggcggggttacgggaccgggggtaactagggtcggtaccgtgggtaacgtccgaacggacccgtaacggtccctccggtcccccgttcggtaccctaccgtccgttcccggttcccccg

SEQ ID NO: 7186 - DNA, 681 bp, Homo sapiens
  misc_feature: GYAE6OF02IYNH7.23.71.G05.1.454.CMB.1.raw
  modified_base (234)..(234): a, c, t, g, unknown or other
  misc_feature (234)..(234): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctcgccctgactcagcctgcctccgtgtctgggtctccgtggacagtcgatcaccgtctctgcacgtcggaacccgngtagtgtagtggttacggttaactttaatagtcggtcgtacgtacgtaacctaacgtaccgtaccgacgacctaaccaccctaactactacttacgttagacggtacgtactaacgtacggccgtccgtagtacgggtttctagtcgtcgtctcgtcgactacgtagtctacggacaacgtccgtcctcgactacctcgtctcgtccgtcctccgacgtccgtacggaccggacggtgtactagtttaacttacgttgttcgtcgtcgtctaactgttacgtcgtacgtaagtagttaacggtttagtttacgggttagggtaccggggttcggggaaaccggggtacgttaacgggtaccgtaccgggttacggtaaccggtaccgaacggtacccggtacgtcccgtcccggtcccgttcgtactcccgttaccgtccctacccg

SEQ ID NO: 7187 - DNA, 885 bp, Homo sapiens
  misc_feature: GYAE6OF02IO15V.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactcagcctgcctcgtgtctggtctcctgacagtcgatcaccgtctcctgcacgtcggaacccgcagtcgagtgttgggtaacttttaatagtcggtctcggtcggtaacctaacgttacccgtccccgaggtaccaaaacccggacccccctaaaacgttcctaactttaacgttttaacgtacgggtacgggtaacctaaaccggttaaacggccccgggtaccccgttacggttaacgggggttttccttaacggttccgtaccttttccgtcgttacggtaccctaaccgttaacggttccgtaacggtaaccaaaccgtaacccgttaccccgttacccgtaaccggtaaccctactttcccggttccgtaccgggtaccccctacccggtaacccggtacccggttaccggaaacccgggtaaccgggtacgggtaacccgtttagggttaaacctttttaacggtttaacgtttccgtaccgtttaccgtaccctttaacgttaactttaccgtcgtaccgtaaggtttaacgtttaacggtttaacggttttacggttacgggttaccgggggttaccggggaaccgggggttaacgtaacgggttacgggacccggttagggtaaccggttaacggtaccggacccggttaacggtcccgtacccggtccccgttacggtcccgtaacctttcccggtcccgttacccccg

SEQ ID NO: 7188 - DNA, 1011 bp, Homo sapiens
  misc_feature: GYAE6OF02IFWNR.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgccactacggaacccgcagtgacgtggttagggtaactttttaaagtagttggttccttacggttaggttaaccccaaattaccccgttacccccgaagggtaacccaaaaaccggaccccccctaaaaaacttccgaaactttaaacccgttttttaagtacgggtaaacgggggtacctaaaccgtttaaaacgggcccgggtaccccccgtttacgggttaaccgggggggttttttaccttaaacgggttacccgttacccgtttttaccttaccggttcgggtaccccttaacccggtaaaaccggttccgtaccggggtaaaccccttaaaaacccggaacccggggttccccctttacccccgttaacgggaaccccttaaacgttacccgtttcccggttaaccggggtcccccttaccccgtaacggtaccccgtttacgggaaacccggtaaccgggtaacggggtaccctaaggtttaaaccgttttaaacgttttaacgttttacggccttaggtacccttaaccgttaaagttaagttccgtaaaccgaaaggttacgttttaacggtaacggttttaaccgttttagggggtaacgggttttacccggggggaacccggggggtaaacctaaggggttccggtaacccggggtttacgggttaacccgggttaacccgtaaacgggtacccccgtaaaacggggtcccttaccccgggtccccccgtttaccggggtaacccctttaacccgttccggtttaaccccggtttccccccccgg

SEQ ID NO: 7189 - DNA, 658 bp, Homo sapiens
  misc_feature: GYAE6OF02JUJ45.23.71.G05.1.454.CMB.1.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctgccctgactcagcctgcctccgtgtctgggtcctcctggacaggtcgatcaccgtctcctagccactgggaaccccnagtgatgttggacttttanatgtctgtgtaccaatcctccaggcaaacgcccccaaatcatacttancgtaggcactaacgcgccctgacggggtttnctcgtcttctcngtccncaagttctcgcaacgcggtccctccgtanaccactcctcncggtcctaccgcgtcctaggacccgtaacgcggtctagtaacttatttatcgtacctaggccttactactacgtagtccgtaagacgtttagtaacgtttaccgttttaggtggggttaacccggggtaccgggggaaccgtaacggggttcgtaaaccgggttccgggttacgggttacgaaaccgacccccggttagggtaccgttaccccgtcccccggttaccgggtttacccaccggtttccccgttcccggttacccccccg

SEQ ID NO: 7190 - DNA, 870 bp, Homo sapiens
  misc_feature: GYAE6OF02H0DWF.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctccgtgtctgggtctcctggacagtcgatcaccgtctcctgcaacgtcggaacccgcaggtgagttggttagggtaactttttaaagtagttggttcttacggttacggtaacctaaactaccctacccgaagggaccaaaaccggtaccccccaaaaacttctaaactttaacttttaacgtaggaacgggacctaacgtaaacggcccggtacccgttacggttaacgggggttttacctaaggttccgtccgtttaccgtcgttacggtacccttaccgttaaaggtccgtacggaacctaaacggaccggtccccttacccgttacgaaccctaacttccgtccgttacggtaccctaccgacgtacccgttacggaaccggtaaccgggtaacggtaccgtaggtaacttttaacgtttaacgttcggtaccttacggtaccttaacgtaacttaacgttacggtacctaaaggttaaccgtttaaaggtttaacggttaacgtttttaacggggtaacgggggtttacccgggggaaccggggggttaaaccgttaacggggttaccgggttaaccgggtaacgggttaacggttacccggaaccgggtacccggtaaacggtccgtaccccggtcccccggttaccggttacccgtaaccgtttcccgttacccgttaaccccccg

SEQ ID NO: 7191 - DNA, 787 bp, Homo sapiens
  misc_feature: GYAE6OF02HQ3SH.23.71.G05.1.454.CMB.1.raw
  modified_base (146)..(146): a, c, t, g, unknown or other
  misc_feature (146)..(146): n is a, c, g, or t
  modified_base (602)..(602): a, c, t, g, unknown or other
  misc_feature (602)..(602): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtccncgggcccagtctcgccctgactcagcctcgcctcgtgtcgtgggtctccgtggacagtcgatccaccgtctctgcagtcggaacccgcagtgattggtaggtaacttttaatagtcggtctcgttaggtaacctaaactacccgtccgaaggaacaaaacccggaccccctaaaactccaacttaacttttaagtacggaacgggtaccaacgtaaacggcccggtccccgttacggttaggggggttttaccttaacgggttccgtacccgttttcgttccggtacgtacccgttaaccgaaacgtttccggtaccgggtaacaaacccgtacccgggtccccttccccgttaagacccttaactccgtttccggtacggtccccgttacccgacgtccgttacggaaccggacgacggtcgtagtaattactttagttcgtctcgtcgtactanttacgactaagttagtaggttaactttccggttagggttcgggggttaccgggacgggggtaaccgtaggttaccggacccggttacggtaacgggttaccgaaccggacccgttaacgggtcccgtacccggtaccccccggttacggacccgttacccttcccgttcccggtttaaccccccc

SEQ ID NO: 7192 - DNA, 710 bp, Homo sapiens
  misc_feature: GYAE6OF02GQ9KJ.23.71.G05.1.454.CMB.1.raw
  modified_base (231)..(231): a, c, t, g, unknown or other
  misc_feature (231)..(231): n is a, c, g, or t
  modified_base (317)..(317): a, c, t, g, unknown or other
  misc_feature (317)..(317): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccnacgtgtagttcggttgggtaacttttaatatggttctcgtggtaaccaactacctccaggaccaaacgccccaaatctatacttangaggcacgtaacgcgcctcgtacgggtttctacggtcgtcttctacgtcggcctaccgaagtccgtcggactaacaccggtcctcccgtacgaacctacttctccgtcggcctccgacgtccgtgaaccggtacggacggtctagttaattacttaacttcggtacttcgcttactagtacttcgacgtaagtagttaacgggtttaacgtttacgttttacgggtaacgggtttaccggggggaaccgggggtaaccgttaacggggttaccgggttaaccgggtttacgggtaaccgggtaccggtaacccgggtaacccgtacgggttcccgttacccggttacccccggttcgttacccgttaccttacccgttcccgttaaccccccg

SEQ ID NO: 7193 - DNA, 608 bp, Homo sapiens
  misc_feature: GYAE6OF02IISAY.23.71.G05.1.454.CMB.1.raw
  modified_base (313)..(313): a, c, t, g, unknown or other
  misc_feature (313)..(313): n is a, c, g, or t
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgattggttgggtacttttaatatggtctcgtagtacctaataccctccaggacaaacgcccccaaatcattacttagngaggacacgtaacgccggccctagtacgggtttctagtccgtnttcctctcggcctaccaagtctgacaacnccggcctcctagacctatctcgtcggcctcacgtcctagaacgacgaggctagtattattattcgctgctacatatcgacaagtatagttattacgtttggacgggttacgggccggggtaactaagggtcggtaccggttacggtacggtaccgacggacccgtaaggcccgttccggacccccgttcgggtacccctaccgttccgtacccgttccccccg

SEQ ID NO: 7194 - DNA, 858 bp, Homo sapiens
  misc_feature: GYAE6OF02FVQ7W.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccgcagtgatgttagggtacttttaatatgtctcgtggtaccaatacctcccagacaaacgcccccaaactcattactttatgagggcaactaagccggtccctcgtaggggtttctaggtccgtctttctcgtcggcctacctaagtcctgggaccaaccgtaccgggccccttccccgtacggaccctaacttccttaccgtcgggtaccccttcccgacggtccctacggacccggacggaacgggtccttacggttaatttaactttaacgtttggtacccgtttcggtaccttactaaacgtttacgttcggaaccgtaaaggttaaacgttttaacggtttaaacggtttttaaccgttttttacgggggtttaaacgggggggtttttacccgggggggacccgggggggggtaaaccccggttaaggggggtttacccggtaaaccccggggtttaccgggggttttaaaccggggttacccggtaaacccgggtaaccccccggttaaacgggggtacccccgtttaccccggggtaccccccccgggttttacccgggttaaccccgggtttacccccttttaccccgggtttacccccggttttaaccccccccccgg

SEQ ID NO: 7195 - DNA, 651 bp, Homo sapiens
  misc_feature: GYAE6OF02FPV2W.23.71.G05.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (304)..(304): a, c, t, g, unknown or other
  misc_feature (304)..(304): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcactcggaacccnagtgatgttggtacttttaanatggtctcgtgtaccaatacctccaggcaaacgcccccaaatcaattactttangacgggcaacgtaacgccgccctcgtaggggtttcctaggtcgtcttctcgtggcctacaagtcctggaccaacgccggcctcccgtacgacctagtcctccgtcggccctaccacgtccctaggaaccgacgacggtctagtaacttagtttacgttacgtcttacgccttacaagttaagttcgacgtaaggtattaacggtttacttacgttttagggcgggtttaccggggacgggggtaacctagggttcggtaccggttcggttaacggtccgtaacggaccccgtaaggtcccgtaccgtcccccggttccggtctacccgttccttaccggttcccccg

SEQ ID NO: 7196 - DNA, 632 bp, Homo sapiens
  misc_feature: GYAE6OF02HY3QA.23.71.G05.1.454.CMB.1.raw
  modified_base (309)..(309): a, c, t, g, unknown or other
  misc_feature (309)..(309): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctctgcactggaacccgcagtgatgttgggtacttttaatatggtctcgtggtaccaataccctcccaggaccaaacgcccccaaactcatactttangaggcactaagcgcctgtagggttcagtcgcttctcgtaggctccaagtctgcaacgcggcctcctcgaccctatctcgtcggtcctccgacgtcctacgaccggacgtacggctagtatttattaacttcgtcttgtccttacattacgtgtactaacgtagtaagttaacgttacgttttaggtaggggttacgggaccggggggtaaccgtaacgggtacggtaccgggttaccggtacgggtaccgtacggtacccgtaacgggtcccgttacccggtcccccgtcggttaccctcgttcccgttccggttccccccgg

SEQ ID NO: 7197 - DNA, 591 bp, Homo sapiens
  misc_feature: GYAE6OF02F4P8E.23.71.G05.1.454.CMB.1.raw
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (339)..(339): a, c, t, g, unknown or other
  misc_feature (339)..(339): n is a, c, g, or t
  modified_base (451)..(451): a, c, t, g, unknown or other
  misc_feature (451)..(451): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtcnccttttgcactggaacccncagtgatgttggacttttaatatggtctcgtggtaccaatacctccaggcaaagccccaaactcatacttatgaggcactaagccgccctcgtagggtttctagtcncttctctggctccaagtctgacaacgacggcctcctcgacctactactctcggtccctccgagtccctacggaccgacgtcgactgtaacttattagttcgcttagccttanattagcgcaagtacttacgttagttacctttggacggttcgggacgggggtaacaaggggtcaaccggtggtaacggtccacggacccctaaggcctcccggaccccgttggtaccctaccgttccgtccgttccccccg

SEQ ID NO: 7198 - DNA, 745 bp, Homo sapiens
  misc_feature: GYAE6OF02JMM1T.23.71.G05.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcacgtctcctgcactggaacccnagtgatgttggacttttanatggtctcgtgtaccaatcctccagcaaacgccccaaactcatacttatggacgtcacgtaagccggtccctcgtaggggtttctaggttccgtctttccgttctacggtccttacccgtaaagttccgttgggacctaaaacccgtaccgggtccccttaccccttacggaacccctattcccgtttcgtccgggtcccttacccgacgtcccgtacggtaacccgacggtacgggtccgttagtaacttttaagtttacgttcgtcgttcgtctacttaatagtcgtacgtaacggtaatttaacggttaacggtttacgttttacgggtaacgggggtttccggggaaccggggggttaactaacgggggttccggttaacccgggttaccggtaacggggttaccgaaccgggtacccgtaacgggtaccccgttcccggtacccccggttaccggttaacccgtaccccgtttccgttacccggttcccccccg

SEQ ID NO: 7199 - DNA, 692 bp, Homo sapiens
  misc_feature: GYAE6OF02G3SHZ.23.71.G05.1.454.CMB.1.raw
  modified_base (233)..(233): a, c, t, g, unknown or other
  misc_feature (233)..(233): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcctactcggaacccgnagtgattggttgggtacttttaatagtggtctcgtggtaacctaactaccctccaggacaaaccgaccccaaactctacttactttagaggacggcacgtaacgcggccctgtacggggtttctacggtcgtctttcgtctcggtcctaccgtaaggttccgtacggaccaaccggtaccgggtcccctaccccgtacgaaccctacgttcctccgttccggcccttaccgtaccgtcccgttggaaccggaccggtacgggtcttacggtaacttttaagttaacgttcgttcttcgtaaccttcgtaagtacgtcgtaacgagttacgtaacgtttagttaacggtttggtacggggttcgggaaccggggtacgtacggtcggtaccggttaggtacggtcgtaccggaccgacgtccgtccgtcccgttcggtcctaccgttcctcccgtacccc

SEQ ID NO: 7200 - DNA, 727 bp, Homo sapiens
  misc_feature: GYAE6OF02G00IX.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgagttggttgggtaacttttaatagttcggtctcggttcggtaacctaactaccctcccgaaggccaaaccgaccccccaaactctaacttactttagtgacgggctaacgtaacgccggtccctcgtacggggtttctaggtcgtctttctctcggcctccgaagttccgtaggaccaaccgccggtccctccctacgaccacgtcctcgtcggcccttccgacgtccgtcggaccgtacggaggtctagtaactttacgttagttcgtcgtcgtctacgtatagtcgtaacgtaagtaacgtaggtttaagtttaccgttttaggggtacggggtttaccgggggaccgggggtaaccgtaacggggttaccggtaaccgggtttacgggtaacgggttaaccgacccggtaacccggaagggttccccgtacccggtcccccggttaccggtacccgttacccggttcccgttcccggttaccccccg

SEQ ID NO: 7201 - DNA, 609 bp, Homo sapiens
  misc_feature: GYAE6OF02HJUVV.23.71.G05.1.454.CMB.1.raw
  modified_base (299)..(299): a, c, t, g, unknown or other
  misc_feature (299)..(299): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaatatggtctcgtggtaccaatacctccaggcaacgccccaaatcatacttangaggcactaagcgccctacgacgggtttctaggtcgtcttctcgtcggctaccgaagtctaggacaacgcggtccctccctgaacctactctcgtcggtcctccgacgtcctgaccgacgaggtctcgtaattagttattcgcgttcgcctactattagtcgacgtagtattaagttagttacgtttaggtacgggttccgggacgggggtacctaagggtcgtaccggttcggtaaggtccgacggtacccgtaacgggtccttcccggccccgttacggtccctaacgttcccgttccgttacccccg

SEQ ID NO: 7202 - DNA, 791 bp, Homo sapiens
  misc_feature: GYAE6OF02FMDOM.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccgtctcctgcacgtcggaacccgcagtgatggttacggtacttttaatagtggtctcggttcgtacctaactaccctccgaggaccaaaccgcccccaaatctaattactttagcggaggccaacgtaacggccggtaccctagtacggggttttacctacggttcgtacctttccgtcgcggtcctaaccgagttccgtacggaccaaccgtcccggtccccttaccctacggtaacccctactttcccgttccgtcggtacccccttaccgtaccggtacccgtacggaaccggtaccgggacgttcccgttaagttaacgtttacgtttattcggtcttcgtaccttaccgtattacgtacgtacgtaaggttacgtttaacggtttacggtttacggttttaccggggtaacgggggtttacccggggaccggggggttaaccggtaacgggttccgggtaaccgggtttacgggttaacgggtaccggaacccggtaaccccggtacgggtcccgttaccccggtcccccgggttacggtacccctaccggtttcccgtaccccggtttaccccc

SEQ ID NO: 7203 - DNA, 559 bp, Homo sapiens
  misc_feature: GYAE6OF02HX5FP.23.71.G05.1.454.CMB.1.raw
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttggacttttaatatggtctcgtggtaccaatacctcccaggcaaacgcccccaaatcatactttangaggcactaagccgcctgagggtttctagtcgtcttcntcggtctccaagtctggacaacgacggcctccngaccntctctcgcctcagcctgacgtacgaggtctagatttatatcgctgtctactatatgactagtagtagttagttacgttaggtacgggttcggacggggtaactagggtaccgtacggttcggtagtaccgacgtacccgagtccgtccgcccgtaggtaccacgttccgtccgttccccg

SEQ ID NO: 7204 - DNA, 690 bp, Homo sapiens
  misc_feature: GYAE6OF02GGXEO.23.71.G05.1.454.CMB.1.raw
  modified_base (232)..(232): a, c, t, g, unknown or other
  misc_feature (232)..(232): n is a, c, g, or t
  modified_base (291)..(291): a, c, t, g, unknown or other
  misc_feature (291)..(291): n is a, c, g, or t
  modified_base (481)..(481): a, c, t, g, unknown or other
  misc_feature (481)..(481): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctgccctgactcagcctgcctcgtgtctgggtctccgtgacagtcgatcgaccgtctacctgcacgtcggaacccngagtcagttggttcggtaacttttagtatggtcctcggtacggtacctaacgttacccnccgaacggtaccaaaccggcccccctaaatcctaacttactttacgtacggacgggtacctaaccgtaacggcccggtcccctacggttaacggggttttccgtacggtaccggttccttacgttccgtcgggtaccttacccgtaagttccgtacggaccaaaccgtccggtccctccgtacgaacctntcctacgtcgtcctccgtacgtccgtacggaccgacgtacgtcgtacgtagttactttacgtcgtacgttctccgtactaactcgtacgaccgagttacgtaacgttcgttacgttcgggtacggtcgggaccgggtaagtcggtacgtcggtacggtacgtcgacgaccgagtccaccgtcccgtacgtctaccgtcgtccgtccccg

SEQ ID NO: 7205 - DNA, 725 bp, Homo sapiens
  misc_feature: GYAE6OF02GLIA6.23.71.G05.1.454.CMB.1.raw
  modified_base (254)..(254): a, c, t, g, unknown or other
  misc_feature (254)..(254): n is a, c, g, or t
  modified_base (312)..(312): a, c, t, g, unknown or other
  misc_feature (312)..(312): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
tcagacgcgagtatcacgaccggtgctcgatttagtgtcgtcgcaagagagagggggggggtcactaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactggaacccgcagtgatggttggtacttttaanatggtctcgtggtaccaatacctccgaggacaaacgcccccaaactcaattacttagngacggcactaagccggcctcgtaggggtttcagtcgcttctcgtggctacagtctgcaacncggcctcctcgaccntcctcgtcggccctcgacgtcctcgacgacggtacgacttaggtactttaagttacgttcgtacgttcggtaccttacgtaagtacgttacggacgtaacgttaacgtttacgggtttaacgttttaacggttttaacggggttacggggttttacccggggggacgggggggttaaacccgtaacgggggttaccggtacccgggtttacggggttaacgggtacccgtaacccggggtaaccccggaaacggggttccccggttaacccgggtcccccccggtttagggttaccccgtacccggttttcccgttccccgggtttaccccccccgg

SEQ ID NO: 7206 - DNA, 691 bp, Homo sapiens
  misc_feature: GYAE6OF02HC3MR.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgctagtcgattgttgggtacttttaatattggtctcgtggtacaactacctccaggacaacgccccaaactcactacttatgagggacacgtaagccggtccttacgacgggtttctacggtcgtcgttctacgtcggtacctcgaagtcgtggaccaacgacggtcctcctcgacctactacctcgtcgtaccctaccgacgtccgtacgaccgaacggacgactaggttaactttaattagtttcggcttcggcttaccgtaattacggtcgtaccgtaagtacgtttaacgttaacggttaccgttttaggggtaacggggtttccgggggacgggggtaacccgtaagggtccggtaccggtttacgggtaggtaccggaccggtacccgaacgggttcccgttacccggtacccccggttcgggtacccttaccgttaccggttccgttaccccccg

SEQ ID NO: 7207 - DNA, 671 bp, Homo sapiens
  misc_feature: GYAE6OF02IYWZV.23.71.G05.1.454.CMB.1.raw
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctctgcactggaacccgnagtgatggttggacttttaanatggtctcgtgtaccaatcctccagtacaaacgccccaaatcattacttangaggcactagcgaccctgagggtttcagtcgtcttctcgtggcctaccgaagtctggaccaacgaccggtccctacctcgacctattccgtctacggccttaccgacgtccgtacgaccgtacggacggtacttaggtaactttagttacgttcgtaccgttgtccttactaagttacgtacgactaagtacgttaacgttacggttacgtttttaggaacggggtttccgggaacgggggtaacctaagggtttccggaacccggttacgggttaacgggtaaccgtaccggtaaccccgtaaacggtcccgttaacccgccccccggtttacggtaccttaacccgttccggtacccgtttacccccccg

SEQ ID NO: 7208 - DNA, 563 bp, Homo sapiens
  misc_feature: GYAE6OF02GA6GT.23.71.G05.1.454.CMB.1.raw
  modified_base (234)..(234): a, c, t, g, unknown or other
  misc_feature (234)..(234): n is a, c, g, or t
  modified_base (312)..(312): a, c, t, g, unknown or other
  misc_feature (312)..(312): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcatcctgcctccgtgtctgggtctcctggacagtcgatccaccgtctcctgccacgtcggaacccgnagtgattggttaggtacttttaatagtgttctcgtggtaccaatacctccgaggaccaacgccccaaatcatacttangaggcacgagcgacctgtaggtttctagtcgtcttctctgctacgagtcngcacgcgcctccnaccatcncgtcgcctcacgtcgngaccgagagntgtattattntgctgactnatgcntagtatagtnttacgttggtacggttcgggaccggggtaactagggtacgtaccggttacgtacggtaccgacggtaccggacgtccgtacccgtccccgttcgaccgtaccgttccgtcccgttaccccg

SEQ ID NO: 7209 - DNA, 610 bp, Homo sapiens
  misc_feature: GYAE6OF02HQ0HM.23.71.G05.1.454.CMB.1.raw
  modified_base (229)..(229): a, c, t, g, unknown or other
  misc_feature (229)..(229): n is a, c, g, or t
  modified_base (383)..(383): a, c, t, g, unknown or other
  misc_feature (383)..(383): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactggaacccncagtgatgttggtacttttaatatggtctcgtaggtaccaatacctccagcaaacgaccccaaactcatacttatggacggcactaagccggtcctcgacgggtttctagtcgtcttctctggctccaagtcgtgacaacgccgtcctcccgtnaccgtactccgttccgtcggtaccctaccacggtcccgtacggtaccggaacggtacggcttacgtaattttaacgttaattcggtaccttcgtacctacgtaacttcgtgaccgtaagtagttaacgttagtttacgtttgggtacggttcggggacgggtacgaggtcgaccgtggtacggtcgacgccgtagctcgtcccgtcgtccacgttcgtcctaccccg

SEQ ID NO: 7210 - DNA, 802 bp, Homo sapiens
  misc_feature: GYAE6OF02HXM4P.23.71.G05.1.454.CMB.1.raw
  modified_base (239)..(239): a, c, t, g, unknown or other
  misc_feature (239)..(239): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtcgtgggtcctccgtaggacagtcgactcaccgttatcctgccacgtcggaacccncgaggtgtacgttggttacgggtaacttttaatagttcggttcgtcgttacggtacctaactacccttacccgagggaccaaacgcccccctaaaactctaacttaactttagtacggaacgggacctaaccgtaacggcccggtccccgtacggttacgggggttttaccttacggttccggtacccgtttcgttcggtaccggtccttaacccgtaaggttccgtacgggacccaaaccggtacccgggtccccttacccgtacgacccgttaacgttccccgttccggttccggtaccccgttcccgtaaccggttaccccgtacggtaacccgggaacggtaccgggtactaacggtttaacttttaaacgtttacgttcggtacttcggtccttaacgtatacgtcgacgtagtaacgtttagttaacgttacggtttggacggggttccggggtaacgggggacgtaacgggtccgtaccgggtaggtaacggtcgaacggtacccggaaggtcctacccggcccgttacggtcctacggttccgtccgtacccccg

SEQ ID NO: 7211 - DNA, 722 bp, Homo sapiens
  misc_feature: GYAE6OF02IU6SQ.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggacagtcgactccaccgtctcctgcaccgtcggaacccgcagtgatggttaggtacttttaatagtggtctcgtacggtaccaactacctccccgagaccaaaccgacccccaaactcctaataacctttagtaggtacggctaacgtaacgccggcccgtacggtacggggttttcctagttccgtcctttcgtcgtacggtcctaccgtaacgtcgtccgacgaaccgccggtcccttacccgcggtaccctacttccgttacgtcgaccctaccgcgtccgtcgaccggacggtacggcttagtactttaagttacttcggtccgttgtaccgtactacgtacgtgaacctaggttacgttaagttaacgtttacgggttggttacgggggttacggggtacggggtaaccggtacggtacggtaccggtacggttacgggacctaaccgggacccggtaacggtcccgtacccggtccccgttaccggcccgtaacccgtttccgtaccccgttcccccg

SEQ ID NO: 7212 - DNA, 753 bp, Homo sapiens
  misc_feature: GYAE6OF02HP4ZL.23.71.G05.1.454.CMB.1.raw
  modified_base (233)..(233): a, c, t, g, unknown or other
  misc_feature (233)..(233): n is a, c, g, or t
tcagacgcgagtatcacgaccggtgctcgatttagtgtcgtcgcaagagagagggggggggtcacaagaggcagcgctctcgggacgtctccaccatggcctgggctctgccgctcctcactctcctcactcaggacacgagggtcctgggcccagtctcgccctgactcagcctgcctcgtgtctggtctcgtggacagtcgatccaccgtctctgccacgtcggaacccgnagtgagttggttagggtaacttttaaatgtggtcgtcgtacggtaacctaactaccctaccgaggaccaaaaccgcccccaaactctaacttaactttagtggacggacaacgtaacgccggtccgtacgtacggggtttctacgttcgtcttccgtcgtcggtacctaccgtaagttcgtacggacaaacccgaccggtcccttaccccgtacgtaaccctaacttccgttccgtccggtaccctaccgtaccgtacccggttacggacccggaacggacggtcgttaacggttaacttttaacgtttacgttgtccgttacgtacgttactaactacgttacggacgtaaaggtaactttaacggtttaacgtttacggtttacgggtaacgggggtttccgggggaccggggtaaaccgtagggtaccgtaccgggtacggtacggtacgaccgtaccggaacgtccgtacccgtcccgtcggtacctaccgttccgtacccgttacccctaccccg

SEQ ID NO: 7213 - DNA, 687 bp, Homo sapiens
  misc_feature: GYAE6OF02GJO5J.23.71.G05.1.454.CMB.1.raw
  modified_base (230)..(230): a, c, t, g, unknown or other
  misc_feature (230)..(230): n is a, c, g, or t
  modified_base (312)..(312): a, c, t, g, unknown or other
  misc_feature (312)..(312): n is a, c, g, or t
  modified_base (380)..(380): a, c, t, g, unknown or other
  misc_feature (380)..(380): n is a, c, g, or t
  modified_base (415)..(415): a, c, t, g, unknown or other
  misc_feature (415)..(415): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccnagtagtatggttaggtacttttaatagtggtctgtcggtaccaatacctccgagacaaacgcccccaaatctaattacttanagacggctacgtaaggccgccctgtaggggtttctacggtcgtcttctcgtggcctaccgaagttcgnggtaccaacgtaccggcccttaccgcgtaaccctnttccgtaccgtcggtccctccgacgtcccgtacggaccggtacggaggtccttaggtaacttttacgtttacgttcgtacgttcgaccttactagttaccgtgaacgtagtaagtttacgttagtttaccgtttagggacgggttaccggggacgggggtaacctaggggtaccggtaccggtccgggttacggaccgtacccggtaaccgtacggttcccgtacccggtcccccgttcggtaccctaccgttccgtcccggttcccccccg

SEQ ID NO: 7214 - DNA, 727 bp, Homo sapiens
  misc_feature: GYAE6OF02HQZK6.23.71.G05.1.454.CMB.1.raw
  modified_base (201)..(201): a, c, t, g, unknown or other
  misc_feature (201)..(201): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacngtcgatcaccgtctcctgcacgtacggaacccgcgagtcgagttggttacgggtaactttttaaatagttcggtcgttcggtacggtaacctaacttaccctacccgaaggaccaaaccgtacccccaaaactctaattactttatacggacggactaacgtaacggccggtccttacggtacggggtttctacggtccgtcgttctcgtcggtcctacgtaacgttcgtacggtaccaaccgaccggtccctccgtacgacctactctcgtccgcctaccgacgtccgtacggacgacggtacgtactagttattagttacgttcgtctgtcctagattacgtgaactaggtaacgttacgttacgttacgtttagggtacggggttacggggaccgggggtaacgtacggggttacgtaccgggttacgggttacggtaccggtaaccggtacccggtaacggccgttacccggtacccccggttcggttaccctacccggtttcccgttcccggttacccccg

SEQ ID NO: 7215 - DNA, 746 bp, Homo sapiens
  misc_feature: GYAE6OF02HN6YT.23.71.G05.1.454.CMB.1.raw
  modified_base (237)..(237): a, c, t, g, unknown or other
  misc_feature (237)..(237): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctccgtgacagtcgatccaccgtctcctgcctacgtcggaacccgnagtgtagttggttaggtaacttttaagtagttggttcttcggttacgtaacctaactacccgtacccgaaggaccaaacccgaccccctaaaactctaacttacgttagaggacggacctaacgtaacggcccggtccttacggtacggggtttctacggttccgtacttctcgtacggtcctaccgtaacgtcgtacggaccaacgccggtcccgtaccctacgaacctcttacgtccgtaccggtacctccgtacgtccgtacggaacgaccgtaggccttagttaactttacttagttaccggtctaggtaccttagtaattaccggtagtaaccgtaagttacgtaagtttacggttaacgtttcgggtaccggggttaaccgggacggggtaaaccgtaggttaccgggtaaccggttacgggtacggaccgtacggaacccggtaacgtccgtacccgggtacccctacggttacccgtccgttccggtcccggttacccccg

SEQ ID NO: 7216 - DNA, 604 bp, Homo sapiens
  misc_feature: GYAE6OF02GMOSG.23.71.G05.1.454.CMB.1.raw
  modified_base (230)..(230): a, c, t, g, unknown or other
  misc_feature (230)..(230): n is a, c, g, or t
  modified_base (312)..(312): a, c, t, g, unknown or other
  misc_feature (312)..(312): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccncagtgatgttgggtacttttaatatggtctcgtggtaccaataccctcccaggccaaacgccccccaaactcaatactttangaggcacgtaagcgccctcgtagggtttctagtcgcttctctggtcctaccaagtctaggaccaacacggccctccgtacgacctactcctcgtcggccctccacgtcctagaccgacgcggactacgtattattattcgtctgcttacatagttgctaagtagttacgttagttacgtttggtaggggttcggacggggggactaagggtcgaccgggttacggtaacgggtaccgaggtacccgaacggtcctcggccccgtcggttcctaccgtccgtccgttcccccg

SEQ ID NO: 7217 - DNA, 653 bp, Homo sapiens
  misc_feature: GYAE6OF02ITPMS.23.71.G05.1.454.CMB.1.raw
  modified_base (127)..(127): a, c, t, g, unknown or other
  misc_feature (127)..(127): n is a, c, g, or t
  modified_base (237)..(237): a, c, t, g, unknown or other
  misc_feature (237)..(237): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctnactcaggacacagggtcctgggcccagtctgccctgactcgagcctgccttccgtgtctgggtcctccgtggaccaggtcgatcaccgtctcctgccacgtcggaacccnagtgagtggttaggtacttttaatgtggtctcgtgtaaccaactaccacccgagaccaaacgaccccaactcaacttactttagcggacggcaacgtacggccgtaccgtcgtacgggtttctaggtcgtcttcgtctggtctactacgtctggacaacgaccgtcctacctagacctatcccgttcgtcggtccctccgtagtccctaacgggacgtacggtcggtactacgttaactttagtttacgtcgtctacgtaccttacgtattcgacgtacgtaagtagttaacgttagtttacggtttagggtaaccggggttcgggaaccggggtacgtaacggtacggtaacggttcggaaggttaccacggaccgtagccgtaccgtccgtacggtctacgtccgttcctcccg

SEQ ID NO: 7218 - DNA, 617 bp, Homo sapiens
  misc_feature: GYAE6OF02FWU8I.23.71.G05.1.454.CMB.1.raw
  modified_base (232)..(232): a, c, t, g, unknown or other
  misc_feature (232)..(232): n is a, c, g, or t
  modified_base (359)..(359): a, c, t, g, unknown or other
  misc_feature (359)..(359): n is a, c, g, or t
  modified_base (406)..(406): a, c, t, g, unknown or other
  misc_feature (406)..(406): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcacccgtctcctgccactcggaaccccnagtgattggttagggtaacttttaatagtggtctcgtagtaccaatacctccgaggcaaacgccccctaaatctaatacttagtggaggcacgtaagccggccctagtagggtttcagtcgtcttcncgtgctacgatctgacaacgcgcctcctgaccatctctcgtcctacngtcctacgacgacgtcgctagtaactttagtattcggaccttgcctatatagtcgactagtacttagttagttcgtttagggacgggttccggggacgggggtaacctaggggttaccgtacggttacggtaacgtaaccgtaccggtacccgtaagggccttaccccggtaccccgtaggttaccctacggttcctacccgttacccccg

SEQ ID NO: 7219 - DNA, 784 bp, Homo sapiens
  misc_feature: GYAE6OF02IT3AQ.23.71.G05.1.454.CMB.1.raw
  modified_base (140)..(140): a, c, t, g, unknown or other
  misc_feature (140)..(140): n is a, c, g, or t
  modified_base (622)..(622): a, c, t, g, unknown or other
  misc_feature (622)..(622): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacngggtcctgggcccagtctcgccctgactcagcctgcctccgtgtcgtgggtcctcctggacacgtcgactccaccgtctcctgcctacgtcggaacccgcaaggtcgtaagttcgggttacgggttaaccttttaagtacgttcggttctccggttacggtaaccctaaacgtaccctacccgaaggtaaccaaaaccgtaccccctaaaactcctaacttaacgttttaacgcggtaacgggtacctaaacgtacggtacccgtcccgttacggtaaacgggggttttcctaacgggtccgttccgtttcgttccggtacggtcccttaaccgtaacggttcctacggtaacccgaaccgtacccggtccccttacccgtacgacccttaacgtccgtcgtaccggtccctacgtacgtccgtacggaccgtacgacggtctagtagtttactgttcgtccgttacgactacgtacgtacngtaaccgtaagtactaacggttgttaacgttagggtacgggtccggggtaaccgggtaacggttacggtcggtaaccggttcggtaaccgtaccggccgtaaccgtaagtcccggtccccgtacccggttgtaccgtaccgttaccggttcccttcccccgg

SEQ ID NO: 7220 - DNA, 689 bp, Homo sapiens
  misc_feature: GYAE6OF02IF0W6.23.71.G05.1.454.CMB.1.raw
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
tcagacgcgagtatcacgaccggtgctcgatttagtgtcgtcgcaagagagaggggggggggtcacaagaggcagcgctctcgggacgtctccaccatggcctgggctctgttgctcctcactctcctcactcaggacacagggtcctgggcccagtctgccctgactcagcctgcctccgtgtctgggtctcctggacagtcgatcaccgtcctcctcgcaccgtcggaacccgcagtgagtggttgggtactttaatatggtctcgtggtaccaactacctcccaggacaaccgacccccaactactatactttagtgaggaccactaacgccggcctcgtagggttctagtcgtcttcgtcnggctccgaagtcgtcggacaaccncggtccctcctgaccactctcgtcggccctaccgcgtcctgaaccggacgtaggtcgtagtatttaacgttacttcggcctacgtctaccttatgttacgactaaacgtagtttaggtttaaaccgtttacggtttgggtaaccgggggtttacggggggacccgggggaaccgttaagggttaccgaccgggttacgggttacgggaaccgtaccggaaccccgggtacggtccttcccccgggccccggttacggttccctaaccgtttccccggttacccggttccccctaccccgg

SEQ ID NO: 7221 - DNA, 698 bp, Homo sapiens
  misc_feature: GYAE6OF02F8Z3M.23.71.G05.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (380)..(380): a, c, t, g, unknown or other
  misc_feature (380)..(380): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaaccccgnagtgatggttgggacttttaanatggtctgtggtaccaatcctccaggcaaacgcccccaaactcaatactttatgaggcactagcggccctgtagggtttctacgtcgcttcgtcgtggctccaagtctggacaacgcggtcctcccgngaaccctatcctcgtcggtccctccgacgcctcggaccgacgaggtccttaggtaacttttaagttacgtttcggacctttggacccttacgtaattacgtacggactaacggtagttaaacgttacggtttaacgttttagggtaaccggggtttaccggggtaccggggggtaaccgttaacggggtacggtacccgggtttacggggttacggggttaccgaacggtaccccgtaacgggtcccgtttacccgggtacccccccgtttcggggttaccctaacccggtttcccgttacccggtttaacccccccg

SEQ ID NO: 7222 - DNA, 646 bp, Homo sapiens
  misc_feature: GYAE6OF02ITAXB.23.71.G05.1.454.CMB.1.raw
  modified_base (141)..(141): a, c, t, g, unknown or other
  misc_feature (141)..(141): n is a, c, g, or t
  modified_base (235)..(235): a, c, t, g, unknown or other
  misc_feature (235)..(235): n is a, c, g, or t
  modified_base (314)..(314): a, c, t, g, unknown or other
  misc_feature (314)..(314): n is a, c, g, or t
  modified_base (487)..(487): a, c, t, g, unknown or other
  misc_feature (487)..(487): n is a, c, g, or t
  modified_base (496)..(496): a, c, t, g, unknown or other
  misc_feature (496)..(496): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgngggtcctgggcccagtctcgccctgactcacgcctgcctccgtgtctcgggtctcctggacagtcgatccaccgtctcctgccactcggaaccncagtgactggtacggtactttatatggtctcgtggtacaactcctccgaggacaaacgcccctaaactcaattacttanggacggtcaacgtaacgccgccctacggtagggtttactacgtcgtcttcgtcgtcggcctacgtacgtcgtacggacaacgccgtccctccgtacgacctactctccgtcgtaccctcacgtccgtacgacggacgtcgtacgttataatttattacgtcgtacttcgactntaatacggntaccaagttagttacgttaacgtttcgttagggtaccggggtacggggacggggaacttacgggacgttaccggtacgggtacggtccaacgggtccctaacgggtcctccggtaccccgtagtcccaccgtttccgtacccgttccccg

SEQ ID NO: 7223 - DNA, 784 bp, Homo sapiens
  misc_feature: GYAE6OF02H17N4.23.71.G05.1.454.CMB.1.raw
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcacgcctgcctccgtgtcgtgggtctcctggacagtcgatcaccgttctccgtgcacgtggaacccgcagtgacgtggttaggtaacttttaagtagtcggtcttcggtacggtaacctaacgtaccctaccgaagggtaccaaaccgtacccccaaaacttacctaacttaacgttttacgtagggaacgggtaccgtaaccgtaacgggccccggtaccccgttacggttaccgggggtttacttaacgggttccgtaccgtttccgtacggtacggtccctaccgtaacggttcgtacgggaccaaaccggccggtacccttccgtacgtacctactccgtccgtacggtaccctaccacggtccgtaacggaccggtaacgtgggtactagttactttaagttacttacggtctagtaccgtactaagtacgtacgacgtaggtaacgttaaggtttacgttacggtttacggtacggggggttaccggggaacggggtaactaggggttaccgtaccgggttacggggtaacggtaccggacggtacccggtaacggtccggttacccggtcccggttaccggacctttaccggttcccgtaccggttaccccg

SEQ ID NO: 7224 - DNA, 945 bp, Homo sapiens
  misc_feature: GYAE6OF02GXQXU.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgccacgtcggaaccccgcgaagtgaacgttggttaggggtactttttaaagtattcgggttcttcggttacgggtaacctaaacgttacccttacccccgaagggtaccaaaaacggaccccccccaaaaacgtccgtaactttaaaccgttttattacgggtaacggggtaccaaaccgtttaaaacggccgggtaccccgttacgtaacgggggtttttctaacggttccgtaccttttacgtcgttacggtcctacccgaaagtccgttcgggacctaaaccggtaccgggtaccccttcccgttacggaacccctacgttccgttaccgttacgggtccccttacccgaacggtccccgttaggtaaacccggaaccggtacggtacccgttacggtaaacttttacgtttaacgttcggtacccgtttacggtaacccttcgtaaacgtttaacttaccgggtaacctaaacgggtttaagtttaaacgggtttaacggtttaaccggtttttaagggtaaccgggggttttacccgggggaaccgggggggggttaaacccctaagggggtttaccggaaccccgggttttacgggtaaccggggttaaccgtaaacccgggtacccccgtaaacggggttacccttaccccggggtacccccccgtttcgggttaacccccgtacccgtttaccccggtttacccccggtttaacccccccgg

SEQ ID NO: 7225 - DNA, 576 bp, Homo sapiens
  misc_feature: GYAE6OF02JH61C.23.71.G05.1.454.CMB.1.raw
  modified_base (229)..(229): a, c, t, g, unknown or other
  misc_feature (229)..(229): n is a, c, g, or t
  modified_base (300)..(300): a, c, t, g, unknown or other
  misc_feature (300)..(300): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggtacttttaatatggtctcgtgtaccaatacctccaggcaaacgccccaactcatacttngaggcactagcgccctcgtagggttctagtcgcttctctcggctccaagtctggacaacncggcctccngaccatcctctcggccctcgacgtcctgacgacgngctgtaattattattcgctgtcctacatcgtgactagtattagttaacttacggtttggacggggttccgggacgggggtaactaagggtcgtaccgtcggtaacggtcgacggcccgtaaggccgttaccggcccccgttcgggtacctacgttccgtcccggttcccccg

SEQ ID NO: 7226 - DNA, 710 bp, Homo sapiens
  misc_feature: GYAE6OF02I710D.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggccagtctgccctgactcagcctgcctccgtgtcgtgggtctcctggacagtcgatcaccgtctcctgcacgtacggaacccgcagtgagtggttgggtacttttaatatggtctcgtcgtaccaactacctccaggccaaacgccccaaactctataccttagtggaggtcaacgtaacgccggtccctcgtaggggtttctacgtccgtcttcgtcgtacggcctacgaagttccgtaggacaaaccgtaccgggtcccttaccctacgaacccgtacttccgtcgtcgggtaccctcccgtacgtcccgtacggaaccggtaccggacgggtcttacggtaactttacgtttaacgttcggttacctcggttacccttacgtaactagttcgacgtaacggtagttaacgttacgtttacggtttagggacggggtttaccgggacggggggtaaccgttaacgggtacgtaaccggtacggttacgggacgtaccggacccgtaacggccgttaccggccccgttaccggtccctaccgttcccgttcccgtaccccg

SEQ ID NO: 7227 - DNA, 791 bp, Homo sapiens
  misc_feature: GYAE6OF02IVNIV.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacaggtcctgggcccagtctgccctgactcagcctgcctccgtgtctgggtctcctggacagtcgatcaccgtctcctgcacgtcggaaccccgnagtgatggtggtactttaatatggtctcgtggtaccaatacctccaggacaaacgccccaaactcatacttatggaggcactagccgtcctcgtacgggtttctagtcgtcttctcgtcggtcctaccgtaagttcctcggaccaaccgaccggtccctaccctcggaccctacttccgtactcgggtacccctaccgtaacgtcccgttacgggaaccggtaaccgggtacggtaccgttaggttaaacgttttacttacggtttacgtccgttacggtccttaaccgtaactttaacgtacggaccgttaaaagggttaacgtttaacggtttaaccggttttacgttttaacgggggtaaccgggggtttacccgggggaaaccgggggggttaacccttaagggggtttacccgtaacccggggttttaaccgggttaaccgggttaacccgaccggttaaccccggaacgggttccccgttacccccgggtccccccggttttaccgggtacccttaacccgtttcccggtttaccccgtttaaccccccccgg

SEQ ID NO: 7228 - DNA, 667 bp, Homo sapiens
  misc_feature: GYAE6OF02IRSAX.23.71.G05.1.454.CMB.1.raw
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (319)..(319): a, c, t, g, unknown or other
  misc_feature (319)..(319): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcgaccgtctcctgcactcggaacccgnagtcgatggttgggtacttttaanattggtctcgtggtaaccaatacctcccgaggcaaaaccgccccaaactcaattactttagnggacgggctaacgtacggccgtccctcgtacggggtttctaggtcgtcttcgcgtcggccttacaagttcctggctaacgccggtacctccctagacctatccgttcgtcggccctaccaacgtccgtacggaccgtacgacggtcttaggtagtttacttaagttcggtcttcggtacctacgtactagttcgactaacggtacttaggtaacgtttacgtttggggtaacgggttccggggacgggggtaccgtaagggtccgtacggttacggtaggtaccgacggtaccggaacggtccgtcccggtccccggttcggtactacccttaccgtccgttaccccc

SEQ ID NO: 7229 - DNA, 627 bp, Homo sapiens
  misc_feature: GYAE6OF02JBC5C.23.71.G05.1.454.CMB.1.raw
  modified_base (354)..(354): a, c, t, g, unknown or other
  misc_feature (354)..(354): n is a, c, g, or t
  modified_base (400)..(400): a, c, t, g, unknown or other
  misc_feature (400)..(400): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggccccagtctgccctgactcagcctgcctcgtgtctgggtctcctggacagtcgatccaccgtctcctgctactcggaacccgcagtgatgttgggtactttaatatggtctcgtcggtaccaatacctcccagcaaacgccccaaactcatacttactgacgggcactaacggccgtccctacgagggtttctagtacgccttntcgtggcctcgaagtctacggcaaccgacggtcctcccgtgtaccnttactctcgcctcacgctagaccgacgagcgtatacttatttactagtacttcgtacctactacctagtacgcgtaacgatttaacggttacgttacgttttcggagggttccgggtaacggggggtacccaagggttacgacccggtcggtacggtaccgaggtaaccccagggtcctccggtccccggttacccggttccctacccgttccggttaccctacccc

SEQ ID NO: 7230 - DNA, 661 bp, Homo sapiens
  misc_feature: GYAE6OF02HSND7.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttgggtacttttaatatggtctcgtggtaccaatacctccaggaccaaacgacccccaaactctattactttatggagggacactaaggccggccctacgtacggggttttctacggttccgtcttcctcgtcggtcctaccgtaagtcgtacggactaaccgaccggtccctccctacgacccacttcctccgtcggtccctacccacgcccgtcggaccgacggacggcgtagtatttattattgtcgtgtcctactattatgacgtagtaagtagttaacgtttacgtttacggttacggggttcgggaccggggggtaacgtaacgggtacggtccggttaaacggtcggtaccgacggacccgtaacggtaccgtccggtaccccgtacggtccgtacgttccgtcccgttccccg

SEQ ID NO: 7231 - DNA, 773 bp, Homo sapiens
  misc_feature: GYAE6OF02JZ9GG.23.71.G05.1.454.CMB.1.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactcagcctgcctccgtgtcgtgggtctcgtggacagtcgatcncgtctcctncacgtcggaaccgnagtgattggtggtacttttaagtatcggttctcggtagtacctaacgttacctacccgaggtaccaaaccggaccccaaacctccgtaattaaccgtttagaggacggtaacacgttaacggccccggtaccttacggtaacggggtttactacggttcccgtaccgtttcctacgtaccggtacctaaccgtaacgttccgtacgggaactaacccggaccggtcctacccgtacgtaccctaacgttccgtaccgttccggtacccgtacgtaccggtaccgttacgggaccggtaaccggtacggtacgttaggttaactttacggttatttaacggacctcggttacttacgtaagtaccgtagtacgacggtaacgtttaggttaaccgtttacgtttacgggttaaccggggttcgggtaaccgggggttaactacgggttaccggtacgggttaccgtaacgggtcgaaacggacccggtaccggtcgtacccgtacccgtccgtaccggtacccgttccgtccccgtaccccg

SEQ ID NO: 7232 - DNA, 811 bp, Homo sapiens
  misc_feature: GYAE6OF02HB00E.23.71.G05.1.454.CMB.1.raw
  modified_base (202)..(202): a, c, t, g, unknown or other
  misc_feature (202)..(202): n is a, c, g, or t
  modified_base (334)..(334): a, c, t, g, unknown or other
  misc_feature (334)..(334): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgccctcgtgtcgtgggtcctcctggacngtcgatccaccgtctcctgcacgtcggacccgcagtcgagtgttaggtacttttaatagtggtctcggtgtaccaatacctccgagcaaacgccccaatcatacttatgaggcatacgcgcctgtacggttnagtcgtcttctctcggtcctccgtaagttccgtggaccaacggtccggtaccctcccgtacgtaacctactccgttaccgtccggtccccgtacccacggtcccgttaacggacccgggtaaccggtacgggtacttaagggtaaccttttaagtttacggttacgtccgttaccggttcctaacgtaacgttacgttacgaaccgttaagtaaacggttttaaccgggttaaagtttttaaccgggtttttacgggggtaaccggggggtttcccgggggggtaaacccgggggggtaaaccgttaacggggggtttacccgggtacccggggtttaaccggggtacccggggttaccggaaacccggtacccccggggtaaacgggttaccccgttcccccgggtaccccggtttacccgggttaccccggttacccgttttaccccgggttaccccgttttccccccccccggg

SEQ ID NO: 7233 - DNA, 664 bp, Homo sapiens
  misc_feature: GYAE6OF02IJZVM.23.71.G05.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (289)..(289): a, c, t, g, unknown or other
  misc_feature (289)..(289): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtcgtggtctcctggacagtcgatccaccgtctctgctacgtcggaacccnagtgacttggttggtacttttaatntggtctcgtgtaaccaatacctccaggaccaacncccctaaactcattacttagagaggacactacgccgcctcgtagggttctagtcgtcttcgtcgcgtacctacgacgttcgtcggactaaccgaccgtcctccctacgaacctcgtcctcgtcgtcctacccgcgtacgtacgaccggacggtagtacgtacgttactttacgttacttcggacttcgaccttcgtaactagtcggataacggtagttacgttaacgttacggttttacgggtaacggggttcccgggtaacgggggtaaccgtaaggttccggtaaccggtttcggaacgggtacgaccggacccggtaacggtcccgtcccgtacccggtcgttccgacgtttcccggtaccctttacccccg

SEQ ID NO: 7234 - DNA, 653 bp, Homo sapiens
  misc_feature: GYAE6OF02FZNG1.23.71.G05.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccgtctcctgcactcggaacccnagtgatggttaggtactttaatatggtctcgtagtaccaatacctccaggacaacgccccaaatctattactttanggaggcaacgtaacgccgacctcgtaggggtttctagtccgtcttcgtcgtcgtctacaagtcgtcgactacgacgtccctcctacgacctatcctcgtacggccctaccgacgtccgtaggaaccgtacggaggtccttagtaactttattacgttcgcttcgtctactagtagttcgacgtaatagttaagttacgtttacgtttggtacggggttccggggaacggggtaacgtacgggttacggacccggttaggttacgggtaccaaccgggtaccccgtaaggtcccgtaccccggtaccccggttccgtaaccgtcccgtttcccgtcccttaccccccg

SEQ ID NO: 7235 - DNA, 593 bp, Homo sapiens
  misc_feature: GYAE6OF02JQU9G.23.71.G05.1.454.CMB.1.raw
  modified_base (251)..(251): a, c, t, g, unknown or other
  misc_feature (251)..(251): n is a, c, g, or t
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
tcagacgcgagtatcacgaccggtgctcgatttagtgtcgtcgcaagagagaggggggggtcggacaagaggcgagcgctctcgggacggtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgtggacttttanatggtctcgtggtaccaatccctccaggcaaacgcccccaaatcatacttangaggcataagccgcctgaggggtttcagtcgacttctcgtggctccaagtctgacaacgcggtcctccngaccatctcncgtccncctagcctagaccgacgacgctacgtattattacgttgtcctgtacctctagtacttcgcgataagttagttaagttccgttaaggtcgggtttccgggacggggggttaaccaagggttcggtaccggtcggttaaggtccacggtacccgtaaggtcgtacccggtccccgtcggtaactcccgttcgtacccggttcccccg

SEQ ID NO: 7236 - DNA, 766 bp, Homo sapiens
  misc_feature: GYAE6OF02JQ067.23.71.G05.1.454.CMB.1.raw
  modified_base (183)..(183): a, c, t, g, unknown or other
  misc_feature (183)..(183): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgacctcagcctgcctccgtntctgggtctccgtggacagtcgatcaccgtctcctgcacgtacggaaccccnagtgacttggttcggtacttttanattggtctcgtggtacctaatacccctccaggaccaaacgcccccaaactctacttacttagtacggaggtacactaacggccggacccttggtacgggtttctaacgttccgctttctcgtcggctacctaaggtctggacctaacgccggtcctccctagaccctatcctacgtaccgggccctcccgtaccgtccgtaaccggacccgtaaccggtaggtccgttacggtaactttttagtttaaccggttactcccggttaaacgcccggtttacctaagtttaaccgtcggtaccgttaaacgtaacgtttacgtttaaccggtttacggttttaggtacccgggggttttacgggggaacccggggggttaacggtaacgggttcccgggtaaccggtttcgggaaccggtttaccggaccggtacccgggtaagtccccggtacccgtaccccggtttaccggacccgttaacgttcccggttccccggttaccccccgg

SEQ ID NO: 7237 - DNA, 830 bp, Homo sapiens
  misc_feature: GYAE6OF02JM3VD.23.71.G05.1.454.CMB.1.raw
  modified_base (182)..(182): a, c, t, g, unknown or other
  misc_feature (182)..(182): n is a, c, g, or t
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctcgtntcgtgggtctcctggacnggtcgatccgaccgttcncctgccacgtacggaaccccgtnacggtgtacgtggttacgggtacttttaagtagtcggtccgtcggtacggtaaccctaattaccctccgtaggtaccaaacggtacccccctaaaacgttccgtaacttaccgtttaagtcgggtaaaccgggcctaaacgtttaacggccccgggtcccttaccggttaacgggggggttttcctaacggtccggttaccgtttccgtaccggttacggtcccttaaccgtaggttccgtacggtaccaaaccgtacccggtccctacccgttacgaaccctctaccgttcggtaccggtccctccgtaacggtcccgttaacgaccggtaacgtcggaccgttagtaacttacgttaacttcggtacttcggtaacctcgaacgttacgtcgacgtaacgttagtaaccgttacggtttaccgtttagggaacggggttaccgggtacggggggtaaccgtaagggttacgggtacccgggtacgggtaacggttacgtaaccggtcccggtaacgggtacccggtccccgtacccccgggttacgttacccggtaaccgttccggtttaacccccgttcccccggg

SEQ ID NO: 7238 - DNA, 570 bp, Homo sapiens
  misc_feature: GYAE6OF02I8LBR.23.71.G05.1.454.CMB.1.raw
  modified_base (230)..(230): a, c, t, g, unknown or other
  misc_feature (230)..(230): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggacttttaatatggtctcgtggtaccaatacctccgaggcaaacgcccccaaatcatacttatgaggacacgtaagccggccctcgtaggggtttctaacgtcgcttctcgtggcctccaagtctggacaacgacggtcctccctcgaaccacttctactcggcctccacgcctcgacgacgagctagtattattattgctgctactatangnagtatagtattacgtttgagggttcgggacgggggtaacagggtacgaccggtcggtaaggtacacgacccgaagtccgtaccgccccgtacggtcctaccgttcgtcgttaccccc

SEQ ID NO: 7239 - DNA, 749 bp, Homo sapiens
  misc_feature: GYAE6OF02IR1T2.23.71.G05.1.454.CMB.1.raw
  modified_base (259)..(259): a, c, t, g, unknown or other
  misc_feature (259)..(259): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccgtctcctgcacgtcggaacccgctagtgattggttagggtacttttaatnttggtcctcgtgtaaccaactacctcccaggcaaacgcccccaaactctaacttactttagtcggaggccaacgtaacggccggtccctacgtaggggttttcctacgttctcttacgtcgtcggcctaccgtaagtccgtacggcctaaaccgtacccggtaccccttcccgtacggtaaccctacgtttcccgttaccgtccgggtcccttacccgaaccggccccgttagggaacccggtacggaacgggtccttaaggtaacgttttaactttagttcgtccgtttcgaaccgttccgtaattacgttacgacgtaagttacgttaagggtttaccgtttacgtttaacgggtacggggttaccgggggaccggggtaacgtacgggttcggtaaccgggttccgggtaggtaacccacggtacccgtacggggtctccccggtccccgttacgtaccgtacccgtttccgttcccgttacccccg

SEQ ID NO: 7240 - DNA, 745 bp, Homo sapiens
  misc_feature: GYAE6OF02I5BMH.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctgccctgactcagcctgcctccgtgtcgtggtctcctggacagtcgatcaccgtctcctgcacgtggaacccgnagtgtagttggttaggttaacttttaagtagttcggttcgtcggttacggtaacctaactaccctaccgaggaaccaaaccgtacccctaaactaccttaacttaaccgttagacggaacggtacctaaccgtaacggccggtacccgttacggttacgggtttacgtacgttcgttcgttccgtcgtcgtaccgtaccgtagtcgtacgaaccgtaaccgtacccggtccctaccgtacctaccgtacttccgtccgtcgccctaccgaccgtaccgtaacggaccggtacggacgtctaagttacttattacgttcgtctacgtcctatactacgacgtacgtaagtaagttacggttacgttacgttacgggtacgggttacggggaccggggtaacggtaaccgggttcgtaaccggtacgggttaacggtccgtaaccggtaccggtacccggttaccgtccccggtcccggttacgttacccgtaccgttcccggtaccccgttcccg

SEQ ID NO: 7241 - DNA, 934 bp, Homo sapiens
  misc_feature: GYAE6OF02GRWTJ.23.71.G05.1.454.CMB.1.raw
  modified_base (215)..(215): a, c, t, g, unknown or other
  misc_feature (215)..(215): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccgtctcngcactcggaacccgcagtgacgttggttacggtacttttaatagtcggttacttcggtacggttaacctaaacgttacccgtaccccgtaagggacctaaaaccggtacccccctaaaaacttaccaaactttaaccgttttaagttacggaaccggggtaacctaacgtaaacggcccggtaccccgttacggtaaacgggggtttttccaacggttccggtccgttttccttcggttacggtcccttaaccgtaaacgttccgtacgggtaccgaaaaccggtacccgggtcccttacccccgtagaaaccccttacgttcccgttaacccgttccgggtacccccgttacccgtaacggtaccccgttacggaaacccggtaaccggggtacggttccttaacggggttaaacctttttaaacggtttcggtttaacgtccgtttcggttacccttaaccttaacgttaacgtttacggaaccggtaaacgttaacgttttaaacgggttaaccgtttttaaccgggtttttacggggtaaccggggttttaccgggggaacccgggggggttaaaccgtacgggggtttaacccggtaccgggtttacggggtaacggttacccggaaccggtaaccccgggtaaacgttcccggttaccggttacccccgttcggttaaccccgtaccgttccccggttacccgttccccccgg

SEQ ID NO: 7242 - DNA, 787 bp, Homo sapiens
  misc_feature: GYAE6OF02HTCET.23.71.G05.1.454.CMB.1.raw
  modified_base (233)..(233): a, c, t, g, unknown or other
  misc_feature (233)..(233): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctcgggcccagtctcgccctgactcagcctgcctcgtgtcgtggtctcctggacagtcgatccaccgtctcctgcacgtacggaacccnagtgattggtaggtactttaatgtggtctcgtagtactaactcctaccgagacaaaccgaccccaaactctaattactttagtacggacggtacctaacgtaacgccggtccctacggttacggggttttactacggttccgtccgtttacgtaccgtttacggtacccttaccgtaaacggttcgtaccgggtaaaccgtaaaccgtacccgggttcccccttaccccgtacggaaaccccttcttacccgtttaccggttcccggtacccgtacccgtaacggtccccgttaacggaacccggtacgggaccgttacgtaagttaactttaacgttagttaccgtcgttcgtacttaactagttaactcgaacgtaagtactttacggtaagtttacgtttagggttaccggggtcgggaaccggggtaaccgtaggttacccggtaccggtttaacgggtacggtacccggaacggtaaccccgtaaggtccccgttaccggtcccccggttacggtacccttaccgtttcccggtaccccgttacccccc

SEQ ID NO: 7243 - DNA, 567 bp, Homo sapiens
  misc_feature: GYAE6OF02IAWZV.23.71.G05.1.454.CMB.1.raw
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (302)..(302): a, c, t, g, unknown or other
  misc_feature (302)..(302): n is a, c, g, or t
  modified_base (453)..(453): a, c, t, g, unknown or other
  misc_feature (453)..(453): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtnatgttgggacttttaatntggtctcgtggtaccaatcctccaggacaacgcccccaaatcatactttangtaggcacgtagccggccctgacgggtttctagtcgcttctctggcctcaagtctggactaacgaccggtcctcctgaccctatcctctcggtacctccacgtccgtacgacgacgtaggctagtactttacgttattcgtctgtctcatntgctagatagtagtattggaggttcgggacggggtacaggtacgtaccggtagtcggtacgtacgaccgtaaggtcctcggccccgttcggtcctaccgttcgttccgtccccg

SEQ ID NO: 7244 - DNA, 735 bp, Homo sapiens
  misc_feature: GYAE6OF02JFAKC.23.71.G05.1.454.CMB.1.raw
  modified_base (185)..(185): a, c, t, g, unknown or other
  misc_feature (185)..(185): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactcctcctcactcaggacacagggtcctgggcccagtctgccctgactcagcctgcctcgtgtcngggtctctggacagtcgatcaccgtctcctgcactcggaacccgcagtgattggtggtaactttaatagtggtctcgtcggtaaccaacgtacctccgaggccaaacgccccaaactcataacttatgaggtcaacgtagcggcctcgtagggtttctagtcgtcttcgtctcggtctacgtaacgtcgtaggacaacggaccgtccctcccgtacgaccaattccctacgtcggtaccctccgacgtccgtacgaaccggtaaccggacgtacgtacgtacgtttaatttacgttcgtacgtagtaccctagttaacgtagttacggaccgtaacgttaacgttaacgttaagtttaacccgttttagggttaacgggggtttaccgggggaaccggggggttaacccgtaaaggggttcccgtaaccgggtttaccggttaacgggtaaccgttaaccggaaccccgggtaaggttcccggtacccggtaaccccccgggtttgggtaaccccttaccggttacccgtttacccgggttaaccccccg

SEQ ID NO: 7245 - DNA, 815 bp, Homo sapiens
  misc_feature: GYAE6OF02IVUAC.23.71.G05.1.454.CMB.1.raw
tcagacgcgagtatcacgaccggtgctcgatttagtgtcgtcgcaagagagaggggggggtcacaagaggcagcgctctcgggacttctccaccatggcctgggctctgctgctcctcactctcctcactcaggacacagggtcctggcccagtctcgccctgacctcacgcctgccctccgtgtcctgggtctcctggacagtcgactcaccgtctcctgccacgtaggaaccccgcagtgtaacgttggttacgggtaactttttaagtattcggttcctacgttcggtaaccctaaattacccgtccgtaaggaccaaaccgccccctaaaactccattaaccgtttaatggaacggactaacgtaaacggtcccggaccttacggtacggggttttactacggtccgtcgttccttacgcggtacctaccgtaagtccgtacggaaccgaacgtaccggtccccttacccgtacgacctaacgtcctccgttacggtccctaccgaacggccccgttacggacccggtaaacggtacggtcttaacggttaaactttactttaagtccgttacgtcgtaccttaactatttaacgcgtaaccgtaaggtaaccttaacgggtttaatttaccggttttacgggttaaccgggggttcggggaaccccggggggtaacttaaaccgggggtacccgttaaccgggttacgggtaaccgggtccaccgggtaaccccgacggggtacccttccgggttaaccccccgttcggtaccccggttaccgtttcccggttaccccgttaccccccgg

SEQ ID NO: 7246 - DNA, 641 bp, Homo sapiens
  misc_feature: GYAE6OF02HLD7N.23.71.G05.1.454.CMB.1.raw
  modified_base (199)..(199): a, c, t, g, unknown or other
  misc_feature (199)..(199): n is a, c, g, or t
  modified_base (320)..(320): a, c, t, g, unknown or other
  misc_feature (320)..(320): n is a, c, g, or t
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccgtctcctgccacgtcggaacccgcaggtgattcggttgggtacttttaatagtggtcgtcgttggtaaccatacctccgaggacaaacgcccccaaactcaattactttangacggcacgtaacgccgcctcgtagggtttctacgtcgcttctctggctcagtctcggcaacgcgcctccgcgaccntctcgtcggccctcncgcctgacgacgnggctagtattacttattcgacttcgactcgacttacgtgacgtagtacgtaagtttacgttaacgttttacggacggggtttccgggaacgggggtaacccgtaaggggttccggtacccgggttacggtacgggttaccgaccggtaacccgaacgggtcccgttccggtacccccggttacggttacctccccggttactccggttaccccccg

SEQ ID NO: 7247 - DNA, 680 bp, Homo sapiens
  misc_feature: GYAE6OF02JWL46.23.71.G05.1.454.CMB.1.raw
  modified_base (160)..(160): a, c, t, g, unknown or other
  misc_feature (160)..(160): n is a, c, g, or t
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (347)..(347): a, c, t, g, unknown or other
  misc_feature (347)..(347): n is a, c, g, or t
  modified_base (540)..(540): a, c, t, g, unknown or other
  misc_feature (540)..(540): n is a, c, g, or t
  modified_base (564)..(564): a, c, t, g, unknown or other
  misc_feature (564)..(564): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctacactcaggacactaggggtcctgggcccagtcncgccctgactcagcctgcctccgtgtctggtctcctggacngtcatccaccgtcctctgaccagtcggaccccgntagtagacttggttcggtaactttttaatagtgttcctcgttcggtaccaagttccccaccgtacggacaaccgaccccctaaactcctaattacctttagaggtaaccggngtaaccgtaacggtccggaccccgttagttacggggtttacctagtccgttacctttacttcgccggtcctaccgtacgttaccgtacggtacccgaaccgaccggtcccttacccgtagtaacccctcttacgtccgtcggaacccctcgtacgtacccgtagaacgtacgaggtacctagtacttaacgtntcgtctagtcttacgatctacgancgttaacgtaggttaacgttgttaggtccggggtacgggtaccgggtactaagggtcacggtcgtacgggcctaggcctaggcctccgtcccgtcgaccacgtcttacccgtcccg

SEQ ID NO: 7248 - DNA, 932 bp, Homo sapiens
  misc_feature: GYAE6OF02F3X50.23.71.G05.1.454.CMB.1.raw
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctcgccctgactcacgcctgcctccgtgtctgggtctcctggacagtcgatcaccgtctcctgcacgtcggaacccgnagtgattcggttagggtaacttttaagtntcggtctcggtacggtaaccaacttaccctccgaaggaccaaacgccccccaaacgtcaactttacctttagtcggacgggtaccaacgtaacggccgggtacccttacggtaacggggttttcctaacggttccgtcttttaccgtccgtcggtaccctccgtaaacggttccgtacgggtaccaaacccggtaccggtccccttaccccgttaccgaaccccgttacgttccccttcccgggttaccggtccccgtaaccccgtacggtaccccggtttacgggaaacccggtaaccgggtacgggtacccttagggttaaaacttttacgttttaacgttccggtacccgtttaggttaccccttaagtaccgttttaacgtacgttaaccggtaaacggttacgttttaaacgggtttaacgtttttaaccggggtttaagggttacccgggggttttaccgggggggtaaacccggggggtaacccgtttaagggttaccccggggtaacccggtttaccgggggttaaacggttacccggaacccgggttaaacccccgggttaacggggtttacccccgttacccgggttacccccccgggtttaccggttaaccccgtacccggtttttaccccgtcccccggggttttaaccccccccc

SEQ ID NO: 7249 - DNA, 847 bp, Homo sapiens
  misc_feature: GYAE6OF02I91GN.23.71.G05.1.454.CMB.1.raw
  modified_base (235)..(235): a, c, t, g, unknown or other
  misc_feature (235)..(235): n is a, c, g, or t
  modified_base (340)..(340): a, c, t, g, unknown or other
  misc_feature (340)..(340): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggacagtcgatcgaccgtctccgtgccactcggaacccncagtgagttggttcggtaacttttaatagttaggtcctcggttggtaaccaataccctccccagggaccaaaacggccccccaaaactccaacttaaccgtttanggacggggtcaacgtaaggccggccctacggtacggggttttactacggtacgtccttctccgttcggtcctaccgtaaggttccgttacggctaaaccgtaccgggtccctaccccgtacggaaccctacttccgtacgtccgggtccccttaccgacccgtcgttacggaccggtacggtacggtcgttaaggttaagttttaacttacggtttacgtcttacggtaccttacctacgtttaacgtcgtaccggttaagtaaacggtaacggttttaaacggttaccgttttaagggttaaccgggggtttcccgggggaaccggggggggttaacccgtaacgggggttacccggtaacccgggtttaccggggttaacggggttaacccgtaaccggggtaacccccggtaaaggggtacccccggtacccggggtttacccccccggttaccggggttacccccgttaacggtttccccggtttcccgggtttaccccccgg

SEQ ID NO: 7250 - DNA, 835 bp, Homo sapiens
  misc_feature: GYAE6OF02IOD7Q.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatccaccgtcctcctgccacgtcggaacccgcagtgagttggttagggtacttttaatattcggtcttcggtacggtaacctaactacccgtacccacggaccaaaccgacccccaaactactattactttagtaggacgggacctaacgtaaccggccggtcccgttacggtacgggggtttactacgtcgtccttctcgtcggtcctacctaacgttcgtaggaccgaaccgaccggtccctacccgtacgaacctacttccgtacgtccggtccctacccgaccgtcccgtacggtaaccggtaacgggtacggtaccgttacgttaacgttttacgttaagtttcgtacgttacgttaccttacgtaatttccgtagtaccgtaaaggttaacgttaaacgtttaagggtttaaccggttttaggggtaaccgggggtttaccgggggtaacccgggggggtaacccgttaaagggggttacccgggttaaccgggtttaccggggttaacgggttaccgaaaccggggtaccccggtaacgggttaccccggttaccccggtaccccccgggttaccgtttacccggtaccccgttttcccggttaccccggtttacccccccg

SEQ ID NO: 7251 - DNA, 811 bp, Homo sapiens
  misc_feature: GYAE6OF02HL2IM.23.71.G05.1.454.CMB.1.raw
  modified_base (196)..(196): a, c, t, g, unknown or other
  misc_feature (196)..(196): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctgggtctcgtgacngtcgatccaccgtctcctgcctacgtcggaaccccgcaagttcgatttgggttacgggtaactttttaagtattcgggtcttcggtacggtaccaacttaccctccaggacaaaaccgccccctaaaacgtcaacttacgtttagtgacggcaacgtacggccggccctcgtacgggtttctagtcgtcttctcgtcggccttccaagtccgtgaccaaccggccggtacccctccctacgacctacgtccttccgtacgggccctcccgtaacggtcccgtacggtaaccggtaaccggtaggtacccgttaggtaacttttaacgtttacgtttccgaccgttacgttaccgtacttaaacgttccgttagacccgtaaggttaactttacggtttaaccgttttaccggttttagggtaaccgggggtttacccgggggacgggggtttaaacccgaacgggggtttacggtaaaccccgggtttacggtttaaccgggtacccgtaacgggtaaccccccggttaagggttaccccgttccccgggttacccccccggtttaacgggttaccccgtaccggtttacccccggttcccgtttaacccccccg

SEQ ID NO: 7252 - DNA, 736 bp, Homo sapiens
  misc_feature: GYAE6OF02HKMZS.23.71.G05.1.454.CMB.1.raw
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgccactcggaacccncagtgagttggttggtactttanatggtctcgtggtaccaataccnccagactaacgcccccaaatcaattacttanacggaggcaacgtacgcggcctcggtagggtttctagtcgctttctacgtcggtctacgaacgttcgtcggacaacgtaccggtccctacccgtcgaaccgtatccgttcccgtcggacccctaccgtacgtcccgttacggaaccgtacgggtaacgtcttagtaagttttactttaacgtcgtccgttaggtcctactaacgttacgtggaaccttaggtaagtttaacggttaacgtttacggtttaggttaccggggggttaccgggaacccggggggtaacgtttaaacggggccgggtttaacccggttacgggttaacgggtcccgtaaacccgggtacccgggttaaaccgggtccgttccccggtaacccccggttccgggttacccgtaccgtttccccgttaccccggttacccccccg

SEQ ID NO: 7253 - DNA, 734 bp, Homo sapiens
  misc_feature: GYAE6OF02GK1DN.23.71.G05.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (509)..(509): a, c, t, g, unknown or other
  misc_feature (509)..(509): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctcctggacagtcgatccaccgtctcctgcactcggaacccgnagtgattggttgggtacttttaanatggtctgtggtaccaatacctccagcaaacgcccccaaatcatacttatgaggcacgtaacgccggccctggtacggggtttctaggttccgtcctttcgtcgtcggtcctaccgtaagttcgtacggaccaaaccgccggtccctacccgtcgaccctactcctcgtcggtccctccgtacgtcccgtagacccggtacggacgtctagtaactttactttacgttcgcgttcgccttacgaactttanaccgggtataacggttagttaacggttagttttaacgtttacggggttaacgggggttacccgggggtaccggggggtaaccctaagggggttccgggtaacccggtttacgggtaacgggttaccgaaccgggtaccccgtaaacgggtcccgtttaccccggtccccccggtttaccggtacccgttaacccgttccccggttaccccgtttaacccccccgg

SEQ ID NO: 7254 - DNA, 859 bp, Homo sapiens
  misc_feature: GYAE6OF02GQM5G.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaaccccnagtcgatggttgggtaacttttaatagtggtcctcgtcggtaacctaactacctcccgaggaccaaaccggacccccctaaaactcctaactttacttttacgtacggaacgggacctaaccgtaacggccccggtaccccgttacgggtaaccgggggtttttaccttaacgggttccggttcccttttaccgttcccggttcggtcccttaacccgtaaaggttcccggtacgggtaacccaaaccggaccgggtccccttacccgtacggtaacccctacttcccgtccgtccggtaccctaccccgacggtccccgtacggaaccggtaaccggtacggtccgttaagttaactttaactttcggttacggtccttacggaccttacgtaactttaacgcgtacgtaacgtaacgtttaagtttaacggtttaccggttttaggggtaccgggggtttaccgggggtaacccgggggggttaacctaagggggttcccgggttaaccgggttacgggttaaccggtaccggtaacccgggtacccggtaacgggtccccggttacccggtcccccggttacgggtaccccttacgtttccccggtttccccgttaaccccccg

SEQ ID NO: 7255 - DNA, 778 bp, Homo sapiens
  misc_feature: GYAE6OF02HS8OQ.23.71.G05.1.454.CMB.1.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactcagcctgcctccgtgtctgggtctcctggacagtcgatcaccgtctcctgcnctcggaacccncagtgatggttaggtacttttaagtatcggtctcgtacggtaaccaactacctaccgaggtaccaaaccgtacccccaaactctaacttaacctttagtacggacgggtacctaacgtaacggcccgtacccgttggttacggggtttcctaggtccgtcttcgtcgtcgtcctacctaaggtctcggtacaacgtaccggtccctcccgtcaacctacgttccgtaccctcggtccctacccgtacgtcccgttacgaaccggtacggtacgggtcttacgtaattttacgttaacgttcggtactcgtccttaactagttacgtacgtacgtaacgttaacgttacggttaacgttttaccggtttacggggttaaccgggggttccgggggtaaaccggggggtaaccggtaacggggttacgggtaaccccggtttacgggttaaccgggtccggtaaccgggtacccggtaaccgggtccccgttacccggtcccccgtaccgggttccctaacccggttcccggttcccggttaccccccg

SEQ ID NO: 7256 - DNA, 643 bp, Homo sapiens
  misc_feature: GYAE6OF02FWF41.23.71.G05.1.454.CMB.1.raw
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctacctcactcaggacacagggtcctgggcccagtctgccctgactcagcctgcctccgtgtctgggtctcctggacagtcgatcaccgtcctcctgcacgtcggaacccgnagtgatgttggacttttaanatggtctcgtgtaccaatacctccaggcaaagcccccaaatcatacttatgaggcactaagccgcctgagggtttcagtcgcttctcgtggctcaagttctacgggcaacgcggccctaccctggaaccctagtcctacgtcggcccttaccgacgtcccgtaggaaccggaccggacggtcccgtagtaactttaactttagtttcgaccgttcgcttactatactgaccaaggttactacgttacggttactttacgacgggttaccgggacgggggtaaccctaaggggttacgaaccggttaccggtagggtaccgacggtacccgtaaaggtccgttaccggcccccgttacggtccctacgttacccgtccgttacccccccg

SEQ ID NO: 7257 - DNA, 642 bp, Homo sapiens
  misc_feature: GYAE6OF02GT6FZ.23.71.G05.1.454.CMB.1.raw
  modified_base (392)..(392): a, c, t, g, unknown or other
  misc_feature (392)..(392): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaaacccgcaggtgatggttgggaacttttaatagtggtctcggtcggtaccaactcctcccgaggaccaaacgccccccaaaatctaacttactttagtggacggcaactaacggccggccctcgtaggggtttctagtcgtcttctctggtcctccaagttccgngaccgaaaccgccggcccttcccgtagacctacgtcctcgtcggccctccgacgcctaggaccgaggtacggctaggtaacttatttagtcgctcnccgtatagtancgtacaagtacgtagttacgttagtttggagggttccggggacggggtacgtaggtacgggaccggttaggtcggtaccaaccggtaccgacggttcgccccgttacccggttcggtaccgaccgttcgtcccgttccccccg

SEQ ID NO: 7258 - DNA, 689 bp, Homo sapiens
  misc_feature: GYAE6OF02GIDLU.23.71.G05.1.454.CMB.1.raw
  modified_base (248)..(248): a, c, t, g, unknown or other
  misc_feature (248)..(248): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgaagtcatgttggacttttaanatggtctcgtggtaccaatacctccgaggacaaacgcccccaactcacttactttacnggacggctacgtaacgccggccctagtacggggttctagtcgtcttctcgtcggcctacctaagtcgtcggactaaccgaccggtcccttcccgtacgaaccctacttcccgtcctcgggtccccttcccgaccgtcccgttacgaacccggtaccggaacggtccgttacggtaattttaacgtttaagttccggtcgttcgtacttcgtaatacgtcgactagtacgttaagttacgttagtttcggtaaggggttcgggtccggggtaaaccgtacgggtacgtaccggttacggtaccggtcgtaaccggcccggtaaacggtccgtacccggtacccccggtcgtacccttacgtccgttcccgtaccccgttccccg

SEQ ID NO: 7259 - DNA, 587 bp, Homo sapiens
  misc_feature: GYAE6OF02GO883.23.71.G05.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggttggacttttaatatggtctcgtggtaccaactacctccaggcaaacgcccccaaactcatactttatgaggcactaagcggtccctgtaggggtttctagtcgtcttctctggctcaagtctggcaacgacggcctccctgaccatctctcggtcctccagcctgaccgacgacggctagattattattcgcttgctctatatgcagtataagttacgttacgtttggtacgggttcgggacgggggtactaacgggtcggtaccggttacggtacggtaccgaaggaccccgaaggtccgtaccggtcccccgtaccggtacctaccgttccgtccggttccccccg

SEQ ID NO: 7260 - DNA, 638 bp, Homo sapiens
  misc_feature: GYAE6OF02HNTDJ.23.71.G05.1.454.CMB.1.raw
  modified_base (198)..(198): a, c, t, g, unknown or other
  misc_feature (198)..(198): n is a, c, g, or t
  modified_base (487)..(487): a, c, t, g, unknown or other
  misc_feature (487)..(487): n is a, c, g, or t
tcagacgcgagtatcacgaccggtgctcgatttagtgtcgtcgcaagagagagggggggggtcacaagaggcagcgctctcgggacgtctccaccatggcctggctctgctgctcctcactctcctcactcaggacacagggtcctggcccagtctgccctgactcagcctgcctccgtgtcgtggtctccgtggacngtcgatcacccgtctcctgccacgtcggaacccgcagtgagttgttgggtaacttttaatattggtcttcgtacgtaccaactaccctccgagaccaaccgacccccaaactctacttacttatcggaggctaacgtacggccggacctacgtagggttactgtctcttctcgtcgctacgagtcgtacgacaacgaccgtccctccacgaccactccgtcgtccgcctacgaccgcgtacgacgacgagtcgttagtattacttagttcgtctctacgtctactagtntacgaagttagtagttacgtttagttagggttaccggggttcgggaacgggggtacgtacgggtacggcggttacggtagtccgaccggaacccgacggtcccggtcccgtcccccggtacgttacgtaccgtaccgtttcccgtaccccg

SEQ ID NO: 7261 - DNA, 716 bp, Homo sapiens
  misc_feature: GYAE6OF02JF3RM.23.71.G05.1.454.CMB.1.raw
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcctactcggaaccccncgaagtcgagtgttacgggtacttttaaangtgtctcggtggtaccaactcctccaggactaaaccgaccccaatcactacgttatgaggcaactagccgcctcgtagggtttctagtcggtcttctcgtagtccgtacctaagtccttagggacctaacgtaccggcctccacggaccactctttacgtccggccttccgacgtccgtagaaccggacgtacggtaccctagttaacgttaacttcgttcgtccgtacggtctacgtactaacggttcgaaccgtaaggttacgttaacggttacggtttaaagtttaccgggggttacggggtttaacccggggaacggggggttaaacccgttaaacggggttcggttaacccggttacggttacggtaaccgaacccgggtacccgaacgttccggtacccggttcccctacgggttacctaccgggttccttacccggtttccccccg

SEQ ID NO: 7262 - DNA, 712 bp, Homo sapiens
  misc_feature: GYAE6OF02FV8UP.23.71.G05.1.454.CMB.1.raw
  modified_base (234)..(234): a, c, t, g, unknown or other
  misc_feature (234)..(234): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggacccagtctgccctgactcagcctgcctcgtgtctgggtctcctggacagtcgatcgaccgtctcctgcaccgtacggaacccnagtgattggtaggtacttttatatggtctcgtagtaccaatacctccaggaccaacgccccaaatcattactttagcggtaggctaacgtaacggaccgtcccttcggtacggggttttcctacggttccgtactttccgtccgttcggcccttacgtaacgtccgttagggaccctaaaccgacccggtccctacccgtacgacccgtactttcccgtcgtccggtaccccttaccgtaccggtccgtacggtaaccggacgtacggtaccttgtaactttacgtttattcggacttcgtactacctagttacgtcgtagtaacgtagttacgttacgtttacggtttacgggtcgggttaccggggtacgggtaaccggtaggtaccggtacggtacgggttacggtaccgacggaccgtaacggtcccgtaccgtccccggttaccgtacgtccgttacccgtccgttacccccg

SEQ ID NO: 7263 - DNA, 853 bp, Homo sapiens
  misc_feature: GYAE6OF02HNER2.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggacagtcgatcaccgtctcctgcactcggaacccgcagtgattggttggtaacttttaagtagttcggttctacggttacggtaacctaacgttaccctaccccgaaggacctaaaacccggacccccctaaaacgttctaacttaaccgttttacgtacgggtaacggaccgtaaccgtaacggtcccggtaccccgttacgggtaacggggttttcctacgggttccgtccgtttccgtcgtacggtaccttaccgtaacgttcgtaccggactaaccgacccggtcccgtacccgtacgtacctacgtccgtccgtacggccctccgaacgtcccgttacgacccggtacggacgtcgttaacgttaacgttttacgttacgttcgtccgttacgtccttaacgtacgtaacggttacgaccgttaaggtaacgtttacggttaaacgttttaccgggtttacggggtacggggtttacccgggggaacggggggttaaccgtaacgggggttcccggttaaaccgggttccgggtttaaccgggtacccggtaacccgggtacccggtaaccgggttccccggttaccccgtaccccgggttacggttacccccggttaaccgttttccccggtaccccggtttccccccgg

SEQ ID NO: 7264 - DNA, 739 bp, Homo sapiens
  misc_feature: GYAE6OF02HE54X.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgccctccgtgtcgtgggtctcctggacagtcactcaccgtctctgcactcggaccnagtgatggttggtaacttttaatagttggtctcggtcggtaaccaacttaccctccaggtacaaaccaccccctaaactcctattactttagtcggaacggtctaacgttaacgccggtcccttacggtagggtttctacgtccgtcttccttcgtcggtacctaccgtaacggttcgtacggaccaaccgtaccggtccctcccgttacgacctacgttcctacgtccggacccttccgacgtcctacggaccgacggtccggacttcgttaacttttattacggtttcgtaccgttcgtccttacgttatactacggactaacggtacgttaaggtttaccgttttaacggtttggggtaaccgggggttccgggggaaccgggggtaaccgttaaggggtaccgtaccgggttaacgggtcggtaacccgtaccgacccggtaacgggtcccgttcccgggccccgttacgggtacccttaccggttcccttacccgttaccccccg

SEQ ID NO: 7265 - DNA, 679 bp, Homo sapiens
  misc_feature: GYAE6OF02F26G6.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgccctccgtgtctgggtctcctggacagtcgatcaccgtctcctgcactcggaacccnagtgatggttggtaacttttaatatggtctcgtggtaccaatacctcccaggacaaacgcccccaaactctaatactttatggacgggacaactaacggccggccctcgtacggggtttctagtcgtcttctcgtcggctacctaagtccgtggaccaccgaccggtcctccctacgaccctatcctacgtcggccctaccgtacggtccctacggaccggaacggtacggccgttagtactttaattacgtttcgtcttacggtccttacgtagttacgtacgactagtaacgttaggtttaacgttacggttttacgggtaacgggttcggggaccgggggaccgtaagggtcgtaaccgggttcgttaacgggtaccgtaacggtacccgtacggtccgtcccggtccccgttaccggtcctaccgttcctccggttaccccccg

SEQ ID NO: 7266 - DNA, 657 bp, Homo sapiens
  misc_feature: GYAE6OF02H4RF8.23.71.G05.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtgaacccgnagtgatggttggtacttttaatatgtctcgtggtaccaatacctccgagcaacgaccccaaactcaattacttataggaggcctaacgtaacgccggtccctagtacggggtttctaggtccgtcttccgtcgtcggcctaccgtaagtccgtcggtacaaccgaccggtccctcccgtacgacctagtacctcgtccggtcctacccgtacgtcctaaggaccgaacggacgtactggtaatttagtttatacgtctagccttataacgtacgtacgactaagtacttaagtttaacgttacgtttgggtacggggttcgggtaccggggtaacgtaggtaccgggtaccggtacggttacggtaccgaccggtaaccgtacgtcccgtaccggtcccgtacgtcctacgttccgtccgttacccc

SEQ ID NO: 7267 - DNA, 613 bp, Homo sapiens
  misc_feature: GYAE6OF02FXM55.23.71.G05.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtgatggttggtacttttaanatgtctcgtgtaccaatacctccaggcaaacgcccccaatcatacttatgaggcactagccgccctcgtagggtttctagtcgtcttctcgtgctacagtctgacacncgcctccngacctatctcgtcgcctcacgcctgacgacgngtctgtattattattgcttcgctctatatcgactagtacgttagttacgtttacgtttagggtacgggttccggggacggggggtaaccctaggggttaccgtacccgggttacgggttaacgggtaccgaaccgggtaccccgtaaggtcccgttacccggtccccccggttaccggttaccgtacccgtttcccgttccggttaccccccc

SEQ ID NO: 7268 - DNA, 671 bp, Homo sapiens
  misc_feature: GYAE6OF02HXHD3.23.71.G05.1.454.CMB.1.raw
  modified_base (261)..(261): a, c, t, g, unknown or other
  misc_feature (261)..(261): n is a, c, g, or t
  modified_base (419)..(419): a, c, t, g, unknown or other
  misc_feature (419)..(419): n is a, c, g, or t
  modified_base (452)..(452): a, c, t, g, unknown or other
  misc_feature (452)..(452): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctcgccctgactcagcctgcctccgtgtctgggtctccgtggacagtcgactcaccgttcctcctgcacgtcggaaccgtcagtgatgttgggtaacttttaanagttcggttctcgtaggtaccaaactaccgtccaggacaaaccgccccaatctaatactttagcggacggtcaacgtacgccggtaccctcgtaacgggtttctagtcgtcttctcgtcggcctacgtagtctgacaacgaccgcctaccctgacctntcgtcgtcgcctccacgtcctacgacggtacgnggtactaggtactttagttacgttcgtactacgtctacgtacttagtacgtactaagtagttacggttaacgtttacggttagggttaacgggtcgggggaacggggttaacgtacgggtacgtacgggtacggttacggtaccgtacgggtacccgtaacggtaccgtcccggtccccggttaccggtacccgtacgttacccgtcccgtttaccccg

SEQ ID NO: 7269 - DNA, 717 bp, Homo sapiens
  misc_feature: GYAE6OF02IC2DW.23.71.G05.1.454.CMB.1.raw
  modified_base (231)..(231): a, c, t, g, unknown or other
  misc_feature (231)..(231): n is a, c, g, or t
  modified_base (449)..(449): a, c, t, g, unknown or other
  misc_feature (449)..(449): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctcgccctgactcagcctgccctccgtgtctgggtctcctggacagtcgatcgaccgtctctagcactcggaaccncagtgacttggttaggtaactttttaagtgttcggttctcggttacggtaacctaactcccgtaccgaaggacctaaaaccgtacccccaaaacttcctaactttacttttaagtcgggaacggtaccacgtaacgccggacccttggtacggggttttctacgtccgttccttcgtcgtcgtacctccgtaagtcgtggacccagaccggtcctacncgaacctctctcgtcgcctcgacgtccgtcgacgacggtacgtcgtagtnttaagttnttcgtctgtctactatacgtgtacgtaagtacgttagttacgtttaacgttacgggtacggggttaccggggaccgggggtaaccgtaacgggttacggttaccggttacgggtaacggtccgtaacggtacccggtaacggtcccggttacccggttacccggttcccggttacccgttacccgttacccggtttcccgttacccccgg

SEQ ID NO: 7270 - DNA, 654 bp, Homo sapiens
  misc_feature: GYAE6OF02GZTP3.23.71.G05.1.454.CMB.1.raw
  modified_base (233)..(233): a, c, t, g, unknown or other
  misc_feature (233)..(233): n is a, c, g, or t
  modified_base (435)..(435): a, c, t, g, unknown or other
  misc_feature (435)..(435): n is a, c, g, or t
  modified_base (487)..(487): a, c, t, g, unknown or other
  misc_feature (487)..(487): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgccacgtcggaacccgnagtgatggttacggtaacttttaatatggtctcgtaggtaccaactacctcccgaggtaccaaacgcccccaaactcaattacttatggacggacacgtaacggccgtccgtcgtacgggtttctacgtcgtccttctcttcggctcctaagtcgtgacaacgtccgtccctccctacgtaccactcctcgttcgccctccncgtccgtacggacgtacggcggtacgtacgtactttattacgttgtaccgtntaccgttactattatcgactagtagttaacggttacgtttacggttacggttaggggttaccggggcgggggtaaccgtaagggtcggtaccgggttcggtaacggtacaccggtaccgacggtacgtcccggtcccggttccggacgtccttcgtccgttcccccg

SEQ ID NO: 7271 - DNA, 618 bp, Homo sapiens
  misc_feature: GYAE6OF02G1RR8.23.71.G05.1.454.CMB.1.raw
  modified_base (232)..(232): a, c, t, g, unknown or other
  misc_feature (232)..(232): n is a, c, g, or t
  modified_base (403)..(403): a, c, t, g, unknown or other
  misc_feature (403)..(403): n is a, c, g, or t
  modified_base (472)..(472): a, c, t, g, unknown or other
  misc_feature (472)..(472): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgccctccgtgtcgtgggtctcctggacagtcgatcaccgtctcctgcactcggaacccgnaggtgattggttagggtacttttaatatggttctcgtaggtaccaactacctccaggacaaacgacccccaaactcctaatactttatggacggctaactaaggccgccctcgtacgggtttctagtcgtcttctcgtggctcgaatcgtgcaacgacgtcctcctcaccnctcctctcgggtcctccacgtcgtcgacgacgagcgtagtacttacttagttgcctcgctactaatgtnaccgtagtagttacgttagtttacggttggtacgggtttacggggacggggtaaccgtagggttcgacgggttacggtacgggtacctacggacccgtaggccgtaccggtccccgtacggtaccgtccgttccgtccgttccccg

SEQ ID NO: 7272 - DNA, 665 bp, Homo sapiens
  misc_feature: GYAE6OF02JQV5W.23.71.G05.1.454.CMB.1.raw
  modified_base (129)..(129): a, c, t, g, unknown or other
  misc_feature (129)..(129): n is a, c, g, or t
  modified_base (233)..(233): a, c, t, g, unknown or other
  misc_feature (233)..(233): n is a, c, g, or t
  modified_base (445)..(445): a, c, t, g, unknown or other
  misc_feature (445)..(445): n is a, c, g, or t
tcagacgcgagtatcacgaccggtgctcgatttagtgtcgtcgcaagagagagggggggggtcgacaagaggcagcgctctcgggacgtctccaccatggcctgggctctgctgctcctcactctcctnactcaggacacagggtcctgggcccagtctgccctgactcagcctgcctccgtgtctgggtctccgtggacagtcgatctaccgtctcctgctactggaacccncagtgatgtagggtacttttaaatatggtctcggtaggtaccaagtacctccaggacaaacgacccccaaatccatacttactggacggacactaacgcggccctcggtacgggttactggtacgtccttcgtcgtggtctctaacgtctcgggacaacgaccgtcctccctacgactacgtctcgtcgccctacacgtcctacgacacggngtcacgtattagttactcgtacgtcgtccgtactactagtccgaagtagtacgttaagttacggttaacgtttagggttaaccggggtttcggggaaccggggtaccgggaacggtttccggaacggtaccggtagggtaacccttacgggacccgttaacggtcccgttccggcccccggttaacggttcccgaccgtttccggttacccttacccccg

SEQ ID NO: 7273 - DNA, 662 bp, Homo sapiens
  misc_feature: GYAE6OF02H7BNI.23.71.G05.1.454.CMB.1.raw
  modified_base (320)..(320): a, c, t, g, unknown or other
  misc_feature (320)..(320): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgcactcggaacccgcagtgattggttgggtaactttttaatagtggttctcggtacggtaaccaatacctaccgaggacaaacgcccccaaaatcaattactttancggaggcacgtaagccggtcctacggtacggggtttctagtcgtccttctcgtcgcctaccagttcgtacggactaacgaccggcctccgtacgaccgattccgtccgtcggcccgtaccacggtcccgttaggaccggtacggacggtctaggttaactttacttagttcgtactacgtactacgatagtgacgtagtattaggttaattacgtttagtacggggttccgggaacggggtaccgtagggttaccgtaccggttacgggtacggtaccgaacggtaccggacgtcccgtccgtaccccggtcggttaccctacgtttcccgtccttaccccg

SEQ ID NO: 7274 - DNA, 654 bp, Homo sapiens
  misc_feature: GYAE6OF02JMB4X.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctccctgcactggaacccgcagtgatggttacgggacttttaagatggtcctcggtcggtacctaataccctcccgaggacaaacgcccccaaactctaattacttactgacggctaactaacggccggcccgtcgtaggggtttctagtcgtcttctactggcctctaacgtctcggacaaccgacggtcctccctagtacccactcgtctcggcctccacggcgacgaccggacgtaggtctagtattattatcgtcctagtctagtactagcgtacgataacgtagttagttacgtttacggacggggtttccggggacggggtaaccgttaacgggtacggtaccggttacggtaacggtccggtaaccgtaaccggtacggtacccgtcccggtaccccggttacgtacccgttacgttccgttcccggttacccccg

SEQ ID NO: 7275 - DNA, 732 bp, Homo sapiens
  misc_feature: GYAE6OF02HKFM8.23.71.G05.1.454.CMB.1.raw
  modified_base (251)..(251): a, c, t, g, unknown or other
  misc_feature (251)..(251): n is a, c, g, or t
  modified_base (453)..(453): a, c, t, g, unknown or other
  misc_feature (453)..(453): n is a, c, g, or t
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
  modified_base (541)..(541): a, c, t, g, unknown or other
  misc_feature (541)..(541): n is a, c, g, or t
tcagacgcgagtatcacgaccggtgctcgatttagtgtcgtcgcaagagagaggggggggtcgacgaagaggcagcgctctcgggacgtctccaccatggcctgggctctgctgctcctcacctctcctcactcgaggaccacgacgggtcctcgggcccagtctcgcccctagactcacgcctcgcctccgtgtctcgggtctccgtaggacagtcgatccgaccgtctctagctaccggtagaacccgnagttgagtttgggtacggttaaccttttaaagttagtcggttccgttcgtacggtaacctaacgtaccctacccgtaaggaacctaaaacccggaccccctaaacctacgtaacttaacgtttacgtacggacggactaacgtaaccgccgggacccttacggtacgggttcgtacgtcgtctcttgtacgcgttacacgtntacgaccaagcccgtccaccgtcaacccgtntacctcgacgtcctccncgccgttacgacgtaagcgtacgtcgttaattatacgttntcgttccagttacctaggttctaggtaccgtaagtagtaaggttaacttacgtttagggtaccgggggttacgggaacccgggggttacctagggtaccggttacccgggtttcggaacggttccgaccgaccggtaaccgcgtaccccgtcccgtcccggttacctacgttcccgtcgttaaccccccgg

SEQ ID NO: 7276 - DNA, 709 bp, Homo sapiens
  misc_feature: GYAE6OF02GL1B3.23.71.G05.1.454.CMB.1.raw
  modified_base (325)..(325): a, c, t, g, unknown or other
  misc_feature (325)..(325): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatccaccgtctcctgacacgtacggaacccgcagtgattggttaggtaacttttaatagtggtctgtcggtaacctaactacctccaggacaaacgaccccaaaactcaacttactttanggacgggtaccaacgtaagccgtccgtcgtagggtttctagtcgtacttctcgtcgtctacaagtcgtggaccaacgaccgtcctcctagacctatcctcgtcgtcctaccgacgctacgacgacggacgtctagtacttattagttcgcttgtactactaatacgtgaaccgtaagtacgttaaggtttacgttacggttttagggtaacgggttaccgggggtaacgggggtaaccgtaaggggttaccgggaacccgggtttacggtacgggttaaccggaacccgggtaacccggtaaccgggtacccgttaccccgggtaccccccggttacgggttaacccctcccggtttacccggttcccggtttaccccccccgg

SEQ ID NO: 7277 - DNA, 681 bp, Homo sapiens
  misc_feature: GYAE6OF02F639F.23.71.G05.1.454.CMB.1.raw
  modified_base (235)..(235): a, c, t, g, unknown or other
  misc_feature (235)..(235): n is a, c, g, or t
  modified_base (311)..(311): a, c, t, g, unknown or other
  misc_feature (311)..(311): n is a, c, g, or t
  modified_base (468)..(468): a, c, t, g, unknown or other
  misc_feature (468)..(468): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggacagtcgactcacccgtctcctgccactcggaacccnagtgatggttaggtacttttaatatggtctgtacgtacaactacctccaggacaaacgccccaatctattacttanaggaggcaacgagccgtcctgtaggtttctacgtcgtcttctctcggtctacgtagtcaggaccaacgtccggacccttccgtacgaacctatcctcgccgtaccctaccgactccgtacgaacgacggtacgtcgtacgttagttactttacgttnaccgttgtccctatacgtagtcgactaagtacgtttaaggtttaacgtttacggttttacgggaccggggtttaccggggaaccggggttacccggaagggttaccggtacccggttacggttaccggtaaccggtaacccgaccgggtaacggtacccggtcccggttcccccgttaggtacccgtacccgttccgttccccggttcccccg

SEQ ID NO: 7278 - DNA, 909 bp, Homo sapiens
  misc_feature: GYAE6OF02HXTU0.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgcagtgagtggttagggtaactttttaagtagttcgggttcgttcggttacggtaaccctaaacttacccttaccccgaacgggtaccaaaaaccggtaccccccctaaaacttacctaaactttaaccgtttttaagtacgggtaacggggtaccgtaaccgttaaaacgggtccccggtaccccgttccggttaacggggggtttttcctaacgggttccggtccttttccgtccgttcgggccttaacccgtaaacggttccgttacgggaccaaaccggtacccgggtaccccttccccgttacgaaccctacgttcctccgttcggaccccttacccgacgtcccgtacggaaccggtaaccggacgggtactaaggttaacttttaactttaacgttcgtaccgtttacggtcccttaactaacgtttacgtcggaacgttaacggtaaggttttaacggttaacggtttacggttttacggggttaacggggggtttaccgggggtaaccgggggggtaacccgtaagggggtttacccggtaaccgggtttaccgggtaaccgggttaccgtaaccgggaaccccgttaacggggtccccgttacccggttccccccgggttacggtaccccgtaacccggttttccggttaccccggtttacccccccgg

SEQ ID NO: 7279 - DNA, 764 bp, Homo sapiens
  misc_feature: GYAE6OF02GCBCD.23.71.G05.1.454.CMB.1.raw
  modified_base (232)..(232): a, c, t, g, unknown or other
  misc_feature (232)..(232): n is a, c, g, or t
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtcgtggtctccgtggacagtcgatcaccgtctcctgcactcggaaccccnagtgatggttagggtacttttaagtagtggtctcggttacggtaaccaacttaccctccgagaccaaacgcccccaaactcaacttacttangaggcaactaagccgcctcgtagggttctagtcgtcttcncgtggtacctaccgaagtcgtacggacaaccgtaccggcccttaccgtacgaacccgtattcccgttacgtaccggtccctaccgtaccgtcccgttacgggaacccggtacggtacggttaccgttacggtttaaaccgttttagtttaacggtttcggacctttacgggtcccttataacggtttaacgtggtaacccgtaggttaacgtttacggttaaacggttttcggtttaacggggtacggggtttaccgggggtaacccgggggtaacgtaacggggttaccggtacccggttacgggtttaaccgggaccgtacccggtaccggacggtaccccgttccggtccccccggttacggtacctcccggttacccgttcccgtttaccccccgg

SEQ ID NO: 7280 - DNA, 727 bp, Homo sapiens
  misc_feature: GYAE6OF02GLJKW.23.71.G05.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgccactggaaccccncaagtcgagtggttggacttttaanatggtctcggtgtaacaactacctccaggacaaacgacccccaaactcacttactttatgacggacactaacgccggtcctcgtaggggtttctacggtcgctttacctcgttggccttacgaacgttcgtaggccaaacgccggtaccctcccgtagacccactcctacgtcggcccttaccgacgtccgtacgaaccggaccggtacggtacgttacgttaactttacgtttaagttacgtccgttcgtacctactacttactcggtactaaggtaacgtttaagttacggtttacgttttacggggtacggggtttaccggggaccggggggttaaccgaacggggttacgtaaccgggtttacgggtaaccgggttaccgtaaccggaccccggtaacggtcccggttcccggttacccccggttcccggtaccgtacccgttcccggttacccgtttaaccccccgg

SEQ ID NO: 7281 - DNA, 829 bp, Homo sapiens
  misc_feature: GYAE6OF02H3ADR.23.71.G05.1.454.CMB.1.raw
  modified_base (237)..(237): a, c, t, g, unknown or other
  misc_feature (237)..(237): n is a, c, g, or t
  modified_base (457)..(457): a, c, t, g, unknown or other
  misc_feature (457)..(457): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatccaccgtctcctgccacgtacggaacccncgagtgagttggttcgggtaacttttaagtagttggttccttacggttacggtaaccctaaacgtacccgttacccgaagggaacctaaaacccggacccccctaaaaacgttacctaaactttaaccgttttaacgtagggtaacgggactaaaccgttaaacggcccgggtaccccgttacggttaacgggggttttcctaaggttccgtacctttcncgttggtacccttactaacggttaccggtcggaaccgaaaccgtacccggtcccttcccgtacgaacccttacgtcccgttacgttaccggccctacccgacgtacccggtaccggtaccggtaacggacggtaccttaggttaacgttttaacgtttacgttcgtccgttcgtacctactaacttacgtgtacgtaaggttacgttaaggttacgtttacggttttaggggttaacggggttaccgggggtaaccgggtacgggtaaacgggtcggtaccgggttacggtacgggtaaccgaccggtaaccgaacggttcccgtacccggtccccgtaccgtaccgtacccttaccggtccgttacccccg

SEQ ID NO: 7282 - DNA, 616 bp, Homo sapiens
  misc_feature: GYAE6OF02H9XC4.23.71.G05.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
tcagacgcgagtatcacgaccggtgctcgatttagtgtcgtcgcaagagagaggggggggtcacaagaggcagcgctctcgggacgtctccaccatggcctggactctgctgctcctcactctcctcactcaggacacagggtcctgggcccagtctgccctgactcagcctgcctccgtgtctgggtctccgtggacagtcgatcaccgtctcctgctactggaacccncagtgatgttgggtacttttaatntggtctcgtgtaccaatccctccaggaccaaacgcccccaaatcacttactttatggacggcactaaggccgtcctgtagggttctagtcgtcttctctggccttacgaagtcgtgacgaacgccggtccctccctgaccctagtccttcgcgtcctccacgtcctggacgacggagtctagtattagttacttgtctgtcttacgatatgactaagtattaagttagttacgtttagggtacgggttacggggaccgggggtaaccgtaaggtccggtaccggttaggtacggtaccgacggacccggtaacggtcccgttcggcccccgttggtaccgtacctttccgtccgttaccccc

SEQ ID NO: 7283 - DNA, 826 bp, Homo sapiens
  misc_feature: GYAE6OF02H2GT5.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacgagggtcctgggcccagtctgtcctgactcacgcctgcctccgtgtcgtgggtctccgtggacagtcgactccaccgttctcctgcctacgtcggaaccccgcgagtgtacgttggtttacgggttaactttttaaagtagttcggttccttacggttacggtaaccctaaattaccccgtcccgaagggtaccaaaacccggtaccccccaaaacttccgaaactttacgttttacgacggacgggtacctaaacgtaaccggcccggtaccccttgggttaacggggttttccttaacggtccgtccttttaccgtcggttccggtaccctacccgtaaggttcccgtacggtaacccgtaaaccgacccggttccccgtaacccgttcggaaaccccttacgtccgtccgttccgtaccccgttccaaccggttcccgtaacggaccgtaaccggtacggtacgttacgttaacttttaacgtttacgtacgtcgttacggtacctacgttaatcgtgtaaccgtaagtacgttaagttaacggtttcgttagggtcgggtaccggggtacgggaacgtacggtacggttaccggtcggttaccggactaccggtaacgaccgggtcccttacccggtaccccggtagttcccgtaaccgtttcccggtaccgttccccccgg

SEQ ID NO: 7284 - DNA, 842 bp, Homo sapiens
  misc_feature: GYAE6OF02HVC43.23.71.G05.1.454.CMB.1.raw
  modified_base (140)..(140): a, c, t, g, unknown or other
  misc_feature (140)..(140): n is a, c, g, or t
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacngggtcctgggcccagtctgccctgactcagcctgcctccgtgtctgggtctccgtggacagtcgatctaccgtctcctgcacgtcggaacccgnaagtcgattggttggtaacttttaanagttggtctcggtcggtacctaactacccgtccgaggaccaaaccggaccccctaaaactctaacttaaccttttagtacggacgggacctaacgttaacggccggtaccctcggtacgggggtttcctacggttccgtacgtttccgtacgtcggaccttaccgtaacgtccgtacggacctaaccgaccgggtccccttacccgtacgtaaccgtacttaccgttaccgtaccgggtaccctccgtaaccggtcccgttaacggaacccgggtaacggtacgggttaccgtacggttaacgtttaacgttaacggtttcggaccgtttacggtaccttaacgtattaccgtacggtaccgtaaaggtacgtttaacgggttaacgtttaacgggtttacgggttaacgggggtttaccggggaccgggggttaaccgtaacggggttaccgtacccgggttttaccgggtaacgggttaccgtaaaccgggtcccgttaacggggtacccgttaccccgggtacccccggtttcgggttaacccctaccggtttacccggttacccggttaccccccggg

SEQ ID NO: 7285 - DNA, 656 bp, Homo sapiens
  misc_feature: GYAE6OF02F2S50.23.71.G05.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (312)..(312): a, c, t, g, unknown or other
  misc_feature (312)..(312): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctcgtgtctggtcctcgtggacagtcgatcaccgtctctgcactcggaacccgnagtgatgttggtaacttttaagntgtctgtcgtaccaactcctccgaggaccaacgaccccctaaatctaattacctttagnggtaggacctaacgtacgccgcccgtgtaggtttctagtccgtcttcgactcggtccctcgtaagtctacggacgaaccgtaccgtaccccgttcctcgacccgttattcccgtcgttaccggccccgttaccgacgtaccgtccggaacgaccggtacggtctagtactttagttacgttcgtcttcgtctctactatcgtacgtaagtagttacgttagtttacgttcggtacgggttccgggacggggtaaccgtacggttcggaccggtggtaaccggtcgtacggtaccccgaagttcccgtaccgtccccgtaccgtcgtactccgtacgttcccccg

SEQ ID NO: 7286 - DNA, 698 bp, Homo sapiens
  misc_feature: GYAE6OF02JUOK7.23.71.G05.1.454.CMB.1.raw
  modified_base (139)..(139): a, c, t, g, unknown or other
  misc_feature (139)..(139): n is a, c, g, or t
  modified_base (190)..(190): a, c, t, g, unknown or other
  misc_feature (190)..(190): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (408)..(408): a, c, t, g, unknown or other
  misc_feature (408)..(408): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacngggtcctggcccagtctgccctgactcagcctgcctccgtgtcgtgggtcncctggacagtcgatccaccgtctcctgccacgtcggaacccgnagngtatggttgtaactttaatntgtctcgtacgtaccaatacctccgaggaccaaccgaccccctaaatcctattactttagacgacggactactaacggccgtcctacggtcggttactcgtcgtcttctcgtacgcttaccagtctcggacaccgtaccggtccctacccgngtaaccctagtcctcgtaccgtccctaccgtcgccgtcgaacgtcggaacggtcttaacgtatttactagttcgccttcgtactcgttaaactgttacccgagtaacttaaggttaaccgttaagtttcggtttaaagggtccggggttaaccgggggtaaccgggggaacttacggggttacgtacccggtttaacggttaaccgggtctaaacccggtcccggtaaccggtcgtacccccgggtaacttaccgggtttcgaccggtttacccttcgtttaaccccccg

SEQ ID NO: 7287 - DNA, 576 bp, Homo sapiens
  misc_feature: GYAE6OF02GSW4E.23.71.G05.1.454.CMB.1.raw
  modified_base (252)..(252): a, c, t, g, unknown or other
  misc_feature (252)..(252): n is a, c, g, or t
  modified_base (359)..(359): a, c, t, g, unknown or other
  misc_feature (359)..(359): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttggacttttaantggtctgtgtaccatacctccaggaccaagccccaaatcatacttatgaggcactaagcgcctgtagggttctagtcgtcttctctggctaccgaagtctgacaacncgcctcctgactatctctcggcctcgagcctagaccgacgacggtctagtattattntgctcgctactacttatcganagtattaggtaagtttacgttggaacgggtttcgggaccgggggtaactaggggtcgtacccggtaggttacgggacctacggcccgtaaggtccgtacccggttcccgtacggtcctaccgtcgttaccgttcccccg

SEQ ID NO: 7288 - DNA, 738 bp, Homo sapiens
  misc_feature: GYAE6OF02I7FEU.23.71.G05.1.454.CMB.1.raw
  modified_base (236)..(236): a, c, t, g, unknown or other
  misc_feature (236)..(236): n is a, c, g, or t
  modified_base (284)..(284): a, c, t, g, unknown or other
  misc_feature (284)..(284): n is a, c, g, or t
  modified_base (668)..(668): a, c, t, g, unknown or other
  misc_feature (668)..(668): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctcgccctgactcagcctgcctccgtgtcgtggtctccgtggacagtcgatccaccgtctcctgcacgtacggaacccgngtagtgtatggttacggtaacttatagtgtactcgtacgtaacctaanccctaccgaggaccaaagccccccaaaagtccaatactttactagaggacaacgtaagcggtaccctagtaacgggtttctaggttccgacgtttaccgtacgttacggaccttaccgaagttcctagggactaaaccgacggtacccttacccgtacgaaccctagtacccgttacgtacggtcccttaccgacgtaccgtacggaaccggtacggtaacggtacgtaagtaacgttaacgttaacgttacgtacgttacgtacctaacgtaactaacgtacgtacgtaacgtaacgtaacggttaacgttaacgttttacggtaacggtttaccggggtaaccgggggtaaccgttaacgggtacggtaaccggttaacggnttaacggtaaccgtaacggtacccgtaacggtaccgtaccggtaccccgtaccggtaccgtaccgtaccg

SEQ ID NO: 7289 - DNA, 816 bp, Homo sapiens
  misc_feature: GYAE6OF02IEC5L.23.71.G05.1.454.CMB.1.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (507)..(507): a, c, t, g, unknown or other
  misc_feature (507)..(507): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtactcctggacagtcgactcaccgtctccngcacgtcggaacccngagtgcttaggttacgggtacttttaatacgtcggtactccggtgtaacctaacgtaccctcccgaacggactaaaccgcccccaaactacgtacttaacttagtggaacggtactaaccgaacggccggtacccgttacggtacggggtttacttacgttcccggtcctttccgtacgttccggtaccgtaccgtaaggttccggtacgggaccctaaaccggtaccggacccgttacccgtacgaaccctacgttccctaccgtcggtacccncgtaaccgccgtacggacggacggtacggtacgttacgttaactttaagttagtttcgtccttaacggtccttaacgttacgtattacgggtactaacgttaacgtttaccgttaacggtttacggttttaacggggtaccgggggtttaccggggaacggggggttaacctaaacggggttcgaaacccgggtttcggtaaaccgggtttccggaaccgggttaaccccgtaacggtaccccggttccccggtaaccccggtttacggggaacccttcccggttttaccgttacccgtttaccccccg

SEQ ID NO: 7290 - DNA, 721 bp, Homo sapiens
  misc_feature: GYAE6OF02J0C1H.23.71.G05.1.454.CMB.1.raw
  modified_base (118)..(118): a, c, t, g, unknown or other
  misc_feature (118)..(118): n is a, c, g, or t
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (572)..(572): a, c, t, g, unknown or other
  misc_feature (572)..(572): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctnactctcctacactcaggacacacgggtcctgggcccagtctgccctgactcagcctgcctcgtgtctgggtctcctaggcagtcgatccaccgttctctagccactacgggaacccngagttcgatgggttacggtaactttttaangttacgggttctacgggttaggtaacctaacgttaccgtccccgaagggtaccaaaaccggtacccccctaaactctacgttaaccttttagtacggaagggacttaacgaacggtccgtcccgtaagtcgggggtttacctacgttccgccgttacgttcgtcggacccttacgtaacggtccttacgggacaaaacccggtacggttcccctaccgtagaccctaagtccttccggtcggcccttaccgacgtcccgtacggaccgaccggtagggtactaggttactttagtaacgttgtcctntaccgtactacgtaacttgtaccaaggtatacgttacgtacgtttaggtacgggttcgggaacgggtacgtaacgtcgacggtacgtacggcgtaccgaccgtaaggtccgccgttcccgtaggtaccgtaccttacgtccgtaccccg

SEQ ID NO: 7291 - DNA, 643 bp, Homo sapiens
  misc_feature: GYAE6OF02FUL90.23.71.G05.1.454.CMB.1.raw
  modified_base (504)..(504): a, c, t, g, unknown or other
  misc_feature (504)..(504): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccgcaggtgagtggttgggtaactttttaatatcggttctcgtggtaaccaactacctcccgaggacaaaccgtccccccaaatctaacttactttatggagggtccaacgtaacgccggtccctcgtaggggtttactagtcgtcttctcgtcggacctcgtaacgttcgtaggaccaacgacgcccttaccctcgtacctactcctccgtcggccctccgacgtcctggaccgacggaggtctagtacttattagttcgctcgtctcgatacncgatacgtatacgtaacgttacgtttagggagggttcggggacggggtaccgtaaggggtcgaccggtcggtaaggtcaaccggacccgtaacggtccgtccgtccccggttacggtcctacggttccttccgtccccc

SEQ ID NO: 7292 - DNA, 653 bp, Homo sapiens
  misc_feature: GYAE6OF02G09LA.23.71.G05.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggtacttttatatggtctcgtggtacaatacctccaggacaaacgcccccaaactcatacttatgaggcactaagccggccctcgtaggggtttctacgtcgtcttctcgtcggtctcctaagttccgtggacaaccgaccggtccctccctacgacctactacctcgtcggcccttcccgacgcccgttacggaccgtaccggaggtcctaggtaactttattagttacgtcttcgaccttctacgtactgaccgtaagtagttagtacgttaacgtttggtacggggttccgggacgggggtaaccgaaggggttacgtaccggttacgggttaaggtccgaaccggtacccgaacggtccgttacccggccccgttccggttacctaccgttacccttccggttacccccg

SEQ ID NO: 7293 - DNA, 645 bp, Homo sapiens
  misc_feature: GYAE6OF02GESYT.23.71.G05.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (450)..(450): a, c, t, g, unknown or other
  misc_feature (450)..(450): n is a, c, g, or t
  modified_base (488)..(488): a, c, t, g, unknown or other
  misc_feature (488)..(488): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctgacngtcgatcaccgtctcctgcacgtcggaaccccgnagtgactggttggtaacttttaatagttcggtcttcggtacggtaaccaactacccgtcccgaggaccaaaccgacccccaaactctaacttactttagtggacggacctaacgtaacggccggtccctgtaacggggtttctacgtcgtcttctcgtcgctaccaagtctcggacaacgacgcctaccgtcgacctacgtctctcggtcctccgacnccgtcgaacggcgagtctagtacttattagtctccgtncctacatatcgactagtataggttagttaccgtttagggtcgggttacgggaccgggggaactaagggtccggtacggttggtacggtaccgtaccggacccgtacggccgttcccgtcccggttaccgtcctaccggttccttacccgttaccccc

SEQ ID NO: 7294 - DNA, 674 bp, Homo sapiens
  misc_feature: GYAE6OF02G1O8N.23.71.G05.1.454.CMB.1.raw
  modified_base (555)..(555): a, c, t, g, unknown or other
  misc_feature (555)..(555): n is a, c, g, or t
  modified_base (655)..(655): a, c, t, g, unknown or other
  misc_feature (655)..(655): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggaccagtcgactcaccgtctcctgcactcggaacccgtcagtgacttggttacgggtattttaagtatggtctcgtacggtaccaactacctaccaggaccaaaccgacccccaaactctaacttactttacgtaggacggactacgtaacgccggtccctaggtacggggtttctacggtcgtcctttccgtcgtcgtacccgtacgaacggttccgtacgtaccgtaacgacccggtcccttacccgtcgtaacctacttccgttccgtccggccctaccgaccgtccgaccgaacggaccggtaggccgttaagttaacgtttagttacgttgcttacgtcctactatactcgtnaacgtattacggttattacggttggtacggggttcgggaccgggtacgaggttcggcgtaggtcggcgacggtcgaccgtcgtacccgtcccgtcgtacnccgttccgtaccgttcccg

SEQ ID NO: 7295 - DNA, 705 bp, Homo sapiens
  misc_feature: GYAE6OF02GLVMP.23.71.G05.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctcgtgtctggtcctcctggacngtcgatcaccgttctcctgcactcggaacccgnagtnagtgttggtaacttttatatgtctgtgtaccaactccnccagacaacgccccaatcattacttangacggcactagccgcctcgtacgggttctagtcgtcttcncgtcgcctaccaagtcgtcgaccacgtaccggcccttacctacgaccctactccgttacgtccggtaccctccgacgtccgtacgacccgggtaacgacggtcctaggttaactttaacgtttagttcgtaccgtttacggccctttataacttaagtcgtaccgtaaggttaaacgtttacggtttaactttacgggttttaccggtaacgggggtttccggggaacgggggtaacctaaacgggttccggtaacccgggtttacggtaaccgggtaaccaccggtaacccggtaggttccccggttaacccggtccccggttacggtacccttaccggtttacccgtacccgtttccccccccg

SEQ ID NO: 7296 - DNA, 770 bp, Homo sapiens
  misc_feature: GYAE6OF02FPYAP.23.71.G05.1.454.CMB.1.raw
  modified_base (232)..(232): a, c, t, g, unknown or other
  misc_feature (232)..(232): n is a, c, g, or t
  modified_base (309)..(309): a, c, t, g, unknown or other
  misc_feature (309)..(309): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccgnagtgatggttaggtacttttaatatggtctcgtggtaaccaattacctccaggcaaacgcccccaaatcatacttangaggcactaagcggcctcgtaggggtttcagtcgtcttctcgtcggcctccgaaatcgtggaccaaacgacggcccttaccctgaacccactcctccgtcggccctaccgacgtcccttacggaaccggtaccggacggtccgttagtaacgttttaagttttaacgttacggtcctttggtacccttacgtaacgtttaacgtcgtaccgaaaggttaacgtttaaggtttaaacgggtttacccgtttttaaggggtaaccgggggtttacccgggggtacgggggggggttaaacccctaagggggtttcgggaaccccggggtttaccgggtttaacgggtaacccggtaacccggtaacccccgggtaaacgggttccccgttaccccgggtcccccccggtttaccgggtacccttaaccccggttccggtttaccccggtttaacccccccccg

SEQ ID NO: 7297 - DNA, 782 bp, Homo sapiens
  misc_feature: GYAE6OF02FLYP9.23.71.G05.1.454.CMB.1.raw
  modified_base (233)..(233): a, c, t, g, unknown or other
  misc_feature (233)..(233): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtcctctggacagtcgatcaccgtctcctgcacgtacggaacccgnagtgagttggttaggtacttttaatgtgtctcgtaggtaccaactacctccgagaccaaaccgaccccctaatctaattacttagacggaggacctaacgtaacggccggtcccgtacggtacggggtttctacgttccgtcctttcgtcgtcggtacctacgtaagtccgtacggaccctaaccggtacccggtccccttacccgtaccgtaacccgtacgttcccgtaccggtccggtccccgtacgtacccggtaccgtacggaacccggtacgggtacgtaccgttaaggttaactttaacgtttcgttcgtccttcgtaccgttactaaggttctacggagttaacgtaagtttaacggtttacggtttaaccggtttcggggtaacgggggtttaccgggggtaacggggtaacccgttaggggttacccggttaccggtaccgggttacggacccgtaaccggtacccggtaacggtccccgtttaccccggccccggttcggttacccttcccggtttacccgttcccccgttaacccccg

SEQ ID NO: 7298 - DNA, 735 bp, Homo sapiens
  misc_feature: GYAE6OF02HWRKL.23.71.G05.1.454.CMB.1.raw
  modified_base (235)..(235): a, c, t, g, unknown or other
  misc_feature (235)..(235): n is a, c, g, or t
  modified_base (569)..(569): a, c, t, g, unknown or other
  misc_feature (569)..(569): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatccaccgtctcctgcacgtcggaacccncaggtgattggttacgggtaactttttaatagttcgggttctacgtggtaacccaattaccctcccgaggtaccaaaacgaccccccaaaactctaacttaactttagtaggtacgggacctaacgttaaacggccggaccccgttacggtagggggtttaccttaggtccgtaccttttcgtccgtaggtcctaccgtaagttcgtacgggaccaaacgacccgggtacccttccccgtacgtaacccgtattacccgttcgttaccgcccttcccgacgtccgtacggaccgacggacggtcttagtaatttacttagttcgacttgcttanaacttagtgactaagtagttaacgttacgtacgtttacggtagggttaccggggacgggggtaccagggttaccgaccggttcggtaacgttcggaccgaacccggtaacggccgtacccgcccccgggttcggacctacccgttacccgtacccgttaccccccg

SEQ ID NO: 7299 - DNA, 747 bp, Homo sapiens
  misc_feature: GYAE6OF02JWLW7.23.71.G05.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacgagggtcctgggcccagtctgccctgactcagcctgccttccgtgtcgtaggtctccgtaggacngtcgatccaccgtctcctagccacgtcggaacccgntagtcgatggttggtaactttttagattcggtcttcgtacggtaaccaacgttacctacccagggaccaaaccgacccccaaactctaacgtaactttagtagacggcctacgtaacggcccggtcccgttacgtagggggttttcctaacggttccgtatttacctcgtcggccttaccgaagttcctacggaccaaacgtccggccctcccgtacgaccacttacgttcctaccggtcctacccgacgtcccgttgaacccggcggtaccggtcgttacgtaacgtttattacgttgtacttacgtcctacgtactacgttacgactaagtacgtttaaggtaacgttttacggtttaacgggttcggggtaaccggggttccgggggtaaccgtaacggggtccgtaccggttccggtaagggttaccgaaccggaccgtaacgggtaccgtcccgaccccgttccggttacccgtaccctttaccggtccccgtttaacccccgg

SEQ ID NO: 7300 - DNA, 741 bp, Homo sapiens
  misc_feature: GYAE6OF02JMCYS.23.71.G05.1.454.CMB.1.raw
  modified_base (169)..(169): a, c, t, g, unknown or other
  misc_feature (169)..(169): n is a, c, g, or t
  modified_base (252)..(252): a, c, t, g, unknown or other
  misc_feature (252)..(252): n is a, c, g, or t
  modified_base (637)..(637): a, c, t, g, unknown or other
  misc_feature (637)..(637): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggttcctgggccagtctgcctgactcngcctgcctccgtgtctggtctctgacagtcgatcacgtctctgcgcgtcgaaccgcagtgacgttggtacggtacttttaagntggtcctgtacggtaaccataccctccaggtccaaacgtccccgaaactctaacgttactttacggtacggacgggactaaccgtaaacggcccggtacccttacggtaacggggttttcaacggtttcgtaccttcgtcgttacgggaccttaccgtaacgttcgtacggtactaaaacgccggttccctaccgtacgtaacctacgttttccgacgttcggtaccctcgtaccgtaccgtacggtacgtacgaacggttcttaacgtaactttaacgttacgttcgtacgttacgtcttaccgtaagtcgttacgactaaggtacttaacggttaagttaaccgtttacgggtacggttaaccggggacgggggtttaaaccncggggttacgttaccggttacgggtaacggttaccgaacgtacccgggtaactcccggtccgttacccgtcggttaccgtaaccgtttcgccccgtttacccgg

SEQ ID NO: 7301 - DNA, 832 bp, Homo sapiens
  misc_feature: GYAE6OF02HGHJ1.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctccctcactcaggacacagggtcctgggcccagtctgccctgactcagcctgccctccgtgtcgtgggttctcctggacagtcgatcaccgtctcctgcctactcgggaaaccctcgaggttgagttggttcggggtaaactttttaatagttggttccgttcggttcggtaacctaaactacccttaccccgaggaaccaaaaccggacccccccaaaaacttcgtaactttaaccttttaagttacggaacggggtacctaaaccgttaaacggccccgggtccccgtttaccggttaacggggggtttttcctttaacggttccggtccttttcgttaccttacgggtcccctacctaaacggttccgttcggggtaacccaaaccggtacccgggttccccttccccgtacgaaccgtacttccttccgtacgggccccttccgtaccggcccgttacggaaccggacggtacggtccgttaggttaattttaagtttacgttcgttccgtcgtccgttaactaagttacgttgtaccgtaagttaacgtttaacgttaacgtttcgttttacgggttaacggggtttccggggaaccgggggtaacgtaacggtccggtaaccggttcggacggttccgacgtaccgtaacggcccgttaccggcccccgttaggtcccttacgttaccgttccgttacccccg

SEQ ID NO: 7302 - DNA, 850 bp, Homo sapiens
  misc_feature: GYAE6OF02JEMNE.23.71.G05.1.454.CMB.1.raw
  modified_base (243)..(243): a, c, t, g, unknown or other
  misc_feature (243)..(243): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcgaggacacgagggtcctgggcccagtctcgccctgactcagcctgcctcgtgtctcggtctccgtggacagtcgatccgaccgtctccgtgacgtactacggaacccgtnaggtcgtagttcggttacgggttaacttttaagtacgttcggttacctcggttacggttaacctaacgttacccctaccgaaggaccgtaaaaccgtaccccctaaaactcctaattaaccgttttagtacggtaaccgggtacctaacgtaaccggtccggtcccgttacgggttaacggggttttacctaacggttccggttaccgttcgttccgtacggtaccttccgtaaacggttcgtaccggaccgtaaccgtaccgggtccccttcccgtaacgtacccttacggtccgttccgtaccgggtccctaccgacggtaccccgtacggtaaccggtaccggtacggtacttaggttaaacgttttacgtttaacttcgtaaccgttcgtaccttacgtacgttacgtacgtaaccgtaagttaacgttaaggtacgtttacggtttacgggtacggggttaccgggtaacggggaaccgtttaacgggtccggtaaccggtttacgggtaaccggttaccggacggttaacccggtacggtaccggttccccggtaccccggttacgtacccgtacgtttacccggtcccggttacccccgg

SEQ ID NO: 7303 - DNA, 864 bp, Homo sapiens
  misc_feature: GYAE6OF02ILIC5.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctcgtgctgctcctcactctcctcactcaggacacgagggtcctgggccccagtctgccctgactcagcctgcctcgtgtcgtggtctcctgggacagtcgatcaccgtctcctgctctcggaacccgctagtgtattcggttggtaactttaatagttggttctcggtacggtaacctaactacccgtcccgacggtaaccaaaaccggtacccccctaaaagtcctaacgtttacgtttagtagggtaacggcctaacgtaacggcccggtacccgttacggttaacggggttttaccgttacggttacccgttactttccgttacggttcggtacccttacccgtaacggttccggtacggtaacccgaacggtacccggaccctccccgtaaccggtaccctaccgttaccttcccgtaccggtcccgtaccgtaccggtcccgaaccggtaaccggacggtacggtacttacggttaacgttttagtttacggttccggttactcgttaacctagtacgttacgtacggattaagggtaacttttacgggttaacgttttacggtttccgggttaacggggggttacccggggtaaccggggggttacgttaaaccgggttccggggttaacccggggtttcggttaacgggtcccggtaaccgggtaccccggtaaccgttacccggttccccccggtcccggttaccgttaacccggttacctttccccgggttaccccgtttaccccccggg

SEQ ID NO: 7304 - DNA, 883 bp, Homo sapiens
  misc_feature: GYAE6OF02H1JHU.23.71.G05.1.454.CMB.1.raw
  modified_base (115)..(115): a, c, t, g, unknown or other
  misc_feature (115)..(115): n is a, c, g, or t
  modified_base (137)..(137): a, c, t, g, unknown or other
  misc_feature (137)..(137): n is a, c, g, or t
  modified_base (194)..(194): a, c, t, g, unknown or other
  misc_feature (194)..(194): n is a, c, g, or t
tcagacgcgagtatcacgaccggtgctcgatttagtgtcgtcgcaagagagaggggggggtcacaagaggcagcgctctcgggacgtctccaccatcggccgcggctcgctgtcncctcctactctcctccactacncggacgacgacggtcggttcggccggaccgtacgttcgtccgtcgtcgtaccgtacnccgtcgtcgtccgtcgtcgtcggtcgtctcggacgacgtacgtacgactaccgactccgtacgtcgacgtacggaaccgaccgacgtacggtcgttaggttacggtacgttttaacgtttacgtcggtcgttccggttacgtaacggtaaccctaaccgtacccgtaacggaaccggaaacctaaacccccgtaacccgtaaactaacgtaaaccgtttttacgttacggggtaacgggtacgtaaccggtaaacgtaccggaccgttaccccggttaaggggttttacggttcggtaccgttacgtccgttcggtacgtccggttacacggtacgttcggacgaaaccgtaccggtccgtacctactccgaacttaccgtcgtaccggtccgtacgacccgtcggaccgtaaccggaacggtacgtacgtaacgttacgttaactttaacgtcgttacgtacggttacttacgttaacgttacgtacgtacggttaaacgtacttaacgttacgtttacggtttaacgggttacgggttacgggggtaccgggtaaacggggtaacggttacggtaccgggttaaccggtaacgggtaacggtacccgtaaccgggtccggtaccggttacccggtacccggttaccggtccggtacccgttacgttccccggttaccggttaccccg

SEQ ID NO: 7305 - DNA, 683 bp, Homo sapiens
  misc_feature: GYAE6OF02FTF1A.23.71.G05.1.454.CMB.1.raw
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcacgtcggaacccgnagtgtatggttgggtactttaatagtcggtctcggtgtaccaactcctcccgaggacaaacgcccccaaactcatacttanggacggctacgaggccgcctcgtagggtttctacgtctcttcgtcgtcggtactaccgtagttcgtacggactaacgaccgtcccgtaccctacgacctactccttcgtcgggtccctaccgacgcccgtacggaccggtacggtacggtccttaagttacttagtttacgttcgcttcgcttacgtacgttagcgtacgtagtaagttaagttacgttacggtttagggtcgggttaccggggtacgggggtaaccgtaggggtaccggtaccggttacgggtaacggtaccgtaaccggtcccggtaacgtcccggtcccgtcccccggttaggttacccctccggttccttacccgttaccccccg

SEQ ID NO: 7306 - DNA, 830 bp, Homo sapiens
  misc_feature: GYAE6OF02H9VX8.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtcggaacccgnagtgatgttggtactttaatatggtctcgtagtaccaacgtacctcccaggtacaaacgccccaaactcacgttacttagtcggaggactaactaacggccgtaccgtacgtacggggtttcctacggtccgtacgttctctcggtcccgtaacctaaacggttccgttacggggaacctaaaaccggacccgggtccccttacccggtaccggtaaccccttaacgttcccgtttacggttcccgggtaccccgttacccgtaacccgggttacccctaacggggtaaaccggtaacccgggtaaacgggtccgttaaacggttaattttttaaccggttaaacgttttcgggacccttttacggggaacctttacccgtaaagttacggttcgaaccgtttaaggtaaacgtttacgggtttaaacgtttaccggttttacggggtaacggggtttcggggaacccgggggtaacgttaaccgggtaggttaacccggttacggtaacggggttaccaaccgggtaacccgtacgggtaccttaccccgtacccccgggttagtacccgtacccgttaccgtcccgttaacccccc

SEQ ID NO: 7307 - DNA, 709 bp, Homo sapiens
  misc_feature: GYAE6OF02H8V0R.23.71.G05.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (436)..(436): a, c, t, g, unknown or other
  misc_feature (436)..(436): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcacgtggaacccncagtgagtgttggtaacttttanatgtctcgtggtacctatacctccaggacaacgccccaaactctaatactttatggaggccacgtaacgccggacctcgtagggttctagtcgtcttctcgtcgcctcgagtctcggacacgaccgtcccctccgtcgacctagtcctccgtcggtcctccgacgtcctacggaccgaacggngtacttacgtattttaattagttcgtaccttggtccttactaacgtttacgtcgtaacgtaaggttaacgttaaacgtttacggttttaacggttttacgggttaccggggggttaccgggggaaccgggggtaaccgttaagggtccggggttaacccggttaccgggtacggtaacccgcggggtaaccccggtaaccggtcccgttccccggtaccccccggttacgttaacccggtaccgtttcccccgttaccgggtttacccccccg

SEQ ID NO: 7308 - DNA, 786 bp, Homo sapiens
  misc_feature: GYAE6OF02ILZGD.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctcgggcccagtctgccctgacctcagcctgcctcgtgtctgggtctccgtggacagtcgatcaccgtctcctgcactcggaaccncagtgagtggttaggtacttttaagtagtggtcgtcgtacggtaacctaacgtacctacccgaaggtacctaaaccggaccccctaaaacgttaccaacgtttaaccttttacggtaggtaacgggtacctaacggttaaacggccgggtaccctacgggttaacggggtttctaaccggttccgtcgtttacctcgttacggtccctaaccgtaacggttccgtaacggtacccgtaaacggtacccgttcccctacccgtaacgtacccgtaacttccgtcgtaccggtcccttccggaaccgtcccgtacggaaccgacggtagggtccttagttaaacgtttagtacgttcgaccgtcgtacgtactaagtcgacgtaccgaagttacgttagttaacgtttacggtcggttaaacgggtcggggaaccggggtaaccaaccgggttcggtaaccgggttagtaacgggtaccaacccggtaccgtaaggtccccggttaccggtcccggtacggttaccccacggtttcccgtaaccccgtttcccccgg

SEQ ID NO: 7309 - DNA, 688 bp, Homo sapiens
  misc_feature: GYAE6OF02IZ1YS.23.71.G05.1.454.CMB.1.raw
  modified_base (182)..(182): a, c, t, g, unknown or other
  misc_feature (182)..(182): n is a, c, g, or t
  modified_base (234)..(234): a, c, t, g, unknown or other
  misc_feature (234)..(234): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtntcgtgggtcctcctggacagtcgatcaccgtctcctgcacgtcggaacccgnaggtgtagttggttacggttaacttttaagtacgtggtcgtacgtacgtaacctaactacctaccgaagaaccaaaccgaccccaaactcaacttacttagacggacggactaacgtacgccgtacctacggtacggtttctacgtctcttcgtcgtcgcctacgtacgtcgtacggactaacgacgtcctcctacgtacctactctcgtcgcctcgacgtccgtagaaccgtacgacgtacgttacgtatttattacgttcgtctcgtactactatacgtacgtactaacgtaacgttaacgttacgtttacgtttacgggtacggggttacggggaaccggggtaaccgtaacgggttacggtaaccggttaggtaaccggtaccgtaccggaaccgtacggtccgtaccggtccccgttacggtaccgtacccgttccgtcccggttcccg

SEQ ID NO: 7310 - DNA, 653 bp, Homo sapiens
  misc_feature: GYAE6OF02FWFCT.23.71.G05.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (298)..(298): a, c, t, g, unknown or other
  misc_feature (298)..(298): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcactcggacccnagtgatgttggacttttaantggtctcgtgtaccaagtcctccaggcaacgcccccaaatcatacttangaggcactagcgcctggtacgggttctagtccgtcttactcgtcggctaccgtaagtctggacaaccgtccggtcccttaccgtacgaccctaagttcctacgtacgggtccctaccgacgtccctacggaaccggaccgtaggccttaggaactttaagttcgttacgtcgttacgtccttactaacgttacgtcgtacctaaggtacttaaggttacgttacgttttaggacgggttaccggggaccgggggtaactacggggttccggaccggttcgttaagggtacccggtacgtacccgtaaggtccttcccggacccccgttgccgtaaccgttcgtacccgttccccg

SEQ ID NO: 7311 - DNA, 713 bp, Homo sapiens
  misc_feature: GYAE6OF02HU7M1.23.71.G05.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctcgtgtcgtgggtctcctggacagtcgatcaccgtctctgcactcggaccncagtgagttggttggtacttttaanagttggtctcgtgtaccaactacctccgagaccaaccgacccccaaactctaattactttagtcggacggtacctaaccgtaacggcccggtcccgttacggtacggggttttctaggtccgtctttccgtcgttcgccttaccgtaagtcgtacgggaaccaaccgacccggtccctaccctcgaccctcgttcctccgtcggccctccgacgtccgtacgacgacggcgtcgtagtattttacttagttcgtctacgtcctatacttatcgtacgtagtaacgttacgttacgtttaccggtttagggtaaccgggggttacggggaccgggggtaacgtacgggttccgtaccgggtttaacggtcggtaccgtaccggtaaccgttaccggtcccgttacccggtcccccggttacggttacccgtacccgtttcccggttaccgttcccccccgg

SEQ ID NO: 7312 - DNA, 828 bp, Homo sapiens
  misc_feature: GYAE6OF02GEIEY.23.71.G05.1.454.CMB.1.raw
  modified_base (119)..(119): a, c, t, g, unknown or other
  misc_feature (119)..(119): n is a, c, g, or t
  modified_base (234)..(234): a, c, t, g, unknown or other
  misc_feature (234)..(234): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctnactctcctcactcaggacacgagggtcctgggcccagtctgccctgactcagcctgcctccgtgtctgggtctccgtggacagtcgatccaccgtctcctgccacgtggaacccnagtgtacttggttaggttaacttttaatagtcggttcttcggtacggttaaccaaacttacccgtcccgaaggtaccaaaccgaccccctaaaactcctaattacttttagagggtaacgggacctaaccggtaacggcccgggtacccttacgggtacggggttttactacggtaccgttcttccgtacgtcggtccttacgtacgtccgtaggacctaaccgccgtccctacccgtcgaccctattccgtcgtccggccctaccgtacgtccgtacggaaccggacgtaggcgttacgttaatttagttaacgttcggtacttcgtcctttaagaatttacgtacgtaacctaggttaaacgtttaagggttttacggtttaacggtttacggggtaacgggggtttaccggggaaccggggggtaaaccgtagggggtttaccggtaacccggggtttccgggttaaacggggttacccgtaaacccggggtaaccccgtaaccggggtttcccgttacccccggggtcccccggttttaacggttccccgttaacccggtttccccggttttacccccgttaccccccgg

SEQ ID NO: 7313 - DNA, 762 bp, Homo sapiens
  misc_feature: GYAE6OF02G5Q6G.23.71.G05.1.454.CMB.1.raw
  modified_base (202)..(202): a, c, t, g, unknown or other
  misc_feature (202)..(202): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacgagggtcctgggcccagtctgccctgactcagcctgcctccgtgtcctgggtctcctggacngtcgatccaccgtctcctgccacgtcggaacccgctaggtgagttggttacgggtaacttttaatagttgtctcgtcgtaccaactcctaccgaggacctaaacgaccccctaaactctaacttacttagtggacggacacgtaacgccgtcctacgtacgggttctagtcgtcttcgtcgtacgtctaccgtaacggttcgtacggtaccaacgtaccgtcccgtacccgtcgtaaccctacgttaccttcggtcccgtacccgttacccgacgttacccgacggtaaccggaccgtacggacgtttacgttaatttacgtttacgttcggttaccgttacgtaccttattaacgttcgtaacggtaacgtaaggttacgttaagggtttacgttaacgtttggggtaacggggttcccgggggtacggggtaaccggttagggttccggtaaccggttcgggttaaaccgggtaccgacccggtaacccggtaccggtaccggtaccccgttccccggttaccggtccgtacccgttttcgtacccccgtttaccccg

SEQ ID NO: 7314 - DNA, 858 bp, Homo sapiens
  misc_feature: GYAE6OF02GTD0I.23.71.G05.1.454.CMB.1.raw
  modified_base (248)..(248): a, c, t, g, unknown or other
  misc_feature (248)..(248): n is a, c, g, or t
tcagacgcgagtatcacgaccggtgctcgatttagtgtcgtcgcaagagagaggggggggtcacaagagcagcgctctcgggacgtctccaccatggcctgggctctgctgctcctcactctcctcactcaggacacgtagggtcctgggcccaggtcctgccctgactcagcctgcccttcgtgtcgtgggtctccgtggaccagtcgactccgaccgtccttccgtgcctacgtacgggaaccccnagtacgagttcggtttagggtaacctttttaagtattcggtcttacggttacggtaacctaaacttacccgtaccccgaacgggaccaaaaccgaccccccaaaaccttactaacgtttacttttaacgttagggaacgggaccttaaacgtaaaccggttccggtaccccgttacggttaacggggtttttccgttaaacggttccggtaccttttccggttccggttacgggtaccgttacccgtaaacggttccgttaccgggaacccgaaacccgtacccgggtacccctttaccccgtacggtaaccctaacgttcccgtaccgttaccgggtaccctcccgtacgtaccccgttacggaaccgtaaccgggacgtaccgtacgttaactttagtttaacgtttcgacgttagtccgttatagtttacgacgtacgagttaacttaagggttaacgtttaaccggttttggggaaacgggtttacccgggggaacgggttaacccggtaagggttacggtaaccggttcggttacggtaccggaccgtaaccggtaacggccgtcccgtaccccgttcggtaccgtccttccgtacccgttcccc

SEQ ID NO: 7315 - DNA, 837 bp, Homo sapiens
  misc_feature: GYAE6OF02GPP70.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccgtctcctgcacgtcggaacccnagtgattggttggtaacttttaatagttcggtccttcggtcggtaaccaacttaccctccctaggaccaaaacgccccccaaaacttccaacttactttagtcggaacgggtaccaaccgtaaacgggtccggtaccccttacggtaacgggggtttttacctaacggttccgtccttttccgttccgttacgggtccttacccgtaaacggttccgtacgggaaccctaaacggacccgggtccccttcccgtacgaccctagttccctcgtcggacccctccgacgtcccgtacgggaaccgtacgacgggtccttaggtaactttacttaacggttcgtaccgttcgtaccgttataacgtttatcggaccgttaaaggtaccttttaaagggttcgtttaaccgggttttgggtaaccgggggtttcccgggggaaacgggggggtaacccgttaaggggttcccggtaaccgggtttacggggttaacggtaaccggtaacccgggtaccccggtaacgggtccccggtttaccccgggtaccccccggtttgggttacccctaaccggttttcccggttacccggtttacccccccccg

SEQ ID NO: 7316 - DNA, 742 bp, Homo sapiens
  misc_feature: GYAE6OF02G51M1.23.71.G05.1.454.CMB.1.raw
  modified_base (235)..(235): a, c, t, g, unknown or other
  misc_feature (235)..(235): n is a, c, g, or t
  modified_base (526)..(526): a, c, t, g, unknown or other
  misc_feature (526)..(526): n is a, c, g, or t
  modified_base (538)..(538): a, c, t, g, unknown or other
  misc_feature (538)..(538): n is a, c, g, or t
  modified_base (546)..(546): a, c, t, g, unknown or other
  misc_feature (546)..(546): n is a, c, g, or t
tcagacgcgagtatcacgaccggtgctcgatttagtgtcgtcgcaagagagaggggggggtcacaagaggcagcgctctcgggacgtctccaccagtggcctggctctgctgctcctcactctcctcactcaggacacgtggtcctgggccagtctcgccctgactcagcctgcctcgtgtctgggtctaccgtgacagtcgactcgacctctcctgactacgtcggaacccgtnaagtggtatggttacgggtaacttttaaagtcgttcggttctcggttacgaacctaacgtcctaccgagacaaaccgcccctaaagtctaacttactttagcgtaggccaacgtaaggtcccggcctagtacgggttactcgtcgtccgttcgtctacggtcctacgtacggtctacgggaccctaacgtccggtccctaccggttgaaaccctcgtccgtaccggtcggcccctacggtaccgtacgtaccggtcgaacgtcgggtactacgtagtttttaacgcggttnttccggacgttntaaccgtnttaaccggtgacctaaggtattttacgggaaattttccggttagggaacccggggtcgggtaaccgggggaatttaaccgggtcggggtaaccctttcggggttaacgtaacccggggacctaaccggggaacctttccgggaccccctacccggggtttcgtaacccgttcttcccgggttaccgtacccccccg

SEQ ID NO: 7317 - DNA, 794 bp, Homo sapiens
  misc_feature: GYAE6OF02GJZCF.23.71.G05.1.454.CMB.1.raw
  modified_base (270)..(270): a, c, t, g, unknown or other
  misc_feature (270)..(270): n is a, c, g, or t
  modified_base (618)..(618): a, c, t, g, unknown or other
  misc_feature (618)..(618): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacacgggtcctgggcccagtctcgccctgactcagcctgcctccgtgtcgtcggtcctccgtggacagtcgatccgaccgtctcctgcctacgtcggaacccgctagtgagttggttacggtaactttttaanaggttggttccttacggtacggtaaacctaacttacccaccggaacggtaaccaaacccgaaccccccgtaaaactccgtaaactttacgtttaacgtaggaacggtacctaaacggtaaccggtcccggtaccgtacgggttaacgggttttccgtaacggttccgtctttcgtaccgttggtacccttaccgtaagttcgtccggaacctaaccgccggtaccctacccgtacgaccctccttcctaccgtccgtccctaccgtacctaccgtacggaaaccggtacggacgttaccgtatttactttaacttgttcgtacgttcgtacctaacgtacttacggtnaaccttaaagggacttttaaggttaacgtttcggtttacgggaacgggtaccgggggtaaccggtaacgtacgggtaccgttacggttacggtacggtaccgtacgtaaccccggcggttcccgtacccggtttccccggctttacccgacccgtttcccgttacccgttaccccg

SEQ ID NO: 7318 - DNA, 739 bp, Homo sapiens
  misc_feature: GYAE6OF02JIPG0.23.71.G05.1.454.CMB.1.raw
  modified_base (176)..(176): a, c, t, g, unknown or other
  misc_feature (176)..(176): n is a, c, g, or t
  modified_base (234)..(234): a, c, t, g, unknown or other
  misc_feature (234)..(234): n is a, c, g, or t
  modified_base (325)..(325): a, c, t, g, unknown or other
  misc_feature (325)..(325): n is a, c, g, or t
  modified_base (386)..(386): a, c, t, g, unknown or other
  misc_feature (386)..(386): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtcctgcccctgactcagcctncctccgtgtctgggtctcctggcagtcgatccaccgtctcctgccactcgggaacccngtagtgtattggttaggtacttttaaatgtggtcctcggtcgtacctaactcccgtccgagaccaaacgacccccaaagtctattacttangaggcaactacgcgtccttgacgggtttcagtcgtcttacgtctcggcctacaacggttcnggaacctaaccgacccgggtccttacccgacgtaccctaacttcccgttccgtacggtcccgtaccgtacgtacccgttaccggtaacggtaaccggtacggtacgttacggtttaacttttaacgtttacggttaacgtccgttacggttcctaacgttactaacgttcgtaccgtagttaacgtacggtttaacgttacggttttacgggtaccggggtttcggggaaaccgggggtaacctaagggttacggtaccccggttaggtaacgggtaacgaccggtaaccgtaggtaccccgttacgtccccggtacggttaccgttaacgttcccgttacccgttacccccg

SEQ ID NO: 7319 - DNA, 826 bp, Homo sapiens
  misc_feature: GYAE6OF02J1MYA.23.71.G05.1.454.CMB.1.raw
  modified_base (159)..(159): a, c, t, g, unknown or other
  misc_feature (159)..(159): n is a, c, g, or t
  modified_base (432)..(432): a, c, t, g, unknown or other
  misc_feature (432)..(432): n is a, c, g, or t
  modified_base (621)..(621): a, c, t, g, unknown or other
  misc_feature (621)..(621): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcacggacacgacgggtccgtcgggcccngtctcgccctagactcgcgcctcgtccctcgtcgtccgtcgggttacctccgtaggacgtacggtcgaactccgccgtcgtcctcgaccgtacggacggacccgcgtagtacgtagttacggttacggttaactttagtcgtacgtcgtcggtaactaccaacttacccgacggacgaaccctaaacccgtaccctaactacgtttaacttaacggtttacacggggttacgaacctaacggtaccggtccggtccgttagggtcggttaccncgggtaccttctacgtcggtcgtacccgttacgacggttacacccggaacgtaacccggtcctaaccgtttcccgtaaatacccgttcctcggttcccggtacgtaccgtacgaccgtacggtaccgaacggtacgttcgacgttacttaacgttggtactcgttactaccgtatacgtacgttaccgnttaaacgttacggttacgttacggtaaggtttacgggtaccgggtaacggggttacggggtaccgggtaaccgtacggggttacccgtacggtttaaccgggacggttaacccggtacggtaacccggtacccgtttacccggtacccgggttaccctccggtttaaacccgggttcccctttacccggttcccttaacccccgg

SEQ ID NO: 7320 - DNA, 628 bp, Homo sapiens
  misc_feature: GYAE6OF02GROEA.23.71.G05.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatgttggacttttantggtctcgtggtaccatcctccagcaacgccccaaatcatacttagngacggcactagccgacctgtacgggtttctagtcgtcttctcncgtctccagttcgtgggacaacgtccggccctaccgtagacccagttccgtcgttccggccctccgacgtccgtaggaccgaacgtggtcctaggtaacttactttagttacgtctcgtactactatacgttcgacgttagtacgttaagttacgttacgttttgggtaacgggtttccggggaacggggtaaccgtaggtacggtccgttacgggtaggtaccacggaacccgtacggtaccgtacccgtccccggtcgtaccctacggtttcctcccggttaccccc

SEQ ID NO: 7321 - DNA, 699 bp, Homo sapiens
  misc_feature: GYAE6OF02FXXR4.23.71.G05.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (519)..(519): a, c, t, g, unknown or other
  misc_feature (519)..(519): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacnggtcgatcaccgtctcctgcactggaacccnagtgattggttggtacttttaatagtggtctgtgtaccaactacctccaggacaaacgccccctaaatctaacttacttagtggacggacctacgtaacggccggtacccttcggtacgggttttacctacgtccgtcctttcgtccgtcggtccttaccgtaagttccgtacggaccgaaaccgtaccgggtcccctacccgtacggtaccctaattcccgtacgtccggaccttcccgaacggtcctacggaacggacggtagacttaggtaattacgttagttcncgttacgtactacgtattagacgatacggtaattaggttaacgttacgtttagggacggggtttacgggaaccgggggtactacgggtcggtacccgggtaggttaacgtccggaacgacccggtaacggtaccgtcccgtacccggttcggtacctaccgtttcgtaccccgttccccg

SEQ ID NO: 7322 - DNA, 679 bp, Homo sapiens
  misc_feature: GYAE6OF02HKZ60.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatccaccgtctcctgcacgtcggaacccgngagtgattggttggtaacttttaagtgtggtctcgtacggtaaccaactacctccgagacaaaccgaccccctaaactcgaacttaactttagacggtagtacgactaacgtaacgccggtacccttacggtagggtttcgtacgtccgtcttcgtcgtcgctacctaacgtcgtgaccgaacaccggtcctccctacgaccctatcctcgtcgaccctctacgtcctacgacgtacgacgtgtaacgtattacgttagtttcgattcgacgtacattacgtagtacgtaagtagttacgttaagttcgtttagggtacgggttaccggggacggggtaaccgtagggttaccggtaaccgggttcggttaacggtcgtaaccggacccggtaaggtcccgtacccgggtacccccgtacgggttacctccggttacccgttacccg

SEQ ID NO: 7323 - DNA, 991 bp, Homo sapiens
  misc_feature: GYAE6OF02JKH1F.23.71.G05.1.454.CMB.1.raw
  modified_base (203)..(203): a, c, t, g, unknown or other
  misc_feature (203)..(203): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctcgccctgactcagccctgccctccgtgtcgtcggtctccgtgacncgtacgatccaccgtctcctgacctctacgggaccccgcaggtcgatttgggttagggttaaccttttaatagttcggtccttcgtacggtaacctaacgttacccctaccccgacggaacaaacccgacccccctaaacttccaactttccgttaaagttcgaacgggggtacctaccgggtttaaaaccgtccgggtaccccggttaccgtaagggggggtttttaccctaacgggtttcccggtcccgtttcccggttaccgttccggggacccttaccccgtaaagggttccccttagggggaaccccctaaaacgtacccggggtacccccttacccccgttaaacgggtaaccccccttacgtcccgtttcccgttaccggggtaccccgttaccccgtaaccgggtccccgtttaaccggaacccgggtaacccgggtaaccgggtaccgtttacgggtaaaccttttaaggttttaccttttacggtacccgttcgggttaccttaccgtactttaacgtacggtaaccgtaacggttaaaggtttaacgttaacgggtttaccggtttttaacggggttacgggggttttacccggggtaaccgggggggttaacccgtaaacgggggttaccgggttacccggttaccgggttaaccgggttcccgggtaacccgggtaaccggttaccccggtacgggttaccccccccggtttacccgggttccccggttaaccccggttacccgtttaccgggtttacccccgttaaccccccgg

SEQ ID NO: 7324 - DNA, 1002 bp, Homo sapiens
  misc_feature: GYAE6OF02FKCXK.23.71.G05.1.454.CMB.1.raw
  modified_base (256)..(256): a, c, t, g, unknown or other
  misc_feature (256)..(256): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgaccctgactcagcctcgcctccgtgtcgtgggtcctccgtaggactaggtcgactccaccggttccttccctagcctaaccgtccgggaaaccccgngtaacggtcggtaagtttcggggtttaacgggttaactttttaaacgttacggttcggtttaccgttaccgggttaaccggttaaacctaaaaccgtttaacccccgttaccccggtaacgggtaaccccgtaaaaacccggtaaccccccccttaaaaacggttacctaaaccgttttaaccgtttttaaacggacgggtaccggggtaaacctaaccgggtttaaaccggacccgggtacccccgtttacggggtttaacgggggttttaccgttaccgggtttaccgttacccgtttaccgttaccggttcggtacccttacccggtaacgttccgttacgggaaccctaacccggtacccggtaccccgtaccccgttaacgtaccccgtactttacccgttaccggtcccggtaccccgttaaccggtcccgtacccggtaaccgggtaaacccgggaaccggtaccgggtaaccgttaacggtttaaacgttaacgttttacgttacggtccgtttacggttaccttaacgtaaactttcggaacgttaccgaaaggtttacgtttaaccggtttaagttttacgggttaccgggttaacggggttcccggggacggggttaaccgttagggttacccgggtaccggtacgggttaccggtaccgaaccggtccggtaaccggttcccgtaccccggttcccgttaccgggtcctaccggttcccgttacccgtcccccg

SEQ ID NO: 7325 - DNA, 908 bp, Homo sapiens
  misc_feature: GYAE6OF02H8R6A.23.71.G05.1.454.CMB.1.raw
  modified_base (268)..(268): a, c, t, g, unknown or other
  misc_feature (268)..(268): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctcgccctgactcagcctgcctccgtgtcgtgggtctccgtggacagtcgatcaccgtctccgtgctacgtcggaaacccgcgagtgacttggttagggtaacttttaagtntcggttacgttcggtacgtaaccaacttaccctccgaagtaccaaaccgcccccgtaaaactctaactttaacgttagtacggaacgggacctaacgttaaaccggcccggtacccgtttacggttaacgggggtttactaacggttccgtaccgtttccgtcggttacggacccttacgtaacgtccgtcgggaacctaccggaacccgtcccttaccctaacgtaccgtacgttccgttaccggtcccggttacctacccggtaccgtaaccggtacggaaaccgggttaccggtagggttacttaaccgttaaggttttaacgttaccgtttagacccgttacgttaaccttactacgttaaacgtgggtaaacctttaaggttagtttaaacccgggtttaagttttaacgggggttttaaccgggaaccggggggtttacggggggaaccccggggttaacgggtttaaacgggttcccgggttaacccgggggtttaacgttcccggggtaaaacccttacccgggggtaaccccgggttaagttacccccgggtacccccgtttaccccggggtccggtttaaaccccgtttcgggtttaaccccccggttcccccggtttaacccccccggg

SEQ ID NO: 7326 - DNA, 810 bp, Homo sapiens
  misc_feature: GYAE6OF02GBENS.23.71.G05.1.454.CMB.1.raw
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
  modified_base (315)..(315): a, c, t, g, unknown or other
  misc_feature (315)..(315): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacgagggtcctgggcccagtctcgccctgactcacgcctgcctccgtgtcgtcgggtctcctggacagtcgatccacgtctcctgcncgtcggaccnacgtgatggttaggtactttanagtgtctggtcgtactaactacctcgagacaaaccgcccctaaactcaacttacttanggacggtcaacgtagccgtccgtagtcgggtttacctacgttcgtcttcgtacgtcgtaccgtacgtacgtcgtaccggacaacccgtaccggtcctacccgtagaccctacttccgccgttacggcccctacgtacccgtaccgttacgggacgaacggtacggtcgtaacggtttactttaacgtttacgttaaccgtcgttaacgttccgttacgtaaacgttcgtcggtaacttaacgaaccgttttaagggtttaaccgttttaaccgggtttcgggggttaacggggtttaccgggggtaaccgggggggttaaccgttaacggggttaccgggttacccggggttaaccggggttcgggttaaacccggtacccgggtaaacccgggttacccgggtacccgggtttaccccccgtcccccggggttaacccggttaccccggttaaccccgttttccccgggttaaccccggttttcccccccccgg

SEQ ID NO: 7327 - DNA, 732 bp, Homo sapiens
  misc_feature: GYAE6OF02GKSDO.23.71.G05.1.454.CMB.1.raw
  modified_base (199)..(199): a, c, t, g, unknown or other
  misc_feature (199)..(199): n is a, c, g, or t
  modified_base (331)..(331): a, c, t, g, unknown or other
  misc_feature (331)..(331): n is a, c, g, or t
  modified_base (528)..(528): a, c, t, g, unknown or other
  misc_feature (528)..(528): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcgaggacacgagggtcctgggcccagtctgccctgactcagcctgcctccgtgtctggtctcctgacngtcgactcgaccgtctccgtgactacgtcggaacccgctaaggtgaattcgggttaggtaacttttaatcgtggtcttcggtacgtacctaactcctaccgaggaccaaaccgcccctaatctattacttangacggactacgtacgcgtccgtcgtaaggttctacgtctctcgttgctacgtacgtaagtcgtacggactaacgcggtccctacctacggaaccctactaccgttccggtcgtacccgttaccgcgtccccgtaaggacccggtacgtacgtacgtacgttacttacgtttagttccgtcgtcgtcctaatacgttntacggatacgggttaatacggtttagtttacggttagggtaccggggtaccgggggtaacgggtaacccgggaggtttacccggtaccggttccggttaaccgggtaccgtaacccggtaaccggttacccgggtcccggtttaacccgccccggttttacccgggtactacccggttttacccggtaccccggttacccccgg

SEQ ID NO: 7328 - DNA, 747 bp, Homo sapiens
  misc_feature: GYAE6OF02FG7KF.23.71.G05.1.454.CMB.1.raw
  modified_base (232)..(232): a, c, t, g, unknown or other
  misc_feature (232)..(232): n is a, c, g, or t
  modified_base (324)..(324): a, c, t, g, unknown or other
  misc_feature (324)..(324): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacactagggtcctgggcccagtctgccctgactcagcctgcctcgtgtctgggtctccgtgacagtcgatcacccgtctcctgcactcggaacccgnaggtgagttgttagggtacttttaagtagtggtctggttcggtaaccaattacctccgagacaaacgcccccaaaagtccaattacgtttancggaaggtcacgtaacgcggtccctcggttaggggtttcaggtcgtcttctcgtggtcctccaagttccgtagactaaaccgccggtccttacccgtagtaacccgacttacgtccgttccggaccctttcgacgtccgtacggaaccgtacggaacggtcttagactttaagttacgttcgtaccgttagtcccgtacgtaacgttacgtggtaaccgtaagttaacgtttaaggtttacggttttaaccgtttaggggttaccgggtttaccgggggtaaccgggggtaaaccgttaacgggggttccgtaaacccgggttccggttaagggggttacccgaacggtaaccccgaaacgggttcccgaccgttccccccggttacggtcccgttacccttccggttccgtttaaccccccg

SEQ ID NO: 7329 - DNA, 763 bp, Homo sapiens
  misc_feature: GYAE6OF02GNGXB.23.71.G05.1.454.CMB.1.raw
  modified_base (233)..(233): a, c, t, g, unknown or other
  misc_feature (233)..(233): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcactcggaacccgnacgtgattggttacgggtaacttttaagtagttggtcctcggttacggtaccaaacgttacctaccgaaggacctaaaaccgaccccccgtaaaaattcctaaagttaccttttaaggacggtaacggggtcctaacggttaacggccggtacctacggtacgggggtttctaacgtcgtccttctacgtcggtctaccgagtcgtcgacgaacgccgtcctacctacgaccattccgtcgtcggtacctcccgacgtcgtacgaacgtacggcgtactagtactttaaagttgttacgacttcggtacctacgtaacgttgtacgtacgtaagttacgtttaaaggtttaacggttaaccggttttacggggttaaccgggtcggggggtaaacccggggtacgttaaacgggggtccgttaacccgggtagggttaaccggttaccggaaccggtacccgttaagggtccccgttacccggtcccccgttacgggtaccctaccggttaccgttcccgttaccccccg

SEQ ID NO: 7330 - DNA, 558 bp, Homo sapiens
  misc_feature: GYAE6OF02FT8P6.23.71.G05.1.454.CMB.1.raw
  modified_base (308)..(308): a, c, t, g, unknown or other
  misc_feature (308)..(308): n is a, c, g, or t
  modified_base (456)..(456): a, c, t, g, unknown or other
  misc_feature (456)..(456): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccgcagtgatggttgggtacttttaatatggtctcgtggtaccaatacctccaggcaaacgcccccaaatcatactttangaggcacgtaacgcggccctcgagggtttctagtcgacttctcgtcggctcaagtctggacaacaccggccctcccgtgacccatcctctcggccctcacgcctagacggacgagctagtattattattgacttgcctgatagcgtanagtatagttagttacttgggaggttcggacggggtacacggtgtaccgtggtagcgacgaccgacggccgtccgcccgtcgtaccaccgttcgccgttcccc

SEQ ID NO: 7331 - DNA, 646 bp, Homo sapiens
  misc_feature: GYAE6OF02G1489.23.71.G05.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccacgtctcctgcactggaaccncagtgatgtggtaactttanattgtctcgtggtacaactcctaccgaggccaaacgaccccctaacgtctaatactttacgtgagggacctacgtaacgtccggtaccctcggtacggggtttctaggtcgtcttactccgtggtcctaccgtagtctggacaaccgcgtccctccgtcgaacctatcctcgtacggtcctcccgacgtccgttaggaccggaacggtcggacgttacggtaactttagtttacgttgtaccgttcgtaccgtactattcgtgaacgtacgtacgtagttacggtttacgttagggttacggggtcgggtaacggggtaccgagggttacgaccggttcggtaaggcctacggccgaacgttccgccgtccgtcgtacctcgttcctcgttaccccg

SEQ ID NO: 7332 - DNA, 754 bp, Homo sapiens
  misc_feature: GYAE6OF02GFIYD.23.71.G05.1.454.CMB.1.raw
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (402)..(402): a, c, t, g, unknown or other
  misc_feature (402)..(402): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacaggtcctgggcccagtctgccctgactcagcctgcctccgtgtctggtctctgacngtcgatcacgtcctctncacgtcggaacccnagtcgatcggttaggtacttttaanacgttggtacctcggtaggtaaccaattacccgtcccgaaggaccaaaaccgtacccccctaaacgtctaattacgtttagacggtaacggactaaacgtacgtccggtccccgttaggttacgggttttacctacggttcctactttccncgttacggaccttaaccgaagttccgtacgacggtaaaccgcgtaccccttcccgtacaacccgttctcctttcgtccggtaccctaccgtaccggaccgtaccgtaacgacggtacgtaggttaccttaatttacgttcgttacgacgttacgtcctaaccgtattacacgtaacgtacgttaacgtaaggtttacgtttacggttacgggttacggggtacccggggtaacgggggaaccgtaacggttacggaacccggtttagggtaaccggaccgtacggaacccggtaccggtccgtaccggttccccgttacgtaccgtttccggttccttacccgttacccccg

SEQ ID NO: 7333 - DNA, 784 bp, Homo sapiens
  misc_feature: GYAE6OF02JQJC7.23.71.G05.1.454.CMB.1.raw
  modified_base (143)..(143): a, c, t, g, unknown or other
  misc_feature (143)..(143): n is a, c, g, or t
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
tcagacgcgagtatcacgaccggtgctcgatttagtgtcgtcgcaagagagagggggggggtcacgaagaggcagcgctctcgggacgtctccaccatggcctgggctctgctgctcctcactctcctcactcgaggaccacngggtcctcgggacccagtctggccctgacctcacgcctgccctcgtntcgtggtctcctaggacagtcgntccgacctcncctgctacgtcggaacccgtagtcagttggttagtaacttttaagtagtggtctcgtacgtaacctaactacccgtccgaggactaaaccgacccctaaactacgtacttacttagtggaccgactaaccgtaacgccggtcccgtacggttacggggtttactacggtccgttcttcgtccgttcggacctaccggtaacgttcgtacggtaacccaacggtcccggtccctacccgtacgacctaaccgttccttaccggtaccgtcccgttaccgtaccggtacccgttaacgggaacccgtaacggtacggacttacggttaacttaacgtttacggtacgtccgttacgtccctagtaaccgtagttaccgaacgtaacgtaacgtttaagttaaccggtttagggttaacggggtttaaccggggtaccggggttaaccggggacggtaccgggtaccgtacccggtagggttaccgaacggtcccggtaaaccggttccggcccgttcccgtaccccggttcgtaccctcccggttcccgttcctaccccccgg

SEQ ID NO: 7334 - DNA, 735 bp, Homo sapiens
  misc_feature: GYAE6OF02IOK22.23.71.G05.1.454.CMB.1.raw
  modified_base (238)..(238): a, c, t, g, unknown or other
  misc_feature (238)..(238): n is a, c, g, or t
  modified_base (265)..(265): a, c, t, g, unknown or other
  misc_feature (265)..(265): n is a, c, g, or t
tcagacgcgagtatcacgaccggtgctcgatttagtgtcgtcgcaagagagagggggggggtcacaagaggcagcgctctcgggacgtctccaccatggcctgggctctgctgcctcctcactctcctcactcgaaggacacagggtcctgggcccagtctgccctgactcagcctgcctccgtgtcgtgggtctccgtggaccagtcgactcaccgtctctgctacgtacggaaccncgagtgattggttcggtaacttttaanagtcggtactcggtacggtaaccctaaatccctacccgtaaggacctaaaaccggtccccccctaaaaagttctaacttaaccgttttaagacgggaacgggtaacctaacgtaacggccggtacccgttacggttaacggggtttactacggtaccgtacttcgtcgtacgtctactaagtcgtggacaacgtccggtcctacccgtagacctacgtacgtcgtcccgtaccgtaccgaccgtaccgacggaaccggaagtacggtacgttagttaaacgttacgtttacgtcggtactaggtacctacgtaagtcgtacgaacaggttaacgtcgtttaagacggttttacgggacgggttaccgggaacggggtaactacgggtaccggtacggttacgggtagtaccggacgttaccgaacggtcctacccggtaccgtcgtacctaccgtccgttccgtaacccc

SEQ ID NO: 7335 - DNA, 662 bp, Homo sapiens
  misc_feature: GYAE6OF02JO1RZ.23.71.G05.1.454.CMB.1.raw
  modified_base (456)..(456): a, c, t, g, unknown or other
  misc_feature (456)..(456): n is a, c, g, or t
tcagacgcgagtatcacgaccggtgctcgatttagtgtcgtcgcaagagagaggggggggtcgacaagaggcagcgctctcgggacgtctccaccatggcctgggctctgctgctcctcactctcctcactcaggacacagggtcctgggcccagtctgccctgactcacgcctgcctccgtgtctgggtctcctggacagtcgatccaccgtctcctgcacgtcggaacccgcagtgacgttggttcgggtaacttttatagtggtctcggttggtacctaactccctccgagacaaacgcccccaaactcacttacttatggtacggacactaacggccgtccctcgtagggtttcctaggtccttcttctcgtacggtcctaccgtaagttccgtacggacctaacgtaccggtccctcctacggaccctagtccttacgtcggcccttaccncggtcctcggaccgtaacggacggtcctaagtactttattacttacggccttagtctactactagtcgaaccgtagtaacgttagttacgttacgtttagggacgggttaccgggacggggtaacctagggtccgtacggtcgtaacggacgtagacccgtaggcctccggtaccccgtcgtaccgtaccttccgtaccctccccg

SEQ ID NO: 7336 - DNA, 794 bp, Homo sapiens
  misc_feature: GYAE6OF02GPQGP.23.71.G05.1.454.CMB.1.raw
  modified_base (228)..(228): a, c, t, g, unknown or other
  misc_feature (228)..(228): n is a, c, g, or t
  modified_base (627)..(627): a, c, t, g, unknown or other
  misc_feature (627)..(627): n is a, c, g, or t
  modified_base (772)..(772): a, c, t, g, unknown or other
  misc_feature (772)..(772): n is a, c, g, or t
tcagacgcgagtatcacgaccggtgctcgatttagtgtcgtcgcaagagagagggggggggtcacaagaggcagcgctctccgggacgtctccaccatcggcctgggctcgtgctgctcctcactctcctcactcaggacactgggtcctgggcccacgtctcggccctgacctgacgtcctcgccctccgtgtcgtggtcctcgtggacagtcgatcctaccgttcncctgcgtaccgtacggaacccagtacgtagaacttggttacggggttaacctttttaaaattacgttggttaccttacggttacggtaaacctaactaccccgtacccgtaaggaaccaaaaccggaccccctaaaactccgttaacgtaacttttaacgtggtaaccgggtactaaacggttaacggacccggtaacccgtaggttaacggggtttaccttacggtaccggtacttaccgtcggtacgtcctaccgtaagtcccgtaaggacctaacgaccgttcgtacccgttacgtaacctacgtacccttcgtaaccggtaccccttaaccggacgtttacccgaacgggtaaccgtaacgggaccgtacgttattaacgttaactttaccggtntaaccgttcgtaccttaacagttaaccgttgaccgtaagtaacggttacgtaacttaggttacgtaagggtcggtaacgggaacgtacggttacggaccgtaacgtggtaaccctacggtctaaccggtccgtccgtacccggtnacttcccgtgtacccttacccg

SEQ ID NO: 7337 - DNA, 692 bp, Homo sapiens
  misc_feature: GYAE6OF02I6KXX.23.71.G05.1.454.CMB.1.raw
  modified_base (236)..(236): a, c, t, g, unknown or other
  misc_feature (236)..(236): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtcgtgggtcctccgtggacagtcgatcgaccgtctccgtgcacgtcggaacccncaagtgattggttggtacttttaatgtgtctcgtacgtacctaactacccgtccgagacaaaccgacccctaaactactattaacgttagtagacgggtactacgtaacgccggtccctcggtacggggtttctaggtccgtaccttcgtcgtcggtcctacgtaacgttcgtacggacgaaacgaccgtccctacccgtacgtacctacgttcctcgtaccgtcctaccgacgtccgtacgaccggaggtacggtctacgtattacttacgttacncgtacncctatatcgtagccgtaagacgttacgttagttacggttaggtacggggtacgggaccggggtaacgtaacgggtaccgtaccgggtacggtaacggtcgtacggtacccgaaccggttccgtacccggtacccggttcggtaccctccggtttcccgtaccgttacccccgg

SEQ ID NO: 7338 - DNA, 839 bp, Homo sapiens
  misc_feature: GYAE6OF02I3Q1V.23.71.G05.1.454.CMB.1.raw
  modified_base (140)..(140): a, c, t, g, unknown or other
  misc_feature (140)..(140): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacngggtcctgggcccagtctcgccctgactcagcctgcctccgtgtcgtgggtcctccgtaggactagtccgatcctaccgtctccgtgtaccgaccgtaccggaacccgtcgaaggttcgtaagttcggtttacgggttaacttttaagtagttcggtactcggtacgtaaacctaactacccgtaccgaacggaccaaacccgaccccctaatacctaagttactttacgaggacggactaacgtacgcccgtaccgtacgtacgggtttacagttccgtcttacgtcgtcggtacctaccgagttcgacggtacaaccgtccgtcctccgtacgaccttctacgtcgtccgaccctacgtaccgtcctacggaccgtacgtcgtacgttacgtaagtttaccttaggttctacgttaccgtaccttacgtaataccgttacgaccgtaacgtaacgtttacggtttaacggtttacgggtttacggggttaaccgggggttacggggtaaaccccgggggaaacgtttacccggggtaccggggttaacccggttccggggttaaaccgggtaaccgttaaaacccccgggtccgggtttaaaacccgggtccccgggtttaacccccggtacccccgggtttacggtaaaccccgttttcccggttaccccgggtttaccccccgtttaacccccgg

SEQ ID NO: 7339 - DNA, 883 bp, Homo sapiens
  misc_feature: GYAE6OF02HY26T.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcagacacgagggtcctcgggccagtctcgcctgactcacgcctcgcctccgtcgtcgtgggtctccgtggacagtcgactccaccgtctcctgacctacgtacggaacccgcaggtgtagttggttacggttaacttttaagtgttcgggtaccttcgggtaccgtaaacccttaacgttaccccgtaccggtaacggaacccgaaaacccgtaacccccctaaaacgttacctaaacttttaaacgttttacggtaacggggtaccgggaacctaaccggtaaaccgggtccccgggtaccccgtttaacggggttacgggggttttaccctttaacggttcccgtttccgtttacgtccggttacggtcccttaccgttaaaccggtccggttacgggaaccctaaaccgtcccgggtccccttaccgtaacccgtaacttccgtcccgttccggacccggttacccttccgtaccgtacccgtacgggtaaacccggtacggtacgggtaccgttagttaactttacgttagtcgtacgtccgtacttacgtattaacgtcgtaacgtacgtacggttaacgttaacggtttacgggttacggggttaaccggggttaccggggggtaaccggggtaaccggtaggggtaccggtacggttacgggtacggttaccggacgtaccgggtaacggttcccgtacccggttacccgtccggttacccgtacgttccggttccgttacccgg

SEQ ID NO: 7340 - DNA, 842 bp, Homo sapiens
  misc_feature: GYAE6OF02JSCSG.23.71.G05.1.454.CMB.1.raw
  modified_base (247)..(247): a, c, t, g, unknown or other
  misc_feature (247)..(247): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctgccctgactcacgctgcctccgtgtctgggtcctccgtaggactaggtccgaatccgaccggttctccgtgtccacgtcgggaaacccntaggtgaagttcggttaggtaacctttttaaaagtcgttcggtccgttaccggtacggtaacctaacgttaccccgtcccgaacggtaccgaaaaccgtacccccgtaaactactaacgttacttacgttaggaacggtacctaacgaacggtccggtcctcgtacggggttttacaccggttcgtaccttcgtcgtcggtccgtaccgtaagtccggtacggaacctaaccggtccggtaccttcccgtacggtaacccttagtccgtaccgttcgggtaccccttaccgaccgtaccgtaacgggtaccggtaaccgggtacggttaccttaaggtaacttttacgttaacgttaccggtccgttcggtaccttcttaacgtacgttacgtaacgtaacggttaagtaacgtttaccgggttaacgttttaccgggtaacggggttaccggggtaaccggggtaccgtaacgggttaccgggttaccggttacggtacggtaaccggtaaccgtacccgggtaacgttcccggttaacccgttcccggttaccggtaacccgtccgttttacccggcccggtttaacccccgg

SEQ ID NO: 7341 - DNA, 802 bp, Homo sapiens
  misc_feature: GYAE6OF02H1S66.23.71.G05.1.454.CMB.1.raw
  modified_base (165)..(165): a, c, t, g, unknown or other
  misc_feature (165)..(165): n is a, c, g, or t
tcagacgcgagtatcacgaccggtgctcgatttagtgtcgtcgcaagagagagggggggggtcacaagaggcagcgctctcgggacgtctccaccatggcctgggctctgctgcctcctcacctctcctcactcgacggacacgacgggtcctgggcccagtccnggccctgactcacgtcctgcccttcgtgtcgtcggtactccgtcggtacagtcgatccgaccgtctcctggacctacgttacggaccccgtcgtagtacgtagttaggttcggttaacgtttttaataagttcggttccgttaccggtacggtaaccgtaactaccccgtcccgaaccgggtaaccaaaccgtacccccaaaaccttactaacttaaccgttttacgtacggtaacggtaccgtaacgttaaccggtcccggttaccgtaccggttaggggtttccgtaaccgtccggttaccgttcgttaccgtcggtacctaccgtaaagttccgtacggaacctaccgaccggcctttacccgcttaccgacgtacctcgtcgtcctcccgacgtccgacgacgacgggtacgtacgtagttacgtttaacgttgtacgtacttcgaccgttaccgtaacgttaccgtacgtacgtaagttaccggtagtttaccgttaggttaacgggtttacgggttaacggggtaccgggtacgtacggtaccggttaacggtcggtaacggtaccgaacggtaaccgaaccggtacttcccggtacccgtacgtcctaccgttccgtcccgttaccccgg

SEQ ID NO: 7342 - DNA, 659 bp, Homo sapiens
  misc_feature: GYAE6OF02JSLEE.23.71.G05.1.454.CMB.1.raw
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
  modified_base (306)..(306): a, c, t, g, unknown or other
  misc_feature (306)..(306): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactcagcctgcctccgtgtctggtctcctggacagtcgatccaccgtctcctgcactcggaacccnagtgattggttggtactttaanagtgtctgtcgtactactacctccgagacaaacgccccaatctatactttagngacggacaacgtacgccggtacctacgggttacggtttactacgtctacttcgtcgtcggtcctaccgtagtccgtagacctaacgtccgaccttccacgtaacctcgttacctcgtcggtaccctacgtacgtccctaggaccgtacgacgtcgtactaagttcttaagttcgacttcgcttagtactagtagcgtaagtagtaacgttacgttcgtttacgggtacgggttcgggaaccgggtacgtaacggttcggtaaccggttacggtacgtaccgacggtaccggtacggttcccgtcccggtacccgtaccggtacccgttacgttacccgtacccgttacccccg

SEQ ID NO: 7343 - DNA, 725 bp, Homo sapiens
  misc_feature: GYAE6OF02G2WPA.23.71.G05.1.454.CMB.1.raw
  modified_base (231)..(231): a, c, t, g, unknown or other
  misc_feature (231)..(231): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccgtctcctgcacgtcggaacccgnagtcgattggttgggtaacttttaagtatcggtctcggttaggtaaccaactaccctccaggaccaaacgcccccaaatcaagtactttagcggtacggctacgtacgccggccctaggtacgggtttcctagtccgcttcgtcgtgctactagtccgtgactaacgccgtacctccctagacctactccgtacgtcggtccctaccgacgtaccgtacggaccggtaaccggtacgtacgtacggttaacttaacgtttacggttacggttccttacggtaccttacggtatacgtacgtcgtaacgtaacgttacgttacggttaccgtttgggtaaccgggttcggggaccggggttaacgaacggggttaccggtaccggttaccgggttacggtaccggtaacggtaaccccgggtaacggtcccggtacccggttccccgggttacccgtacccggtttaacccgttccggttaccccgttacccccg

SEQ ID NO: 7344 - DNA, 759 bp, Homo sapiens
  misc_feature: GYAE6OF02IL726.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggacagtcgatccaccgtctcctgcactcggaacccgnagtgatggttaggtactttaatagttggtctcgtacggtacctaactaccctaccgaggaccaaacgacccccaaactctaacttactttagtacggtaagggacctaacgtaacggccggtacccgttacggtacggggttttactacggttccgtcgttttccgtcgttcggtaccctacgtaacgttcgtacggacaaccgtccggtacccctaccgtacgaccctactccgttaccgtcggtcccctcgaccggtccgtacggaacggacggtagtcgtacgtaagttactttacgttcgtagtccgtacttacgaatacgtcgtaccgtaagttacgttaggttaaccgttaggtttacgggttacggggttaccggggaccggggggttaacctaacggggtaccggttaacccgggtcggttaaacgggttacccggtaaccgacccggttaacggtcccggttacccggtcccccggttacggtaccctcccggtttacccgttccggttacccccccg

SEQ ID NO: 7345 - DNA, 851 bp, Homo sapiens
  misc_feature: GYAE6OF02F75D0.23.71.G05.1.454.CMB.1.raw
  modified_base (141)..(141): a, c, t, g, unknown or other
  misc_feature (141)..(141): n is a, c, g, or t
  modified_base (250)..(250): a, c, t, g, unknown or other
  misc_feature (250)..(250): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgnggtcctacgggcccagtctcgccctgactcagcctcgcctccgttgtcgttggtcctccgtggacagtcgatccgaccgttctcctggcctaccgtacggaaaccccgngtaaggttcgtagttcggttacgggttaacttttaaagttacgttcggtccgttcggttacggtaaaccctaaattaccccgttaccccgaaggggaaccctaaaaacccggtacccccccctaaaaacgtttcctaaacgtttaaccgtttttaacggaggggtaaccgggtacctaaaccggtttaaaaccgggcccggttaccccgttacggggttaacggggtttttaccttaccgggttccgttcctttacgtccgtacggtccctaacgtaacgttcgtaccggtaaccgaaacgccgggttaccccttacccgtcggtaaccctacgtttcccgtacggtcccgtacccgttacccgtaacggtccgtaccggtaaccggtaacggtaccgtacgttacgtaacgtttacgttaacgttcgtacgttccgtcttaactacgttacgtacgtacgtagtagttacgttaggttacgttcggtacgggttccgggaaacgggttacggtacggttacggtaccggtacggtaacggcgtaccgaccgtaacggtccgtaccggtcccgtcgtactccgttaccgtccgttaccccg

SEQ ID NO: 7346 - DNA, 577 bp, Homo sapiens
  misc_feature: GYAE6OF02F0H0L.23.71.G05.1.454.CMB.1.raw
  modified_base (230)..(230): a, c, t, g, unknown or other
  misc_feature (230)..(230): n is a, c, g, or t
  modified_base (305)..(305): a, c, t, g, unknown or other
  misc_feature (305)..(305): n is a, c, g, or t
  modified_base (443)..(443): a, c, t, g, unknown or other
  misc_feature (443)..(443): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactcggaacccnagtgatgttggtacttttaatatgtctcgtgtaccaatacctccaggaccaaacgcccccaaatcaattacttangacggcactaagcgtcctgtagggtttcagtcgcttctctgctacgaagtctcggcaacgcgcctacctgacctatcctcgtcgtccctacacgcctagaccgacggagtctgtattattattgcttgctacgattgngacagtatacgtagttacgttgggtacggtcgggacggggactagggtacgaccggttcggtacggtaccgtaccggaccgtaacggtccgtcccgtccccggttcggtcctaccgttccgtaccgttcccccg

SEQ ID NO: 7347 - DNA, 677 bp, Homo sapiens
  misc_feature: GYAE6OF02GL1MS.23.71.G05.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (293)..(293): a, c, t, g, unknown or other
  misc_feature (293)..(293): n is a, c, g, or t
  modified_base (436)..(436): a, c, t, g, unknown or other
  misc_feature (436)..(436): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacgacgggtcctgggccctagtctcgccctgactcagcctgcctccgtgtcgtggtctcgtgacagtcgatccacctctctncactcggacccnagtgtagttggttacggttacttttaagtcgttcggtctcgttacgtaacctaacttaccnccaggaccaaaccgtaccccctaaatctattaacttgacgggagctaacgacgccgtccgtaggtacggttctacgtctcttctgtacgtctacgagtcgacgacacccgctccctccgactacctctccgtccgtcgtcccnccgtacgtcgacggaccgtaggtacgtctagtttaacttagttcttacggcttacctacgtacgtaatcgtacgacgtaaagttacgttacggtttaagttccggttaagggtcggggggttaacccgggtagggtaacgttccgggtacgggtacggttaccggtacgacgtaaaccggcccgttacggtaccaccccgggttccctaacggttccctacggtacccgttcctacccccg

SEQ ID NO: 7348 - DNA, 740 bp, Homo sapiens
  misc_feature: GYAE6OF02HZCYK.23.71.G05.1.454.CMB.1.raw
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (246)..(246): a, c, t, g, unknown or other
  misc_feature (246)..(246): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcgaggaccacgacgggtcctcgggcccagtctcgccctgactcacnccngccctcgtgtctgggtctccgtggacagtcgatccaccgttctcctgccacgtacggaaacccgtnacggttgtacgttggttacgggttaactttttaaagtgttcggtacttcggttacgtaaacctaacgtacccttaccgaagggtaccaaaaccggaccccctaaaacttacaactttaactttacgacggaacggacctaacgtacggccgtcccgtagtcggggttactagtccgtaccttctcgtcggtcctacgtaacgttcgtacgtccgaaaacgtcccggtccctcctagacccgtatccgtaccgtcgccgtacctcgtaccgtcgaacggacggtagcgtacgttaacgtttatagttcgtctcgtccttaagtactgtacgccgtaagtacgtacgttaacgttacggttaggtacgggggtacgggtaccgggggaactaagggtaccggttaccggttacgggcggttaccgaccggaccgtaacggtcccgttcggaaccccccggttgtaccccgtacttcccggttaccgttaccccccg

SEQ ID NO: 7349 - DNA, 764 bp, Homo sapiens
  misc_feature: GYAE6OF02GX2RG.23.71.G05.1.454.CMB.1.raw
  modified_base (232)..(232): a, c, t, g, unknown or other
  misc_feature (232)..(232): n is a, c, g, or t
  modified_base (322)..(322): a, c, t, g, unknown or other
  misc_feature (322)..(322): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatccaccgtctcctgccacgtcggaacccnagtgattggtaggtacttttaatagtggtctcgtcgtaacctaactccctccgaggaccaaaccgccccctaaactctacttacgtttanacggacggcctaacgtaacgcccgtccctacggtacgggtttctacggttccgtcttaccgtcgtcggtacctaccgtaacgttcgacgggtacccaaacggtcccggtcccttaccccgtacgaaccctacgtccttcgtaccggtccctaccgtacgtcccgtacggaaccggacggtacggtacttacgtaacgttttaacgttacgttacgtcgttactccgttaactacttacgacgtacgtaaattacggttacgtttaacggtttacggtttcggggttaaccggggttccggggtaaacccgggggtaccggttaacgggtacccggttacgggttaccggttaaccggtaccggaaccggtacccggtaacggtcccgtacccgttccccggtaccgttaccgtaaccgttcccggttaccccgttcccccgg

SEQ ID NO: 7350 - DNA, 700 bp, Homo sapiens
  misc_feature: GYAE6OF02GAK5Z.23.71.G05.1.454.CMB.1.raw
  modified_base (490)..(490): a, c, t, g, unknown or other
  misc_feature (490)..(490): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacacgggtcctgggacccagtctcgccctgactcacgcctgcctccgtgtcttgggtcctccgtgacagtcgactcaccgtctctgctacgtcgacccgataggtgtagtggttacggtaacttttaagtagtcggtacgtcggttacggtaacctaaactcccgtaccgaggacctaaaccggcccccaaactctaacttacttagtacggtacggacctaacgtaacgccgtccgtacggtacggggtttctaaggtccgtaccttaccgtcgtcggtcctaaccgagttccgtagaccgaacgtccgtaccctccgtacggtactcgtacctcgtaccgtccctaccgtntcccgacggaccggtacggacgtctagttactagttacgttgtactcgtctactacgtacgctacggtatagtaccgttaggtttcgttacgggtacggttaccggggacgggtaactacggtccgtacggttaacgggcttaaccggacgtaccggaacgttccgtaccggtcccgttacggaccttacggttcctcccgggttacccc

SEQ ID NO: 7351 - DNA, 736 bp, Homo sapiens
  misc_feature: GYAE6OF02F4TKW.23.71.G05.1.454.CMB.1.raw
  modified_base (236)..(236): a, c, t, g, unknown or other
  misc_feature (236)..(236): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtcgtgggtcctccgtggacagtcgactcaccgtctcctgctactcggaacccgnacgtgatggttaggtacttttaatagtggttctcggtacggtacctaactacctccaggacaaaccgcccccaaactctattacttagtcggacggactacgtaacgccggtccctggtacgggtttctacgttcgtcttctcgtcggtactaccgtaagtcgtcggtaccaacgtccggtacctcccgtacgtaccctacgttcctcgtccgtcccttacgaccgtccgtacggaaccgacgggtacgtacgttacgttagtttacttcgttacgcttcgtacctacgtagttacgtcgtaacctaggttaacttaagggtttacgtttaacgggtttagggtaccggggttacccgggggaaccggggtaaccggttacgggtaccgttaacccggggttaggttaaccgggaccgaacccggtcccgtaagggttccccgtacccggttcccccggttaggttaccctcccggttaccgttaccccggttccccccg

SEQ ID NO: 7352 - DNA, 761 bp, Homo sapiens
  misc_feature: GYAE6OF02H6K2O.23.71.G05.1.454.CMB.1.raw
  modified_base (327)..(327): a, c, t, g, unknown or other
  misc_feature (327)..(327): n is a, c, g, or t
  modified_base (464)..(464): a, c, t, g, unknown or other
  misc_feature (464)..(464): n is a, c, g, or t
tcagacgcgagtatcacgaccggtgctcgattttagtgtcgtcgcaagagagaggggggggtcacaagaggcagcgctctcgggacgtctccaccatggcctgggctctgctgcctcctcactcctccgtcactacgaggacacgtacgggtcctcgggcccagtctcgccctagactcgacgtcctcgcccttccggtgtcgtcgggtacctccgtaggacgtacgtcggactccgtacccgttctcctcgccgtacgtaccggacccgtgagtagtacgttggttacggtaattttatagtcggtactcgtacgtacactacccngacgaccaacctacccgaatctacttacttagacggacgactaccgtacgccggtccgtaggttcggttaccgtacgtccgtacgttctcggtccgacttacaacggttcgacgtaccgaacgtcccgtccttaccncgaccttactctcggtccgccgtaccgacgtaccggacgaacgacgcgtcgttaagttacttacgttacgttcgtacgttctacgttacttatacgtacgtacacggttaagtacgtttaaccgtttaggttacgggttaccggggtacgggtaaccggggttacgggttaacggtaccggttaaccgggttacgggtaccggtaacccggtaccggtaacccggtaaccggtcccgttacccggtaccccggttacggttccccggtttaccgttccccgtacccgttccccccgg

SEQ ID NO: 7353 - DNA, 796 bp, Homo sapiens
  misc_feature: GYAE6OF02IF0S1.23.71.G05.1.454.CMB.1.raw
  modified_base (245)..(245): a, c, t, g, unknown or other
  misc_feature (245)..(245): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacgtagggtcctgggcccagtctcgcccgtgactcgagtcctgccctcgtgtcgtggtcctcgtggactggtcgactccgaccgtctccgtgcacgtacggacccgntagtgtagtcggttaggttactttaagtcgtggtccttcggtacgtaacctaacgtcccgtaccgaaggacctaaaccgaccccctaaagtctaactacgtttagacggaggactacgacggccgtcgtcgtaggttctacgtctacttcgtcgtcgacctacgtaggtccgtacgtaccaaccggtacccgtcccttaccgtaccgtaaccgtccgtttaccgtcccggtccggtacctaccccggtacgtacccggttacggaaacccgggtacgtaaccgggttcgttaacggttaattttaccggtttacttacggtccgttaaccgtaccgttgaacgtacggtactaccggtaacgttaaggtttaacggttggttttaccgggaaccgggtttacgggggtacccggggtaacgggttaaccgtaacggggttcccgtaaaccggttcgggtaacccggaccggttaccggaaccggtttacccgccggttaccccggtcccgttacggtacctttcccggttaccgtaccccggttaaccccg

SEQ ID NO: 7354 - DNA, 824 bp, Homo sapiens
  misc_feature: GYAE6OF02IS58G.23.71.G05.1.454.CMB.1.raw
  modified_base (221)..(221): a, c, t, g, unknown or other
  misc_feature (221)..(221): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctccgtgtcgtggtctccgtggacagtcgatcacccgtctccgtnccacgtcggaaccccgctagtgagttggttagggtaacttttaatagttcggtacgttcgtacggtaacctaacttacccgtccctaacggacgaaacccgtacccccctaaactacctaacgtttaaccgttttaacgtacggaacgggtaccttaaccggtaaccgggtacccgggtccccgttacgggttacggggtttaccgttacggttccgtacgttttccgtccgtccggtcctaccggtaacgtccggttcggaacctacccggtaacccggtcccgttaccccgtacgtaaccctacgttcccgttacgtaccggtcccctacccgtaaccggtccgtaaccggaaccggttaccggacggttcttacgttattttacgtttacgttcggtaccttcgtacctatactacgtcgaactaggttaataacggtttaaggtttacgtttagggttacgggggtccggggtaaccgggggtacgtaacggggttacggtaacccggttgggtaaccggtaccgaccggtaacccggtaccgtcccggttacccgccccggtttaccgaccttaccggttccgttccccggtccccgg

SEQ ID NO: 7355 - DNA, 870 bp, Homo sapiens
  misc_feature: GYAE6OF02HJRI8.23.71.G05.1.454.CMB.1.raw
  modified_base (248)..(248): a, c, t, g, unknown or other
  misc_feature (248)..(248): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtcctcgccctgactcacgcctgcctcgtgtcgtggtcctcctggacagtcgactcaccgtcctccgtcgaccgtaccgtacggaacccccgtnacggttcgtaggttggttacgggttaactttttaagtacgttcggttcgttaccggttacggttaaaccgtaaccttaacccccgttaccccaacgggaaccctaaaaccccggaccccccctaaaaaccgttacctaacgtttaaccttttacgtaacgggtaacgggcctaaaccggtaacggcccgtcccgtacggtttaacggggttttcctaacgttccggttccttacgttcccggtggttaccgttacccgtaacggttcccgttacgggtacccaaacccgtaccgggcccttaccccggtcccgtaacctaccgttccgtccgtaccggtcccttccgaccgtccgtacggaacggtccggaacggtcttaaccggttatttaacttacgttcggtaccgtcgttacctacgttactaggtttcgaacgtaagttcgttaaaagggtttcgtttaagtttcggggttaaccggggtccgggtacccgggggtaaagtaccggggtacgttacccgggttaggtacggtaaccggccgtaacccggtcggtaccccggtacccggttccccgggtacctttacccggtaccgtcccgggttaccctccccccgg

SEQ ID NO: 7356 - DNA, 761 bp, Homo sapiens
  misc_feature: GYAE6OF02JSD0C.23.71.G05.1.454.CMB.1.raw
  modified_base (207)..(207): a, c, t, g, unknown or other
  misc_feature (207)..(207): n is a, c, g, or t
  modified_base (255)..(255): a, c, t, g, unknown or other
  misc_feature (255)..(255): n is a, c, g, or t
tcagacgcgagtatcacgaccggtgctcgatttagtgtcgtcgcaagagagagggggggggtcacaagaggcagcgctctcgggacgtctccaccatggcctgggctctgctgctccctcacctctcctcactcaggacacagggttcctgggcccagtctgcccgtgactcacgcctcgcctccgtgtctcgggtctccgtggacngtcgatccgaccgtctcctgcgtacgtacgggaaaccccgcaggttgngttacggttagggttaacttttttaactaggttcggttccgttcggtacgggtaacctaaactaccccttacccgaaggaccaaaaccgccccctaaacttactaacttacttagaggacggcaacgttaacggccggtacccgtggttaagggtttcgtacgtccttcctttcgcggtcgtacctacgtaaccggtcgttaccgggacaacccgttaccggcccttccccgaacgacccttaacgtttccgtccgtcccggtacctcccgtacggtaccccgttaacggtacggaccggtacggtaccttagttaacgtttacgttacgttcgttacgtccgtacttacgtaccgtagttccgaacggttatacggttaacgttttagggttacggtttacgtacgggggtcgggttaaacggggactgggtacgtaccgtgtaacgtcgaaccgccggtagtccaccggttcccgacgttaacgtcctacggtccccttacccg

SEQ ID NO: 7357 - DNA, 770 bp, Homo sapiens
  misc_feature: GYAE6OF02JBMAL.23.71.G05.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcactcggaacccnagtgagtgtggtactttaantggtctcgtggtaccaataccctccgacggacaaaccgacccccaaactctacttaaccttttataggagggacctaactaacggcccggcccttacggtacggggttttcgttacgtccggtaccttcgtcgtaccggtctaccgtaagttccgtaggtaccccaacgtacccgggccctttccccgtcgtaaccctagttcccttaccgtacgggtacccctcccgtaacggccccttaggggacccgaaccgggagttacccgttaggttaactttacgtttaagttccggtactttccggtacttacctaactttgaccggtagaacgttaagtttacggttaaggttttcggtttacgggttaacgggggtttccggggtaccgggggggaacgttaaaccgggtgggttacccgttacgggttaccggttaacgacgggtaaccccgaacggtccgttaccccggaccccggtttccgtacccgtaccgtttccccgtacgtttacccccccg

SEQ ID NO: 7358 - DNA, 803 bp, Homo sapiens
  misc_feature: GYAE6OF02F04JC.23.71.G05.1.454.CMB.1.raw
  modified_base (181)..(181): a, c, t, g, unknown or other
  misc_feature (181)..(181): n is a, c, g, or t
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
  modified_base (548)..(548): a, c, t, g, unknown or other
  misc_feature (548)..(548): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtntcgtggtctccgtgacngtcgatccacgtctcctgcacgtggacccgnagtcgagttcggttggttaacttttaatattcggtcgttcggttcggtcgacccgtaaacttaccccgttacccgaacgaaccgtaaaacccgtacccccctaaaaccgtacctaacttaactttaagtacgggtaacgggtacccgaaataaaccgggcccggtccccgttaacggtacggggtttttccttaacgggtccgttcctttacctcggttcgggtaccttaccggtaaccgttacgttcgggacctaaccggtaccgtaccccgtcccgttaaccgaacccgtcttaccgttcggtcccgtcccttaccncggtcccgtcgaaccgtacgggaccggtgtacgttacgtttaacttttaagttccgttccgttagttcccgtagttaattccggtgtaccgaagtaaccgtttaaagtcccgtttaagtttggtacggggttaccggggacgggggtaaccgtacgggttaaccgtccgggttacgggttaccgacgggttaccgaacccggtacggttccgccccggtttaccccgtcggttaccctacggtacccttccccgg

SEQ ID NO: 7359 - DNA, 820 bp, Homo sapiens
  misc_feature: GYAE6OF02FFV1T.23.71.G05.1.454.CMB.1.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactacagcctcgcctccgtgtctgggtcctccgtagacagtcgaatcaccgtctccngcacgtcggaaccctnagtgatcgttaggtactttaatatggtctggtcgtaccaatacctccaaggtaccaaacgtacccccgaaaactccaacttaccgtttaagcggaacgggtaccaaacgtaacggcccgggtacccgtaccgtacgggggtttacctacggttaccgttccgttccgtttcctacggtcgttaacccgtaaagttccggtaacgggtaccgtaaaaccgtacccgggtacccgttaccccgtacggtaaccctaaccttccctaaccggttaccggtacccgtttcccggaaacgttcccctaaccgggtaaaccggtaaccggtaagggtaccctacgggttaaactttactttaaaggttcgtaccgttcgtaacgttactaacggttaccgtaaggtacgaaacgtttacgtaaacggttttagttaaacccggttacgggtaaccggggttacggggaacccgggggtaacgtaaccggggtacggtaaccggtcggttaaaccggtacgttacccggacccggtaaagccgttacccgccccgttaagggtccctacttccggtaccccggtacccc

SEQ ID NO: 7360 - DNA, 737 bp, Homo sapiens
  misc_feature: GYAE6OF02GGJMV.23.71.G05.1.454.CMB.1.raw
  modified_base (238)..(238): a, c, t, g, unknown or other
  misc_feature (238)..(238): n is a, c, g, or t
  modified_base (467)..(467): a, c, t, g, unknown or other
  misc_feature (467)..(467): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtcgtcgggtctccgtggacagtcgactcaccgtctctgctacgtacggaacccgngagtgtagtggttaggttactttaagtagtgtcgtcgtacgtacctaactacccgtccaggacctaaaccgaccccctaatctaacttacgttacgtagacggtaccaacgtaacggccgtacccgtacgggttaggggtttactacggttcctcgttcgtctcggtactaccgtaacgtcgtacggaccgaaaccggtcccggtaccccttacccgtacgaacccgtnttacccgttcgtcccgtacccaccgcgtccgtacgtacgggacgttacggtactacgttaactttagttaagcggtatcggtacctataacggtactcgtaacgtaagtaacgtttacggttaagttacggtttacggggtaccgggttccgggggaaagggtaccgtaacggtccgggttaccggtaggtacccggtacgaaccggtaaccggtacggtcccgtcccggtacccgtacgttccctacccggttcgtcccgttaaccccc

SEQ ID NO: 7361 - DNA, 830 bp, Homo sapiens
  misc_feature: GYAE6OF02IJUYJ.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctggggcccagtctcgccctgactcagcctgcctccgtgtcgtgggtcctcctggactagtcgatccaccgtctacctcgcctactacggaacccgcgtacggtgagttggttagggtaacttttaagtacgttcggtcttcggttacggtacctaaacgtaccctcccgaggtaccaaaaccgtaccccctaaactacctaactttacctttaaggtacggtaacgggacctaacgtaacggtccggacccttgtacggggtttctacgtacgtccgttctcgtcgtacctacgtagttcgcgtaacgtaaccggacccggtccttaccccgtagtaacccgtgttacccgtccgtacgggtcccttacccggtaccgaccgttacggaaccggtaccggtaaggtaccgtacgttaacgttttacgttacgttacggtccgtacgttacccgttagtaaccgttacgtacgggtacctaggttaaaccgttaagggtttaaccgtttacgggtttaaccggggtagggggtttaccggggaacccgggggtaaccgtaaccggggttacggttacccgggttaccgggtaacggtaccggtaccggtaccgggaccgttacccgggttcccgaccccgggttccggttaccctacccggttaccccttcccggttacccccgg

SEQ ID NO: 7362 - DNA, 761 bp, Homo sapiens
  misc_feature: GYAE6OF02HJ3KS.23.71.G05.1.454.CMB.1.raw
  modified_base (119)..(119): a, c, t, g, unknown or other
  misc_feature (119)..(119): n is a, c, g, or t
  modified_base (139)..(139): a, c, t, g, unknown or other
  misc_feature (139)..(139): n is a, c, g, or t
  modified_base (150)..(150): a, c, t, g, unknown or other
  misc_feature (150)..(150): n is a, c, g, or t
  modified_base (381)..(381): a, c, t, g, unknown or other
  misc_feature (381)..(381): n is a, c, g, or t
  modified_base (436)..(436): a, c, t, g, unknown or other
  misc_feature (436)..(436): n is a, c, g, or t
  modified_base (455)..(455): a, c, t, g, unknown or other
  misc_feature (455)..(455): n is a, c, g, or t
tcagacgcgagtatcacgaccggtgctcgatttagtgtcgtcgcaagagagaggggggggtcacaagaggcagcgctcctcgggacgtctccaccatggcctgggctctgctgcctccncactctcctcactcaggacncgagggttccncgggccctgtctcgaccctgtactcgacgtccctagccccttccgtcgttcgtaggtccttcccgtaggacctaggttccgaacgttaccgacccggttctccgtacgaccgtaccgtacggtaaccccgctaggtgtattggttacggttaattttaatagtcgttctcggttacggtaacctaacgtaccctccgaggtactaaaccgaccctaactcaattacgttangacggtatacctaacgccggccttacggtggtttcctacgtcgtactcgttacgngtcctctaacggtcgtacnccgaaacgtccgtacacctacgaccctatccggtccgaccgtccgccgtactaccggcaccggaacggtacgtaccgtgttaaacgtttacgttacgttaacgttctaccggttacctacgtaccgttacgtacggttaacctaacggtaagttaacggtttaacgttacggtttacgttacggggttaccgggacggggtttacccgtaaccggggttacgtaccggtacgttaccggtaccgttacggaccgtcgtaccggtcccgtaccccgacgttacgtcccgttaccggtacctaccccg

SEQ ID NO: 7363 - DNA, 832 bp, Homo sapiens
  misc_feature: GYAE6OF02GEBP8.23.71.G05.1.454.CMB.1.raw
  modified_base (193)..(193): a, c, t, g, unknown or other
  misc_feature (193)..(193): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctggcccagtctgccctgactcagcctgcctcgtgtcgtggtcctccnggacacgtcgactcgaccgtctcctgcctacgtacggaacccgcgtaggtcgacgttggttacggtaacttttaagtacgttggtccttcggtacggtaaacccgtaacttaccccgtcccgaacggtaaccgaaaccggtacccccctaaaactcctaactttaacgttaagttacgggacggtacctaacgtaaccggcccggtacccgttacggtaacgggtttccgttacggtccgttccgttaccgttcggtcggtacccgtcgtaaacgttccgttaacggtcccaaaaccggtccgtccccgtacccgtaacgacccgttaccgtccgtttaccgccgggtaccctacccggtacccgtaccggtacggtaacccggaccgggttacggtaccgttaacggttaacctttaaggtttacttcggaccgtttaccgtaccgttaaccgtacgttaggtacgttacgaaacggttacgttaaggtttaacggtttacggttacgggttaacgggttcccggggacggggtaaccggtacgggttaccgtacgggttacggtacggtaccgaaccggaccgtacgggtccctacccgtcccggtaccggtcctccggttccgttacccgtccccg

SEQ ID NO: 7364 - DNA, 656 bp, Homo sapiens
  misc_feature: GYAE6OF02GOSQP.23.71.G05.1.454.CMB.1.raw
  modified_base (229)..(229): a, c, t, g, unknown or other
  misc_feature (229)..(229): n is a, c, g, or t
  modified_base (322)..(322): a, c, t, g, unknown or other
  misc_feature (322)..(322): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgtgcccagtctgccctgactcagcctgcctcgtgtctgggtctcctggacagtcgatcaccgtctcctgcactcggaacccncaggtgattgttagggtacttttaatagttggtctcgtacggtaccaactaccctcccgaggaccaaacgacccccaactcattacttatagnggacacgtagccgcctagtgggttctgtcgtcttctctgcctacagtcgtgacaccgccggtccctccgtcgacctacgttcctcgtcggccctaccgacgtccgtacggaccgtacggacggtcttacgtatttagttacgttcgcttacgtctactagttagcgactaggtattaaggttacgtttacgtttaggacggggttccggggacgggggtaacctagggttccgaaccgggtttcggtacgggttaccaccgggtaacccgtaacgggtcccgtaccccggttacccccggccggtttacctaccccggttcgtttaccccccgg

SEQ ID NO: 7365 - DNA, 680 bp, Homo sapiens
  misc_feature: GYAE6OF02GQOY7.23.71.G05.1.454.CMB.1.raw
  modified_base (245)..(245): a, c, t, g, unknown or other
  misc_feature (245)..(245): n is a, c, g, or t
  modified_base (339)..(339): a, c, t, g, unknown or other
  misc_feature (339)..(339): n is a, c, g, or t
  modified_base (541)..(541): a, c, t, g, unknown or other
  misc_feature (541)..(541): n is a, c, g, or t
tcagacgcgagtatcacgaccggtgctcgatttagtgtcgtcgcaagagagagggggggggtcacaagaggtcagcgctctcgggacgtctccaccatggcctgggctctgctgctcctcactctcctacactcaggacaacgtgggtccgtgggcccagtctgccctgactcagctgcctccgtgtcgtggtcctccgtggactagtacgactcgacccgtctccgtgccacgtacgaacccgnagtgtattggtaggtaactttatacgtgtctaggtacgtacaactaccctaccgaggacctaaaccgcccctaaacgtctaacgttactttagnggaaccggactaaccggtacggtccgtccttgggtacgggtttcacgttccgactttccgacgtcggacctacgtagtccgaacgtaccaccggacgttccctccgagtacctactccgtccgaccgtccctagcccgtagtcggacggtacggtacgtgttacgtacttaagtttgactcgttcgtactaacgactttagngtaccgtaatacggtttacttagggtacgttacggcggggtaccggacgggtacgtacggttccgacggtacggtaccgtagacccggtacgtccggtccgtcccgtccgtagttcccgtacgttcccgacctccccgg

SEQ ID NO: 7366 - DNA, 684 bp, Homo sapiens
  misc_feature: GYAE6OF02HQMJ4.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccgaccgtctcctgcacgtcggaacccnagtgatggttggtaacttttaatatcggtcttgtacgtaactaactccgtccaggacaaaccgacccctaaatctaacttactttagtacggacggactaacgtaacggcccgtacccttacggtacgggtttctacgtccgtcttcgtcgtcgtcctaccaagttccgtacggacaacgaccgtccctaccgtacgacctacgtctacgccggtccctacccgtgacccgtcgaaccggtaacgtacggtcttacgtaaacttttacgtttaactcggtactacgttaccataagtacgcaacgtaagtacgttaagttacgtttacggttaggtacggggttcgggaaccgggtaacgtagtaccggtacggtacggtacggtccacggtaccgtaacggtcctacccggtaccccgtggtaaccctccggttacgttcccttacccccg

SEQ ID NO: 7367 - DNA, 711 bp, Homo sapiens
  misc_feature: GYAE6OF02JWO4Y.23.71.G05.1.454.CMB.1.raw
  modified_base (141)..(141): a, c, t, g, unknown or other
  misc_feature (141)..(141): n is a, c, g, or t
  modified_base (157)..(157): a, c, t, g, unknown or other
  misc_feature (157)..(157): n is a, c, g, or t
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
  modified_base (326)..(326): a, c, t, g, unknown or other
  misc_feature (326)..(326): n is a, c, g, or t
  modified_base (622)..(622): a, c, t, g, unknown or other
  misc_feature (622)..(622): n is a, c, g, or t
  modified_base (688)..(688): a, c, t, g, unknown or other
  misc_feature (688)..(688): n is a, c, g, or t
  modified_base (697)..(697): a, c, t, g, unknown or other
  misc_feature (697)..(697): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcgaggcacgngggtccgtcgggcccngtctcgccctgactcacgtccgtgacctcgtgtcgttacgggtctccgtaggacagtaccgactacctccgttctccgtgtccgtacgtcggaaccncgtaagtcgtgttggttagtacttttaagngtcgtcgtcgtacgactaactaccgcgagacaaccacccaanctactacgttagcgacgcacgtacggccgtaccgttggtacggttctacgtccgtaccttcgtcggttacgtactaccgtaacggttcctacggaaccgtaccgtaccggttccccaccttacggtaaccctgtccgttaccggtaccggtcccgtactaccggtccgaacggttaaccggaggtcgttacggtaaactttattaacgttcgtcgttacacgtacttactcaaacgtcgtacgaatttacgtaacgtacgtttaacgtttcgggaaccgggttacgggaaccgggnttaaccgggtacgtcggtaacggtaaggaccaacggtaccggtccctaagtccccggcttaccgtntttaacccnccggttccctaccg

SEQ ID NO: 7368 - DNA, 818 bp, Homo sapiens
  misc_feature: GYAE6OF02IP0LL.23.71.G05.1.454.CMB.1.raw
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
tcagacgcgagtatcacgaccggtgctcgatttagtgtcgtcgcaagagagagggggggggtcacaagaggcagcgctctcgggacgtctccaccatggcctggctctgctgctcctcactctcctcactcgaggacacagggtcctggccctagtcctgccctgactcacgccgtcgcctccgtgtcgtggtctcgtgacngtcgatcaccgtctccngctacgtcgaaccgcagtntacgtgggtttacggtaacttttaagtagttcggttctcggttagtaaccctaaaccgttaccctccgaacggaccaaacccgaccccctaaacttctaacttacgtttagtggacggactaacggtaccgccggtccttaggtcgggtttacacggttcgtccttcgtccgtgtcctacgtatccgacgaccaacgaccgtccctcgaccgacctcgtcgtccgtccgtacccgtccgaccgtaccgacggaccggtaaaccggtcggttcgttaacggttaactttttagtttaaccggttcgacccgtttaccgttaaccgtacgtacttaaaccggttccggtaacgtaaacggtttaaacgttttagggtttaaccggttttacgggttcgggggttaaccggggtttaaaccgggggggtacccgggttaaccggtaacggggttcccgtaccggggttaccgggttaaccggaacccgggtaagtcccgggttaccggtacccggttaacccccgggttccccggttacccggttaccctttaccccgtcccggttaccccgttacccccccg

SEQ ID NO: 7369 - DNA, 732 bp, Homo sapiens
  misc_feature: GYAE6OF02FI7ZG.23.71.G05.1.454.CMB.1.raw
  modified_base (246)..(246): a, c, t, g, unknown or other
  misc_feature (246)..(246): n is a, c, g, or t
  modified_base (581)..(581): a, c, t, g, unknown or other
  misc_feature (581)..(581): n is a, c, g, or t
  modified_base (589)..(589): a, c, t, g, unknown or other
  misc_feature (589)..(589): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggccccagtcctcgccctgactcagcctgccctccgtgtcgtgggtcctccgtggacagtcgactccaccgtcctccgtgactacgtcggaaccccgngagtgtagttggttacggtaacttttaagtagtcggttccgtcggttacggtaaacctaacttacccctacccgaggaaccgtaaaaccgacccccctaaaatcctaacttacttttagcggtaacggtactaaccgtaacgggcccgtaccccgtcggttaacgggggttttcctaggttaccccgttcgttccgtcgtcggtacctaccgtaacgttccgtaggaccaaccgtccggtaccctcccgtagaccctacttcgtaccgtccgccttaccgacgtccgacggaccgacggacgtacgtagtacttagttacgttgtactgtacctntattacgngtacgtaagttacgtagttaagttacgttagggtacgggttacgggacgggtaacacggttacgaccggtacggtacggtcgacggacccgtagtcccgtaccggtccctaccggtcctaccggttccctaccgttacccccg

SEQ ID NO: 7370 - DNA, 762 bp, Homo sapiens
  misc_feature: GYAE6OF02GNSX0.23.71.G05.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (457)..(457): a, c, t, g, unknown or other
  misc_feature (457)..(457): n is a, c, g, or t
  modified_base (727)..(727): a, c, t, g, unknown or other
  misc_feature (727)..(727): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcacggacacagggtcctgggcccagtctcgtccctgactcacgccgtcgcctccggtagtcgtcggtcctccgtcggacngtcgactccgaccgtctcctgcctaccgtcggaaccncgtagtcgtatggttaggtaactttaatacgtcggtctcggtacggtacctaaacgtcccgtccaacggactaaaccgacccctaaactctaattacttagacggacggactaacgtaacgccggtaccctggtacgggtttctagtcgacttcgtcgtcgacgtactagtccgtgaaccgacgtaccgcctaccgtacctaacccgtntacccgtcgtacggtacccacgtaccctccggtacgtaaccggaacggtcggacttagttaaacgtttacgttaggttaccgtacgtacttcgtaacgttatagttcgaacgttaaacgtaggtaacgtttaacggtttcgtttaacggggttacggggttaaccggggaaccggggtttaaacggaacggtttaccgggaccgggttaaccgttcgggtaaccgtacccgggtaacggtaccgtaccgttaccccggtaccggttaccnccggtttaacccgttcccggtaccgttaccccccg

SEQ ID NO: 7371 - DNA, 730 bp, Homo sapiens
  misc_feature: GYAE6OF02HRPFP.23.71.G05.1.454.CMB.1.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (332)..(332): a, c, t, g, unknown or other
  misc_feature (332)..(332): n is a, c, g, or t
  modified_base (446)..(446): a, c, t, g, unknown or other
  misc_feature (446)..(446): n is a, c, g, or t
tcagacgcgagtatcacgaccggtgctcgatttagtgtcgtcgcaagagagaggggggggggtcacaagaggcagcgctctcgggacgtctccaccatggcctgggctctgctgcctcctcactctcctcactcgaggacacgagggtcctgggccctagtctcgccctgactcagtcctgcctcgtggtctgggtcctcctgacagtcgatccaccgtcnctcgacacgtcgaaccgcagtnacgttggttaggtacttttaangtcgtcgtgtacgactaactaccctacgagtaccaaccgacccccaaactcgtaacttacgttacgnggaaggacctacgtaacggtcccggtaccttacggtacgggtttactacggtacttcttcgtacggtcgtcctacgtaacggtctacggactaacgtaccggtaccctccgtanaccctactcgtaccgtcgtacctcgtacgtaccgtacggaccgtaggacgtcgtagttattagttacgtcgtcgtacgttactaacctaagttcgacggtacaagtaagttacgtaagtttccgtttagggtaccgggtccgggggtaacgggtaaccggtaagggttcccggtaacgggttacggtaaggttacccgaaccgggttacccgtaagggtcccgtaaccccggttccccggtaccggttacccgtaccgttacccggttcccccgttaacccccg

SEQ ID NO: 7372 - DNA, 879 bp, Homo sapiens
  misc_feature: GYAE6OF02HN08R.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcgaggacacgacgggtcctcgggcccagtctcgccctgactcgacgcctcgccctcgtgtcgtcgggtctccgtggactagtcgactccgtaccgtctccgtgccgtacgtaccgggaacccgtctaggtgtacgttgggttaacgggttaacttttaagcgttcggttccgtaccggtacggtaacctaaccgttacccgttacccgaaggtaacccaaaccggtacccccctaaaattaccgtaactttaactttaaggcgggtaacgactaaccgtaacggtcccggtacccgttagggttacgggtttactacggtcttaccttcgtacgttcggaccttacggtaacgtcgttacggacgaaccgtaccggtccctaccgtacgaaccgtctccggtccgtaccgtccgtacccgtaccggtaccggtaccggaaccggtaacggacgggttactacggtttaaactttcgttaaggtcctaccgtaccgtcttaacgcgttagtaccggtacggttaaataccgtttaacgggttaacgtttaccgggttaagggaccgggggttttaccggggaaccgggtttaacggaacgggttacccggttaacgggttacgggtaacccggtaccggttaaccggaccccggggtttaaacggtccccggtttaccccccggttacccggttaaccggttaccccttttaaccggttacccccggttacccgtttaaccccccccgg

SEQ ID NO: 7373 - DNA, 848 bp, Homo sapiens
  misc_feature: GYAE6OF02GQRGU.23.71.G05.1.454.CMB.1.raw
  modified_base (129)..(129): a, c, t, g, unknown or other
  misc_feature (129)..(129): n is a, c, g, or t
  modified_base (144)..(144): a, c, t, g, unknown or other
  misc_feature (144)..(144): n is a, c, g, or t
tcagacgcgagtatcacgaccggtgctcgatttagtgtcgtcgcaagagagagggggggtcacaagaggcagcgctctcgggacgtctccaccatggcctggctctgctgctcctcactctcctcactnacgacacgaggtccngggcccagtctcgccctagctcagtcctcgccctcgtgtctcgggtctaccgtggaacctggtcgtactcccgtaccgtccttaccgtcgccgtacgtaccgggaacccctagtaggtgtaacgttcggttaacgggtttaccttttaagtacgttcggggttcttacgggtacggtaaacctaaaccgttcccgtaccccgaaggacccaaacccggtccccctaaaattccgtaattacgtttagacggacggtactaacgtaacgcggcccttaggtcggtttactcggtcgttcttactacgtcgtacctaccgtagccgtacgtaccgaacgtccgtcctaccgtaccaacgtccgttccacgttccgacccgttacgaccgtaccgtacgggtaaccgcgggtacgtaccgttacggtaaacgttttaagtttaccggttagtaccgggttacctaacgggtttaccaacggttttccagggtaaactacggggttaaatttaacccggttttaagggtttaccggtttaacgggggttaaccggggttacccgggttaaccgggggggtaaccggttagttaccggggtacccgggttaggtttaacccgggtacgcccggtttaaaccgggccttaccggggtaccccttccccgggaccggttacccgtacctttccggttaccccgttaccccg

SEQ ID NO: 7374 - DNA, 755 bp, Homo sapiens
  misc_feature: GYAE6OF02JS5KJ.23.71.G05.1.454.CMB.1.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
tcagacgcgagtatcacgaccggtgctcgatttagtgtcgtcgcaagagagagggggggggtcgacaagaggcagcgctctcgggacgtctccaccatggcctgggctctgctgctcctcactctcctcactcagacacagggtcctgggcccagtctcgccctgactcacgcctgcccgtccgtgtccgtgggtcctccgtggacctagtcgactcaccgtctcctcgccacgtcggaaccccgncgttagngttgtaggtacttttaatgtgtctcgtacggtacctaactaccctccgagtaccgaaaccgacccccaaactcaacttaactttacgtcggtaacggcctaacgtaacggtcccggcccgtacggttacgggttaccgtacgttacgtcctttcgtccgtcgtacctcgtaacgtcgtacgtaccgaaccgaccgtcccgtaccctcgtaacctaccttccgtccgttaccggtcccgtacccgaccgtacccgtcgaacccggtacgtacgtcgtacggttaatttacgtttcgttcgtcgttacgtccgttacttaactcgttacgaccgtagtaacgttaacggttagtttacggtttcgggtaccggggttacggggaaccgggttaccggtaacgggtacggttaccggtacgggtacggtccgaaccgggtcgaaccggtcccgtacccgtccccggttacccgtcggtacccgttcccggtacccgttacccccg

SEQ ID NO: 7375 - DNA, 789 bp, Homo sapiens
  misc_feature: GYAE6OF02FNA0E.23.71.G05.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (762)..(762): a, c, t, g, unknown or other
  misc_feature (762)..(762): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacgacgggtcctcgggccctagtctcgccctgactcacgcctcgcctccgtgtcgtcgggtcctcctggacagtcgactccaccgtcctctnctactcggaccnctagtgtagtcggttaggttacttttagtagttcggtcgttaccggtacgttaacccgaaaccttaccccgtacccgtaacggaaccctaaaccccggtacccccctaaaacttcctaactttaaccggtttacggacggaaccggtaacctaaacccggtaacgggtccccggttacccgttacgggttaacggggttttccgacggttccgttcctttcgtaccgtcggtacccttacgtaaccgtcggttaccgaacctaaccggtccgaccgtttcccagtacctacgttccgtccgtccgaccctccgtacgtaccgcgaacgggtacgtagtaccgttaagttactttaaacggttccgttacgtcccgttatccgttactacgtacgttacgaccgaaagttcttaacggttacttaggggttacgggttacggggtccgggacggtaaccggtacggtcgtacgggtcgtaacggcctaacgggaccgttacgtccgttaccgtcccggtancccgtttaccgccgttacccgtccccg

SEQ ID NO: 7376 - DNA, 750 bp, Homo sapiens
  misc_feature: GYAE6OF02JS4ZQ.23.71.G05.1.454.CMB.1.raw
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (349)..(349): a, c, t, g, unknown or other
  misc_feature (349)..(349): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctcgccctagacctcacgtcctgcctccgtgtcgtgggtctccgtggacacgtcgatccaccgtctcctgcctacgtcggaacccgntagtgagttggttaggtacttttaanacgttcggtctcggtacgtaacctaactacccgtaccgaaggtaccaaaccgtccccctaaaagtctaacttacgttancgggaacgtactaacgtacggccggtcccttagggtacgggtttctacggtctaccgttctacgccggtactaccgtatccgtacgacaaccgccgtaccctcctacgaccttcgtcctcggtaccgcctaccgtaccgtcgtaccgggacgaccggtacgtaccttaggtaacttttacggttcgtaccgttcgttaccgtactaacgtaagtttcgaccggagttacgttaaacgttaggttacgttacggtttacggggtccggggttacgggaacccggggtaattaccggggtctacccgggttacggtaccgtaaccgtaacgtaccccggtagggtcccctacccggggttcccttaacggtcccgtaccgtttacccggtcccccggttaccc

SEQ ID NO: 7377 - DNA, 842 bp, Homo sapiens
  misc_feature: GYAE6OF02HFIFP.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctcgccctgactcagcctgcctccgtgtcgtgggtctcctggacagtcgatccgaccgtctcctgcctactggaaccccgctaagtggattggttacgggttaacttttaaatagttggttaccttacggttcggttaaaccctaaacgtaccccttccccgaacgggtaccaaaaccggaccccccctaaaaactcctaacgttacgttttaacgtaggaacggggtacctaaaccgtaacggtccccgggtaccccttacggttaccggggggttttaccttacgggtcccgttccgtttccttccggttacggtcccttacccggtaaagtttccgtacgggaccgaaacgtacccggtcccttcccgttacgaacctacttaccgttcgtccggtccctaccgacggtacctcggaccggtaccggtacggtaccgtaggttaatttacgtttcgttacgtccgttagaccttacgtattacgtcgacgtaagttaacgtttaggtttaacgttaacgggttttacgggttaccggggttaaccggggtaacggggggtaaccgttacgggtaccgggttaaccggttacgggttacgggtaccgaaccgggtcccgaacgggtcccgtcccgttacccccggtacggttacccgtaccgtttcccggttccggttcccccg

SEQ ID NO: 7378 - DNA, 821 bp, Homo sapiens
  misc_feature: GYAE6OF02FKRT0.23.71.G05.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (287)..(287): a, c, t, g, unknown or other
  misc_feature (287)..(287): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcgagcctgcctccgtgtccgtgggtcctccgnggacnggtcgaatcaccgtctctgcactcggaccgntagtgagtggttacgggtactttaatatgtctcggtcgtaccaacttaccnccgaggacaaccgccccctaaatacctactaacttttagagtacggctaacgtaaggccgtaccctggtacggggttttactacggttcggtccttacggttccgtacgggtccttaccgaacgttccgtacgggtacctaaaacggtcccggtccctaacccgtcggaaccctcgttaccgtcgttaccgtcccgtaccgacgtcccgtaaggtacccgtacgggacggtacgttcggttaacttaagttttaccgtacggttccgttacggacctttactagtaacctcggtaacgtaaggtttagttaaacggttttagttaaccggttttcggggtaaacgggtttccgggggaaaccgggggttacccggttaaacgggttacccggggttaaccggttaccggggttaaaccggttcccggaaaccggggttacccccgttaaacgggtcccctttacccccgggtccccgggtttaccgttaaccccggtttaccgttacccgtttacccgggtttaaccccccccg

SEQ ID NO: 7379 - DNA, 799 bp, Homo sapiens
  misc_feature: GYAE6OF02HRY3Q.23.71.G05.1.454.CMB.1.raw
  modified_base (742)..(742): a, c, t, g, unknown or other
  misc_feature (742)..(742): n is a, c, g, or t
tcagacgcgagtatcacgaccggtgctcgatttagtgtcgtcgcaagagagaggggggggtcacaagaggcagcgctctcgggacgtctccaccatgcctgggctctgctgcctcgtactactctcctacactcgaggacacgtacgggtcctcggcccagtcgtcgcctacgactacacgtcctacgtccgttccgtcgttcgttcgggtaccttaccgtggtactaacggttccgacttaccgtacccgtccttcgtacgaccgtaactaccggaaaccccgtagtaggtacggtacgtttagggttaacgttaacgtttttaagtaccggttcgtccgttaccggtaaccggtaaccttaactaccccgtaccgaaacggtaacccgtaaccccaaaccccgtaacgttaacgtaacttttaaccggttaacgcgggtaaacgaaccgtttaaccgaaccgtaccggtaccccgttagggttaccggttttaaacgccggttacgttacgttacttccggaacgtcctacgtcgttacgacgtacaccgtccgtacccgtcagtaccctgtcgccgtcgtccgtacgtacgaccgtaacgtcggacgtacgtaccgtagtacgttaatacggttcgtcttacgtactcgtagtacctgaacgtacgtagtaacgttacgtaggttcgtacgggtacggaacgggtacgtacggtacgtggtacgtagtaccggtaaccncgttaccggtaccgtccgtaccgttaccgctttaacccggtcgttaccgtaaccccg

SEQ ID NO: 7380 - DNA, 627 bp, Homo sapiens
  misc_feature: GYAE6OF02IWHF7.23.71.G05.1.454.CMB.1.raw
  modified_base (239)..(239): a, c, t, g, unknown or other
  misc_feature (239)..(239): n is a, c, g, or t
  modified_base (326)..(326): a, c, t, g, unknown or other
  misc_feature (326)..(326): n is a, c, g, or t
  modified_base (383)..(383): a, c, t, g, unknown or other
  misc_feature (383)..(383): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (578)..(578): a, c, t, g, unknown or other
  misc_feature (578)..(578): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacgagggtcctgggcccagtctgccctgactcagcctcgcctccgtgtcgtgggtctccgtggacaggtcgatccaccgtctcctcgcactcggaacccgngagtgagttggttaggtacttttaagtagtgtctcgtggtaccaactacctccgaggacaaaccgcccccaactctacttacttagnggacggcacgtacggccgtcctacgtaggttctagtctcttctcgtgcctacagtcngacacgccgtcctccncacntcctcgtcgcctcgcgccgtacgacgcgcggtactgtacgttagttagtcgtcttcgtactctatctcgactagtacgtaaggttacgtttacggtttagggtacggggttcggggaaccgggggtacgtaaccggggtaccgtacgggttcggtaacggtcccgaaggtcccgnggtaccctcccggtaccgtcccgttacgccttaccggtcttaccccccg

SEQ ID NO: 7381 - DNA, 818 bp, Homo sapiens
  misc_feature: GYAE6OF02JNIPA.23.71.G05.1.454.CMB.1.raw
  modified_base (451)..(451): a, c, t, g, unknown or other
  misc_feature (451)..(451): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcgagacacgaggtccgtcggcccagtctcgccctgactcacgtcctcgcctcgtgtcgtcggtctccgtaggactagtcgactccgtaccgtctaccgtcgtccaccgtaccggaacccgtcgaggtacgtacgttcgggttacggttaactttaagtacgttcggtcgttcggtacgtaacctaccttacccgtaccggaacgaacccaaacccgtaccccgaattactaacgttacgttacggtacggaccggtactaaccgtaaccggtcccggtaccgttacgggttacggtttacgtaccgttacgtccgttacnccggtacttcccgtacgaacggtcgtacgacccgtaaccgccgtccctaccgcgacccttagtccgtaccgtctacccgtcgaccgtccgtaacggacgtacggtcgttacgtacttacttaggtcttacggtctacgttactaagtctacgtcgtaaacgttacgttaccggtttaagttaccgggttaacgggcggggtttaacccggggtaacggggaaccgggttaaccttacgggggtacccggttacggttaacccggtaacgggtaacccgaacccgggtaccggttacccgtcccgggttacccccggttcgttaaacccggtcccgttcccgtttaccccggtacccccgtttacccg

SEQ ID NO: 7382 - DNA, 708 bp, Homo sapiens
  misc_feature: GYAE6OF02FIA44.23.71.G05.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgtacggtcctgggcccagtctcgccctgactcacgcctgcctccgtgtctggtctccgtgacngtcgatcaccgtctctcgcactcggacccntagtgtatcggttggtacttttaanagtcgtctcgtcgtaccaactacccgtccacggtaccaaaccgccccctaaactcctaagttaccttagtacgacggtacaacgtaacgccggtccccttcggtacggggttttcctacggtccgtccttacgtcgtacggccttaccgaagttccgtacggacctaaccggccggtcctacccgttcgaaccctcgtacctcggtaccgtacccgtccaccggtccgtacggtacccggacggtacggtaccttaggtaaccttttacgttcgttacgccttcgtacctacgtacctagtacgaacctagtaactacggtttacgttacggttgggtacgggttacggggaccgggtaaccgtagggtaccgtacggtacggtacggtcaaccgggtacaacggtccgtacccggtcccttacgggaccttacgtcccgttactcccccgg

SEQ ID NO: 7383 - DNA, 723 bp, Homo sapiens
  misc_feature: GYAE6OF02FVGCB.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccgtctcctgcactcggaacccgnagtgattggttgggtaacttttatatggtctcgtgtacaactcctccagacaacgccccaaatctatacttatcgacggcacgtagcgccctgtacgggtttactaggtcctcttctcgtcggctacgtaagtcgtcggacctaacgaccggtaccctcccgtacgtaccctattccgtccgtacggtccctaccgacggtcccgtaggaaccgaacggtccggtacgttagttaacgttaagttttacgttcgtacccgttggtaccttacgtagtttacgtacgaccgtaagttaacgttacggtttaacgtttcggtttaaccggggttacggggttacccgggggtaccgggggtaaaccggttacgggtaccggtaacccgggtttacggttaacgggtaccgtaacggaccccggtacggttcccgttaccccgggtccccgttaccggtaccgtacccgtttaccgtcccccgggttacccccc

SEQ ID NO: 7384 - DNA, 861 bp, Homo sapiens
  misc_feature: GYAE6OF02HV0LI.23.71.G05.1.454.CMB.1.raw
  modified_base (211)..(211): a, c, t, g, unknown or other
  misc_feature (211)..(211): n is a, c, g, or t
tcagacgcgagtatcacgaccggtgctcgatttagtgtcgtcgcaagagagaggggggggtcacaagaggcagcgctctcgggacgtctccaccatggcctgggctctgctgcctcctcactctcctcactcaggacacgacgggtccgtcgggcccagtctcgccctgtactcacgcctcgccgtccgtgtcgtcgggtctccgtggacncgtcgactcctaccgttctccgtcgcgtacgtaccggaccgacgtacggtcgtagttggttacgggtttaacttttaagttggttacggttcgtccggttacggtaacctaaccgtaccgtccgaacggaaccaaaccgtaccccaaactcgtaactttacgttagtacggacggtactacgtaacgccgggttaccgttacggtttacgggttacttacggtacgttcgttacgttccggttacggtcccttaacccggttaacgttccggtacgggtaaaccctaaccggtaccccggttccgttacccgttacgaacccttacgttccgtacccggttccggtacccttaccggtccggtaccgtacgggaccggaacgggtcggtaccgttagttacgttttattcggttacggttctaccgtacttacctagtaccgttcgaacgtacgttaacgttaacgttaacgttttacgggttaacggggtaccgggggttaccggggtaaacggggttaccgtaacggggttcggtaccggtttacggaccgggtttaccgacccgggttaaccggtaaccggtccggtaccccggttccccgggttacgtacccgtttacccggttccgttaaccccgtttaccccgg

SEQ ID NO: 7385 - DNA, 760 bp, Homo sapiens
  misc_feature: GYAE6OF02ISQSJ.23.71.G05.1.454.CMB.1.raw
  modified_base (128)..(128): a, c, t, g, unknown or other
  misc_feature (128)..(128): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctnactcaggacacacgggtcctgggcccagtctcgccctgactcagcctgcctccgtgtctgggtctcctggacagtcgactcaccgtctcctgccatcgaaccgcagtgatgttaggacttttaatataggtctacgtggtacctaaacgtaccctccgaacggtacaaaccggaccccctaaactactaattaacctttagtacgtacgggacctaagaaccgacggtcccgtagtacggggtttactcgtacgtccgttactccgtacgcctaaccacgttacgtacgacgtaacgaccgtacctacccgtacgaaccttactacctcgttaccggacctacccgtaacgccgttaacgaaccgtaaccggtagggtaccgttggttaacttaagtttacggttacgtaaccgttgttaacccgtactaacgttagtaccgtaacggttagtaaaccgtttaagtaaccggtttaccggttttacggtaacggggttaccgggtaacgggggtaacccttagggtacgtaacggttaccgggttaacggtaccgtacggacccggttaagggtaccctaccgttcccccggtcggttaccctaaccggtttcgttccccgttaccccccgg

SEQ ID NO: 7386 - DNA, 661 bp, Homo sapiens
  misc_feature: GYAE6OF02I36MH.23.71.G05.1.454.CMB.1.raw
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (308)..(308): a, c, t, g, unknown or other
  misc_feature (308)..(308): n is a, c, g, or t
  modified_base (381)..(381): a, c, t, g, unknown or other
  misc_feature (381)..(381): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctccgtggacagtcgatcacgtctctgcacgtggaacccnacgtgatgttggtaacttttaanatggtctcgtagtaccaatacctccaggacaaacgccccaagtcattacttagngacggtcaacgtaacgccggtacctcgtaagggtttcgtacgttcgcttctcgtcggtcctacgtaaggtccngggacctaaacggcccggtcctcccgtacggtaccctacttctccgttccggacccttaccgtacgtcccgtacggacgacggtcgtcgtacgtagttactttagtcgtctacggtctctaactacgtctacgtagtacgttaagttacggttacgttagggtacggggttaccgggaacggggtaacgtaagggtccgtaccggtacggtacggtaacgccgtaaccgtaacggtccgtacccgtcccgtacggtcctacgttcccgttccgtaccccg

SEQ ID NO: 7387 - DNA, 785 bp, Homo sapiens
  misc_feature: GYAE6OF02IKT0X.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatccaccgtctcctgcctacgtcggaaccccgcagtgattggttcgggtaacttttaaagtagttggttcttcggtacggtaaccaaactaccctaccccgaggaccaaaaccgaccccccaaactcaattacctttaagtggacggactaacgtaacggcccggtaccctagggtaacggggttttctacggttccgtacctttcgtcgtcggtcctaccgtacgtcgtacgaccaacgaccggtccctcccgtacgtaccctacttccgttccgtccggtacccttccggaccgtcccgtaacggaaccggtacggacggtcgttaagttaactttagttagttcggtcttcggtacttactaagttcgtacgacgttaaagtacgtttaacgtaggttttaaccgtttaggggtaaccggggtttccgggggaaaccgggggttaaccgtaaggggttaccggaacccgggtttacggaacgggtacccgtaccgggaaccccggaaggtccccggttaccccggtcccccggttaccggtacccgtaccgtttcccggttccccggttacccccgg

SEQ ID NO: 7388 - DNA, 613 bp, Homo sapiens
  misc_feature: GYAE6OF02GK38Z.23.71.G05.1.454.CMB.1.raw
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
  modified_base (375)..(375): a, c, t, g, unknown or other
  misc_feature (375)..(375): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccnagtnatggttggtacttttaantgtctcgtgtaccaatcctccgagcaaacgccccaaatcatacttagngaggcactaaggccgtcctgtaggggttctagtcgcttctcgtggtcctacagtcgtgacaacgaccggcctcccngaccctatccgtcgtcgtccctccacgtccgtacggaccgaccggaacggtcttagtaacttttagtttactttcgcgttcgttccttactaaattgttacggctaaggtattacggttagtttaccgtttgggacgggttccgggacggggtaacagggtcgtaccggtaggtacgtcgacggtcccgtaaggtccgtaccggtccccgtacggtcctacgttccgtccgttccccg

SEQ ID NO: 7389 - DNA, 833 bp, Homo sapiens
  misc_feature: GYAE6OF02FGPKU.23.71.G05.1.454.CMB.1.raw
  modified_base (247)..(247): a, c, t, g, unknown or other
  misc_feature (247)..(247): n is a, c, g, or t
tcagacgcgagtatcacgaccggtgctcgatttagtgtcgtcgcaagagagaggggggggtcacaagaggcagcgctcgtcggacgtctccaccatggcctgggctctgctgctcctcactctcctcactctagacacgacggtccgtggcctagtctcgccctgactcacgcctgcctcgtgtctagggtcctccgtgacgtaggtccgtactccaccgtcctcctcgcctaccgtccggaacccncagtcgtatcgggttaggttactttaatacgtgtactcggttacgtaaccacttacccgtaccgaggtaacccaaacccgacccctaaacgtcctaacgttactttaagacggacggtacaaccgtacggtccgtacccggtcgttaacggggttttcctaacggttccttcttcgttaccggtaccggtcctacgtacggtccgttaacgggaccctaacggtacccggttaaccctacccgttaacccgtacgtaaccgttccgttaccgtaccggtacccttaccgacccggtccgaaccggtacccgggaagtccggtacgttacgttaacgtttaacgtaggttctaccggacgtaccttaactaccgttaacgttcgaacgtaaacgttacggttaaagttttaaaccgttacgggtttaccgggtaacgggtaaccggggtaccggggtaaacgtacccggggttacgtaacccgggtttcggtaaacgacccgggtaccggtaaacccggacggttcccggtaccccggtaaccgggtttaccccgctaccccggttcctttaccccggtaccccccg

SEQ ID NO: 7390 - DNA, 813 bp, Homo sapiens
  misc_feature: GYAE6OF02H5WVV.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctctcactctcctcactcaggacacagggtcctgggcccagtctcgcctgactcagcctgcctccgtgtctgggtctccgtggacagtcgatccaccgtctcctgcactcggaacccgcagtgtatggttaggtacttttaagtattcggttctcggttacggtaacctaaacttacctacccgaaggaccctaaaaccggaccccccaaaaacgttcctaaactttaccttttagtacgggtaacgggtaccctaaaccgtaacggccccggtaccccgttacgggttaacgggggttttccttaacggttccgtaccgtttaccttcggttcggtacccttaccgtaagttcgtacgggtaacccaaaccggtacccgtcccttacccgtaccgaacccttacgtaccttccgtccgggtccctaccgaccggtccgtacggaccggtaacggtcggtaccgttagttacttttaacgtttacttaccgtcgtaccggtacttaacgtaattaagttacgaccgtaaggtacgttaaacgttaacgtttacgtttacgggttacggggttaccggggaaccggggggtaacgtacggtaccggtacggttacgggtacgtaccggtaacggaccggtaacggtcccggttaccgtccccggtaccggttaccctacgttcccgtacccggtcccccg

SEQ ID NO: 7391 - DNA, 861 bp, Homo sapiens
  misc_feature: GYAE6OF02HLEEN.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggcctctgctgcctcctcactctccctcactcaggacacacgggtcctcgggcccaggtcctggcccctgtacctcgaagcctgcccgttcgtggtctgggtctcccgtaggaccagttcgactccgtacccgtctccgtagaccgtaccgttacgggaaacccgtcctaacggttcggagttacggggtttaccggggttaaactttttaaagttacgttcggggttcctttccggggttacgtaccgtaaaaccttccctaccccggaaggtaacccaaaacccgtacccccaaaacgttacctaagttacctttaaggtcggtacggaacctaccggtaaacggcccggtcccgttacgggtaacggggtttcgtacgtccggtccttacgtccgtacgtcctactaacgtcgtacgggacctaaccggccgttccgaccccggttaacccgtacgtccgtccgttcgggtcccctaacggtaccctacgtaccggtaaccgaccgggtacgaccgttagtaacgttttagtcgttaccgtgttaccgcttaactaggttcaacggtctaacggtacgttaacgtttacggtaccttttaggggtaccgggggtaccggtttacccgggggaaacgttaccggtaccggggtttcccggtaaccggttacgggttacccggaacccggtaccgtaaccgggtccttcccggggcccccttagggtaccccttacgtcccgttaccccggttcccc

SEQ ID NO: 7392 - DNA, 726 bp, Homo sapiens
  misc_feature: GYAE6OF02GBLT8.23.71.G05.1.454.CMB.1.raw
  modified_base (237)..(237): a, c, t, g, unknown or other
  misc_feature (237)..(237): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctcgccctgactcacgcctcgcctccgtgtctgggtctccgtggacagtcgatccaccgtctcctgcacgtcggaacccncagtcgatggttaggtacttttaagagtggtctcgtacggtaccaataccctccgaggaccaaaccgacccccaaactcctaacttacttagtggacggacaacgtaacggccggcccttacggtacgggtttactacggtccgttcttccgtcgtcggtcctaccgtagtccgttggaccaaacgccgtaccctccctacgtacctacttcctcggtccggtccctacgacgtccgtacgggacccgtaacggtacggtcttagttaacttttacttgttacggtcttacgtacctagtaactttagtacgtactaagtacggtttaagtttaacgtttacgggtttacgggtacggggttaccgggggtaaccgggggaacctaagggttccgaccggtttacggacggttccgaaccggtaccgtacggtccccttaccgggtccccggtaccgttaccgacccgtttccgtaccccgttaccccg

SEQ ID NO: 7393 - DNA, 764 bp, Homo sapiens
  misc_feature: GYAE6OF02JE30E.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctctcactctcctcactcaggacacagggtcctgggcccagtctgccctgactcagcctgcctccgtgtctgggtctcctggacagtccgatccaccgtctcctgacacgtccggaacccgcgacgtgtattcggtttgggtaactttttaagtacgttggttacctcggttacggtaccaaacgttcccgtacccgaggacctaaaaccggtacccccctaaaacgttctaacgttaacttttacgacggtacgggtacacgttaaacggcccggtacccgttcggttacggggtttcctacgttccgttcttccgttcgtcggtcctaccgtaacgttccgtcggacccaacgaccggtcccgttacccgtcgtacccactttccgttcccgttcggtacccttaaccgacgtacccgtacggtaacccggtaccgtagggttctaacgttatttaacgttgttacgtccgtaccgtcttacttacgttacgtcgtacgttaacggtaatttccgtaaacgttttggttacggttacggggtccgggagggtaccgacggttacggtaccggttagtccggtacgaccggtacccgtaggtcccgtccggtacccgttaccggacttcccgttccgtcccgttaccccg

SEQ ID NO: 7394 - DNA, 829 bp, Homo sapiens
  misc_feature: GYAE6OF02H3GSH.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgcctcctcactctcctcactcaggacacgacgggtcctgggccccagtctgccctgacctcacgcctgcctccgtgtcgttcgggtctccgtggacaggtcgactcctaccgtctcctgccacgtcggaacccgcaggtgtagttcggttagggttaactttttaatacgttggttcctcggtacggtaaacctaactaccctaccgaggaccaaacccgaccccctaaaatccaactttacgttagtacggacggacaacgtacgccggtcccgttacggttacggggttcctacggtcctcttcgtcgtacggtccctacgtaacgtctacggacaaccggacccgtccctaccgtacgacctactccgttccgtccgtccctaccacggtccgttaccgaacgtacggacgtctaacgttaagtttacgttattcgtccgttagtcctacgtagtacgtcgtaacgtaagtacgtaacggttttacggttacgttttacgggtacggggggttaaccggggtaacggggggtaaccgttaacggggttcccggtaaccgggtttaaccgggttccgggttaaacccggtacccgggtaaaccccggtaacccgggggttaccccggtttcccccggggttaacccccggtttacccggggtttaccccctttaaccggttttaccccgggtttcccccggtttacccccccggg

SEQ ID NO: 7395 - DNA, 707 bp, Homo sapiens
  misc_feature: GYAE6OF02GO3D2.23.71.G05.1.454.CMB.1.raw
  modified_base (239)..(239): a, c, t, g, unknown or other
  misc_feature (239)..(239): n is a, c, g, or t
tcagacgcgagtatcacgaccggtgctcgatttagtgtcgtcgcaagagagagggggggggtcgacaagaggcagcgctctcgggacgtctccaccatggcctgggctctgctgctcctcactctcctcactcaggacacagggtcctgggcccagtctcgccctgactcagcctcgcctcgtgtcgtgggtctccgtaggactgtcgatccaccgtctctgctaccgtcggaacccgnagtcggtattcgggttacgggttacttttaagttacgtgggttctcggtacggtacctaaactaccctccaggaaccaaaccgtacccccaaactctaacttacgttagtcggtacggacacgtaacggccgtcctacgtacggttcttacgtctcttctcgtcgcctcaagcttaggacaacgcgtcctacctcgacctagtcctctaccggcctacgccgtaccgcggaacgtacccgggtagtaccgtacgtttaacttagtttacgtcgtaccttggtcctactaagtacgttcgataacgtattacgggttaactttacgggttttagggtaacgggttcggggggaaccgggggttaactaggggaccgtaccgttaccgggtaaggtaccgaccgtacccggttaccgaccgttccccggtacccgttccgtaccgcgtttaccccggtccgttcccccgg

SEQ ID NO: 7396 - DNA, 878 bp, Homo sapiens
  misc_feature: GYAE6OF02G3ZMY.23.71.G05.1.454.CMB.1.raw
tcagacgcgagtatcacgaccggtgctcgatttagtgtcgtcgcaagagagaggggggggtcacaagaggcagcgctctcgggacgtctccaccatggcctgggctctgctgctcctcactcctcctcactcaggacacgtgggtcctcgggcccagtcctcgccctgacctcagtcctgcctccgtgttcgtcgggtcctccgtggactagtcgactccaccgtctcctgccacgtcgaacccgtgagtgagttcggtaggttaacttttagcgttggtcgtcgtacgtaccaactccgtccgagaccaaaccgaccccaaatctaattactttagacgggacggacctaacgtaacggccccggtacccttacgggttaggggtttacctacggtaccgttaccgtttctccggtcggtacccgtaccgtacggttccgacggtaccctaaaccggacccggttcccttacccgtccggtaaccctacgttccgttacccggttccggcccctttacggaacgtccccggtaggtacccggtaacggccggttacgttacggttaacttttaacgtttagttaccgtaccgttacgtaccgttaacttaacgtacgttacccggtaagtaaccgtttaacgttaaagggtttttaaccggtttaccgggtttaacggggtaaccgggggttacccggggggtaaacccgggtaacgggttaccggggtttaccggtaacggggtttaccggggttaaccgtaacccggtaaccggaccccggggttaaccggttccccggtttaccccggtaccccccggttttaaggtaaccccggttccccggtttacccggtttccccccgttaacccccccg

SEQ ID NO: 7397 - DNA, 637 bp, Homo sapiens
  misc_feature: GYAE6OF02FPRSF.23.71.G05.1.454.CMB.1.raw
  modified_base (228)..(228): a, c, t, g, unknown or other
  misc_feature (228)..(228): n is a, c, g, or t
  modified_base (315)..(315): a, c, t, g, unknown or other
  misc_feature (315)..(315): n is a, c, g, or t
  modified_base (492)..(492): a, c, t, g, unknown or other
  misc_feature (492)..(492): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcatcaccgtctcctgcactcggaacccncagtgatggttagggtacttttaatatcggtctcgtgtaccaatacctacccaggaccaaacgcccccaaactctaacttaacttancggaggccaacgtacggccgtccctgtacgggtttctacgtctcttctcgtcggccttcctaagtctacggacaacgtaccggtcccctccctgaaccctactcctcgtcggccctaccgacgcctaggaccgtacggcggtaccttaggatttaattgttcgcttgcctagactancgctatagtacgttagttcgttagggtacgggtccggggaacggggtaccgagggttcgaccggttcggtaacggtaccgaccgtaaccccgtaggtcccgttccccgcccggttcgtacccgtcgtttacccgtcctacccccg

SEQ ID NO: 7398 - DNA, 748 bp, Homo sapiens
  misc_feature: GYAE6OF02JH66Y.23.71.G05.1.454.CMB.1.raw
  modified_base (129)..(129): a, c, t, g, unknown or other
  misc_feature (129)..(129): n is a, c, g, or t
  modified_base (583)..(583): a, c, t, g, unknown or other
  misc_feature (583)..(583): n is a, c, g, or t
  modified_base (728)..(728): a, c, t, g, unknown or other
  misc_feature (728)..(728): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctnactcaggacacgagggtcctgggcccagtctgccctgactcagcctcgcttccgtgtctgggtctccgtgcagtcgatccaccgtctcctgcacgtacggaacccgtctagtgagttggttacggtaacttttaaagtgttcggtaccttcggttagtaaaccctaacttacccctccgaacggaaccaaaccgtcccccaaaacctctaacgtttaacttagtcggaacggtctaaacagggccgtacccgttacgtacggggtttactacggtctacctttcggtccttacggcctaccgtaaggtcgtacggtacgaaacccgtccgggtccctccgaacccgtaccgttcgttaccctacgggttcccgaacccgttaccgtacccgtctaacgggaccgacgggtactccggttaagttaacttacgtttatcggacttcgccttaacntaacggctaagtaacgtagttatttaaccggttacgtttcggggtaccggtaccgggggtaacgggtaacccgtaagggttcgtaaccggtcggttaacggccgtaccgaccggttacgtccgtccccggtacccggtcgtaacnccgtttcccgttacgtcccc

SEQ ID NO: 7399 - DNA, 674 bp, Homo sapiens
  misc_feature: GYAE6OF02IO9EP.23.71.G05.1.454.CMB.1.raw
  modified_base (188)..(188): a, c, t, g, unknown or other
  misc_feature (188)..(188): n is a, c, g, or t
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (514)..(514): a, c, t, g, unknown or other
  misc_feature (514)..(514): n is a, c, g, or t
  modified_base (526)..(526): a, c, t, g, unknown or other
  misc_feature (526)..(526): n is a, c, g, or t
  modified_base (581)..(581): a, c, t, g, unknown or other
  misc_feature (581)..(581): n is a, c, g, or t
  modified_base (591)..(591): a, c, t, g, unknown or other
  misc_feature (591)..(591): n is a, c, g, or t
  modified_base (623)..(623): a, c, t, g, unknown or other
  misc_feature (623)..(623): n is a, c, g, or t
  modified_base (632)..(632): a, c, t, g, unknown or other
  misc_feature (632)..(632): n is a, c, g, or t
tcagacgcgagtatcacgaccggtgctcgatttagtgtcgtcgcaagagagagggggggtcacaagaggcagcgctctcgggacgtctccaccatggcctgggctctgctgctcctcactctcctcactcaggacacacgggtcctgggacccagtcctcgccctgacctcagcctgcctccgtgtcnggtcctccgtggacagtcgactcaccgtcnccgtgcacgtcggaccncagtgcttggttaggtactttaangtgtctacgtagtaactactacctcaaggacaacccgtacctaactaccgtagttaaccttgacggacgtacgaacctaacggtcccggccctttagggacgggttttacctggttaccgtcctttgccgttacgtacccttcgaacgttcgacggtaccaacggtcccgtcctccgtactacgacctcgttaccttcggcccttcgaaccgtcgtacgaacggaccgcgttgtaaattcgttattacttcggtntaccgtcgttanacggttactacgtacctagtagttacgtttagttcggttaggacggggtaccggngggttaaacngggtacccgttaggtcggacgttaccggaacnccggttaanccggttccacccggtccgtctaccgttcgtcccgttaccccg

SEQ ID NO: 7400 - DNA, 843 bp, Homo sapiens
  misc_feature: GYAE6OF02HQHT6.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcgaggacacgacgggttcctcgggacccagttctcggcccttagactcacgcctgcccttcgtcgtcgttcgggtcttccgtaggacacggtcgactccgaccgttctccgtgaccacggtaccgggaaccccagaggttcgtagttcgggtttaggttaaaacttttttaaactaggttcggttccgttacggttacggtaacctaactacccgtaccgaacggaaccgaaacccgtaacccctaaacgtccttaatttaacgttaacgtacgggaacggtacctaacgtaaccggccggtcccgttacggttacggggtttaccttaacgtccgttcctttaccgttcggtaccgtaccgttaaccgtacggttcgtacggtaaccaaccgtaaccgtccgttaccctaacgaccttacgttccgttccggttccggtacccgtacccggtacgccggtaaccgtaccggaacgttcggtcgttacgttagtttacgttcgttacgtccgttacgacttacgtaagtactacgacggtaaacgttacgtaacggttaaggtttaccggtttagggtaccgggggttacggggtaaccggggtacggtaacggttcgggaccgggtttacggtaacggtccgaccggtaccgtacggtcccgttcccggtccccgttacgacccggtttactccggttccgttaacccccg

SEQ ID NO: 7401 - DNA, 788 bp, Homo sapiens
  misc_feature: GYAE6OF02FSFBA.23.71.G05.1.454.CMB.1.raw
  modified_base (243)..(243): a, c, t, g, unknown or other
  misc_feature (243)..(243): n is a, c, g, or t
tcagacgcgagtatcacgaccggtgctcgatttagtgtcgtcgcaagagagaggggggggggtcacaagaggcagcgctctccgggacgtctccaccatggcctgggctctgctgctccctcactctcctcactcaggacacgagggtcctgggccccagtctcgccctgactcagtcctcgccctccgtgtctgggtcttcctggcagtcgactccaccgtcctcctgcacgtcggacccgnacgtgtatggtacggttaacttttatagtcggtactggttcgtacctaacttaccctaccccgaggacctaaaccgaccccctaaactctaactttacctttagaggtacggaccaacgtacggaccggtacccgtacggtacgggtttcctagtccgtcttcctactcgctaccgtaacgtcgtagtaccgaacgtaccggtccctccctacgtacctacgtccgtacgtcggaccctcgacctccgacggtaccggaacgtaccgggtacttagttaacttacgtttacgtacgttacgtcgtaccttaactacgtacgttacgtacggtaacgttaaggtttaagtttacggtttaccggttttaagggggttaccgggggttaaccggggtacccgggggaacggttaccgggttaccggtacccggttacgggttaaccgggtccggtaaccgggtaccccggaacccgggttccttacccccgggaccccgtttcgggtttaaccccgaccgtttcccggtccccggttttaacccccg

SEQ ID NO: 7402 - DNA, 775 bp, Homo sapiens
  misc_feature: GYAE6OF02FY5LB.23.71.G05.1.454.CMB.1.raw
  modified_base (257)..(257): a, c, t, g, unknown or other
  misc_feature (257)..(257): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatccaccgtctcctgctactcggaacccgcagtgagttggttaggtacttttaanagttggtctcgtacggtaccaacttacccgtccgaggaccaaaccgaccccccaaaattcctaaacgttaaccttttagacggtaacgggacctaacgtaacggccggtcccctacggttaacggggttttccaacggttccgtaccgtttctcgttcggtcctaccgaagttccgtagaccgaaaccgaccggtccccttaccgtcgtaacccgacttccgtcgtccggtccctaccgacggtcccgtaggaaccggtaaccggcggtaccgttaggttaactttagtttacgtttcgaccgttgtccttacctattacggtacgacctaagttaaggtttacggttaacgtttacgtttcggggtaacgggttaccgggggtacgggggttaaaccctagggggttaccgtaccgggttaccgggttaacggtaccggaccggtaacccgtacggtccctaccggtaccccccggttgttacccgtccgtttcccggttaccccggttcccccccg

SEQ ID NO: 7403 - DNA, 640 bp, Homo sapiens
  misc_feature: GYAE6OF02GMRML.23.71.G05.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (296)..(296): a, c, t, g, unknown or other
  misc_feature (296)..(296): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgnagtgatggtggtactttaanatggtctgtagtacaatacctccagcaacgccccaatcatacttangaggcactagccgacctgtacgggtttctagtcgtcttctcgtcggtctaccgagtctggaccaacgccggtccctcccgtcgaccctatcctcgtcggccctccgacgcctaggaccgacggagtctagtaatttacttagttcgcttagtcctagattgtcgactaagtagttaagttacgtttacgtttgggacgggtttccggggacgggggttaaccctaggggttccgtaccggttgggtaacggtacccgaacggtaccccggtaagggtcccgttacccgggtacccccggttccggttaccctaccggtttcccgttaccccggtttaccccccc

SEQ ID NO: 7404 - DNA, 822 bp, Homo sapiens
  misc_feature: GYAE6OF02H4SYQ.23.71.G05.1.454.CMB.1.raw
  modified_base (213)..(213): a, c, t, g, unknown or other
  misc_feature (213)..(213): n is a, c, g, or t
  modified_base (340)..(340): a, c, t, g, unknown or other
  misc_feature (340)..(340): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacgagggtcctgggcccagtctcgccctgactcacgcctcgcctcgtgtctgggtctcgagtcggacagtcgatccncgttctcctagcacgtcgaaccgctagtgtattggttaggttaacttttacgtagttcgtcgtcgtaggtaaccacgttacctccgaacggaccaaaccgtaccccaaacgttctaattactttacnggacgctaacgtaacggcccggtaccttacgggtacgggtttacctcgtacgtcctttcgcgtacggttcctaccgtaagttcgtacggaccaacgtcccggtcctaccgtacgacctacgttccgtccggtccgacccttacgtaccggtaccgtacgtaaccggtaacgtacgggtacgttacgttaacttttacgtttaacggttccggttacttaacccggttcttaacgtaacgtacgtttacggacccggtaaagttaaccggttaagggtttaacccgtttaacggtttacgggggtacccggggttacggggggaaacccggggtttaaccgaaccggggttaccggtttaccggggttaacggttaacccggtacggtaacccgggtttaaccccggacggtttacccggtaccccggggttacccccgttaccgggtttaccgttaccccgtttcccggtttaacccccggg

SEQ ID NO: 7405 - DNA, 747 bp, Homo sapiens
  misc_feature: GYAE6OF02HEYX5.23.71.G05.1.454.CMB.1.raw
  modified_base (197)..(197): a, c, t, g, unknown or other
  misc_feature (197)..(197): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcacctctcctcactcgaggacacagggtcctgggcccagtctgccctgactcagtcctgcctccgtgtcgtggtctcgnggacagtcgactccaccgttctcctgcacgtcgaaccgctagtcgtattggttagggtaacttttaagtagttcggtcttcggttacgtaacctaactaccctaccgaacggaccaaaaccgaccccctaaatcctaacttaacgtttagaggaaccggactaacgtaacggccggtcccgttacggtacggggtttactacgtacgtaccttccgtcgtacgtacctaaccgtaagttacctacggacctaaaccgccggttccctacccgtaccgtaacctactccgttacgtcggtacccttccgacgtacgtccggaacgaccgtgtacttacgtaattttaacttagttcgtacttacgccttctatactagaaccgtataacgtttaagttaacggttttaacggttggggttaacccgggttcggggaaccgggggtaaccgaagggttcgttaaccgggttaggtaacggttaccgaccgggtaacgttaccggccgttcccgacccggttcggtaccaccgtttaccgtccttaacccccg

SEQ ID NO: 7406 - DNA, 809 bp, Homo sapiens
  misc_feature: GYAE6OF02I667Z.23.71.G05.1.454.CMB.1.raw
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacactacggtccgtgggcccagtcctcgccctgactcacgcctcgcctccgtgtcgtgggtacctccgtggacagtcgactcgacccgttctcctcgacctacgtaccggaacccgcgtacggtcgtagttcggttacgggttaacttttaagtagttacggttccgttacggttacggttaacctaaaccgttaccccttaccccgaacggtaacccgtaaaacccgaaccccccgtaaacttaccgtaacctttaacgtttacgtacgggtaacgggacctaaccggtaacggcccggtacccttacgggttacggttacggtacgtacgttccttctaccgtcgtacctacgtagttccgacggtaacccaccgtaccggtccctaccgtccgtaccgtaccttaccgtccgtaccgtccctaccgacgtcctacggaccggtacgtacgtcgtcgttaattacgttagtcgtacgtctaccgtagtacgtacgtacgctaagttcgttacggtttacgttacgttgggttacggggttaccggggtaaccgggtaaggtaccggttacgtaccgggttacggtaaccggtaccggtaccggaacccggttcgacccggttcccggtacccggtccgttaccctaccggtacccgttcccgttacccccg

SEQ ID NO: 7407 - DNA, 723 bp, Homo sapiens
  misc_feature: GYAE6OF02GHZCL.23.71.G05.1.454.CMB.1.raw
  modified_base (159)..(159): a, c, t, g, unknown or other
  misc_feature (159)..(159): n is a, c, g, or t
  modified_base (177)..(177): a, c, t, g, unknown or other
  misc_feature (177)..(177): n is a, c, g, or t
  modified_base (248)..(248): a, c, t, g, unknown or other
  misc_feature (248)..(248): n is a, c, g, or t
  modified_base (547)..(547): a, c, t, g, unknown or other
  misc_feature (547)..(547): n is a, c, g, or t
tcagacgcgagtatcacgaccggtgctcgatttagtgtcgtcgcaagagagagggggggggtcgacaagaggcagcgctctcgggacgtctccaccatggcctgggctctgctgctcctcactctcctcactcaggacacagggtcctgggcccagtcngccctggactccagtccngccgtccgtgttccgtgggttctcccgtggactagtcgatccaccgtctccgtgacacctcggaaaccccngacgtgtacgttggttacggtactttaatagttgtcgtcgtgtacaactacctccgagacaaacgaccccaactcgaattacttatgggacggcaaccgtagcggacccttacgtcggggttactagtccgtacttcgtccgtggtccgtacgtaacgtcgtacggaccaaccgtaccggccctaaccgtcgaacctacgtccgtttacgtcggtccctcgtaccgtccgtacgtccgacggccgtaggtctaagtttagttagttacgttcgttacggacttacgacgttctcggtanaagtacgttagttaacggttactttaggggtacggtacggggtacggggaaccgtacgggtacggtacggtaccgggttacggtaacggtaccggtaaccgtacccggtaccggttcccgaccccccgggttaccgttaccggtacccgtttaccggttacccccgttacccccgg

SEQ ID NO: 7408 - DNA, 907 bp, Homo sapiens
  misc_feature: GYAE6OF02G3GCW.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacgagggtcctgggcccagtctgccctgactcacgcctgcctcgtgtctgggtctcctggactagtcgatccaccgtctccgtgaccacgtcggaacccgctagtgtatcgggttaggtaactttttaatagttcggttcttacggtacggttaacctaacttaccctacccgaaggaccaaaccgtaccccctaaactactaacttactttagcggaacgggtccaacgtaacggccgcccgtagtacgggtttctacggtcgtccttcgtacgttcggtcctccgtaaggttccgtacggacttaaaaccgccggttaccctcccgtaaccgtaccgtacctttccgtaccggttccggaccccgttaccgtaccgtcccggttacgaacccgggtacggtaacgggtaccgtttacggtaactttttaacgtttaaccgttcgtacccgttacgttacgttaacccgttaagttaacgttaccggaacggttaaccggttaggtttaaaccgggtttaaaccggttttaccggggttttaacggggtaacccggggggttttaaccgggggggaaacccgggggtttaaccgggtaaacgggggtttacccggttaacccggggtttacggtttacccggggttaaaccggtaacccgggttaacccccggtaaggggttacccccgtttacccccgggtccccgggttttacccggttaaccggttaaccccggtttcccgtttacccccgggttttaaccccccc

SEQ ID NO: 7409 - DNA, 920 bp, Homo sapiens
  misc_feature: GYAE6OF02IKF4I.23.71.G05.1.454.CMB.1.raw
  modified_base (275)..(275): a, c, t, g, unknown or other
  misc_feature (275)..(275): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctccctcactcacggacacgagggtcctcgggcccagtctcgccctgacctcgacgcctcgtcccgtccggtcgttcgtcgggttcctccgtacggtaacctacggtccgatcccgacccgttcctccgtacgccaccgtaccggaaccccgngtacggtagtacgttggtttaccgggttaatttttaaacgtagttcggttaccgttccggttaaccggttaaaccctaaacgttcccccgttaccggaacggtaaaaccccgaaaccctaaaccccccaaaacgtttcctaaattttaccccgtttaagtcgggaaaccggtacccgtaacgtaaacccgggtcccgtccccgttaagggttaccggggttttaccgtaacggtcccgttccgttccgtttcggcggtacccctaacgtccgttaccgtacggtaaaccccgtaacccgtccggtcccccttacccgtaccgtaaccctatacccggtttcccaccggttaccccgtacccgtaaccggtccccgttaacggaaaccccgggtcggttaacggtccgttaacgttaacgtttacgtttaaccgttcgggttaccttaccggacccttttacgacgttaccgtaagtaccgttaaacggtacgttaacgttaacggtttaaccgggttacggtaccggggttacggggaaccggggtaacctagggtacccggtacgggttacgaacggtcccgagtaccccggtaagcccggtcccgtacccgtcgtaccctaccgtcccgttacccggtccccg

SEQ ID NO: 7410 - DNA, 838 bp, Homo sapiens
  misc_feature: GYAE6OF02IESJF.23.71.G05.1.454.CMB.1.raw
  modified_base (229)..(229): a, c, t, g, unknown or other
  misc_feature (229)..(229): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcactctcctgcacgtacggaaccncagtgacgttggttagggttaacttttaatacgtcggttctcggttacggtaacctaaacgtaccctacccgaacggtacaaaccggtaccccccaaattaccgtaactttaaaccgttttatacggggaacggtactaaccggtaaaccggcccggtacccttacgggtaacgggggttttacctaaacgggttcccgtcgtttcctccggttacggtcctaacgtacgtcgtacggaactaaccggcggtccccttacccgtacgacccgtattccgtacgtccggtacccgtccgtacgcccgtaacggaacggacgtaacggtcttaaggtacgtttaacgttgtttaccgtacgtaggtccctactaaacgtacgttcggaacctaaggttaacgttaaccgggtttaacgtttaaccggttcggggttaaccgggttacccgggggggaacggggtaacccgtaaggggttccggtaaacccgggttcgggttaaaccgggtcccggttaaccggaacccgggtacgttaccccggtccccggtttaccccgggtaccggtttaccgttacccggtttacccgttcccgttaaacccccccgg

SEQ ID NO: 7411 - DNA, 776 bp, Homo sapiens
  misc_feature: GYAE6OF02IX8V4.23.71.G05.1.454.CMB.1.raw
  modified_base (128)..(128): a, c, t, g, unknown or other
  misc_feature (128)..(128): n is a, c, g, or t
  modified_base (234)..(234): a, c, t, g, unknown or other
  misc_feature (234)..(234): n is a, c, g, or t
  modified_base (317)..(317): a, c, t, g, unknown or other
  misc_feature (317)..(317): n is a, c, g, or t
tcagacgcgagtatcacgaccggtgctcgatttagtgtcgtcgcaagagagagggggggggtcacaagaggcagcgctctcgggacgtctccaccatggcctgggctctgctgctcctcactctcctnactcaggacacagggtcctgggcccagtctgccctgactcagcctgcctccgtgtcgtggtctcctggacagtcgatccaccgtctcctgcctacgtggaacccgnaagtgagttggttcggtaacttttaatagtgtctcgtggtaccaatcctaccaggacaaacgcccctaaatctactactttancggaggctaacgtaacgccggtccttcgtaggggtttactacggtccgtcgtttccgtcgtcggtccttacctaacggttccgtacggaccaaccgtaccggtcccttccctacgtaccctacgttccgttaccgtcgggtcccctacgaccgtacccgtacggtaacccgtaacggtacggtaccgttagttaacgttttaacgtttacggttaaccgttcgttaccggttcccgttaacttaacgtaaccgtcggttaacctaaggttaacgtaacggtttaacggtttaacgtttcgggttaacggggttacggggtaccgggggtaaaccgttacgggtaccggttaccggttaccggggtaacgtacccggtaaacggtaccccgtaaacggtcccgttacccggtacccccgttccggtaaccctcccgtttacccgtcccgtttacccccgg

SEQ ID NO: 7412 - DNA, 326 bp, Homo sapiens
  misc_feature: GYAE6OF02GLFIJ.23.71.G05.1.454.CMB.1.raw
  modified_base (207)..(207): a, c, t, g, unknown or other
  misc_feature (207)..(207): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (267)..(326): a, c, t, g, unknown or other
  misc_feature (267)..(326): n is a, c, g, or t
tcagacgcgagtatcacgaccggtgctcgatttagtgtcgtcgcaagagagaggggggggggtcacaagaggcagcgctctcggggacgtctccaccatggcctgggctctgctgctcctcactctcctcactcaggacacagggtccctgggcccagtctcgtccctgactcagcctgcctccgtgtcttgggttctcctaggacngtcgatcctaccgtctcctgcactacggaacccnagttanagttggtggttactttaagnnnnnnnnnnnnnnnnnnnnnnnnnnnnnnnnnnnnnnnnnnnnnnnnnnnnnnnnnnnn

SEQ ID NO: 7413 - DNA, 764 bp, Homo sapiens
  misc_feature: GYAE6OF02JY7K2.23.71.G05.1.454.CMB.1.raw
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactcctcctcactcaggacacgacgggtccgtcgggccctagtctcggcccgtgacgtcacgcctgccttccggtgtccgtgggtacctcccgtagacgacgttaccgatcctcccggtcttccgngacgaccgtggaaccccgntaaggtcgagttaggttggttaacttttaagngtggttcctacggtagtacctaacttccgaccgagtacgaacctacccctaaacttctattaaccgttgacgtaacggaccgtaataccggcgttaccctacggttagggttttaccacggtcgtaaccgtttcctagtaccggtacctacggaaacggtcttacgggaacccacgttaccgtaccccgtacgtacgaaccgtttcgacggtttcccaaccggtccccgtaacgaccggtcccgtacggtaaccggtaccggaaggtaccgttagttaccctttaagttacgttccggtactactacggtctaagttaacggctaagtacgtaagttcgacggtttaggtccgggtagggttaccggaggggtaacctacggtcggtaacggtcggaaccgggtctaccggcggtaacgtcccgtacccgttcccggtcggttacctaccgtccgttcccgttaacccg

SEQ ID NO: 7414 - DNA, 723 bp, Homo sapiens
  misc_feature: GYAE6OF02IGBSZ.23.71.G05.1.454.CMB.1.raw
  modified_base (657)..(657): a, c, t, g, unknown or other
  misc_feature (657)..(657): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccgtctcctgacctacgtacggaacccgcaggtgtagttggttcgggtaactttttaaagtagttcggttcgttacggttacggtaaccctaaacctacccctacccggtaaggaacccgtaaaacccggacccccctaaaacttacctaacctttaacttttacgtacgggtaacggtacctaaccgtaacgtcccggtaccccgttacggttacggggtttaccttacgttaccgttcgtttcccgtgtccggtcccttacgtacgtcgtcgaccaacgtaccgtccctcccgacgtacctacttaccgttcgtaccggtacccctacgtaccgtcccgtaagaaccggtacggtacggtccgtagttactttagtttactcgttactgtacctcgtatcgtcgactagttatacgttatttaccgttggtacgggtcgggacgggtaanacggtcgtacgtcgtagtcgtacgactacgtccgtccgtcccgtgtacccgtctcctacccgtccc

SEQ ID NO: 7415 - DNA, 774 bp, Homo sapiens
  misc_feature: GYAE6OF02FVIOA.23.71.G05.1.454.CMB.1.raw
  modified_base (232)..(232): a, c, t, g, unknown or other
  misc_feature (232)..(232): n is a, c, g, or t
tcagacgcgagtatcacgaccggtgctcgatttagtgtcgtcgcaagagagaggggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccgtctcctgcactcggaacccnagtgatggttaggtaactttaagtagtggtctcggtacgtaaccaacttaccctccgaggaccaaaccgaccccctaaactctaagtttaccgttagtcggaacggacctaacgtaacggccggtcccgtacggttacgggtttacctacgttccgtccttacgtcgtacggtccttaccgagttccgtacgacccgtaacgacccggtcccttcccgtacgaccttacgtccgtcgtaccggtcccttacgacgtccgtaggacccgtacggcgtaccgttaggttatttaacgttacgttcgtccgttcgtacttacctaagttctacgggtacctaaggttacgtttacgtttacggtttaaccgtttggggtaccggggttaccgggggtaaccgggggttaacccgtaagggtttaccgggtacccggttacgggttaacgggtaccggaacccgggtcccggtaacgggtccccgttcccggtaccccgttacccggttaacccgtcccggtttcccggttacccggttccccccg

SEQ ID NO: 7416 - DNA, 781 bp, Homo sapiens
  misc_feature: GYAE6OF02HM4JE.23.71.G05.1.454.CMB.1.raw
tcagacgcgagtatcacgaccggtgctcgatttagtgtcgtcgcaagagagagggggggggtcacaagaggcagcgctctcgggacgtctccaccatggcctgggctctgctgcctcctcactctcctcactcaggacacgagggtcctgggcccagtctgccctgactcagcctgcctccgtgtctgggtctccgtggacagtcgatcaccgtctcctgctacgtcggaacccgcagtgagttggttaggtaacttttaatagtggttctcgtacgtacctaactaccctccgagaccaaccgacccccaaactctaattaactttactaggaacggtactaacgtaacggccggtaccctacggtacggggtttctacggttcgtcttcgtcgtcggccttaccgagttcgcggacctaacgccggtccctccgtacgacctacttccgtccgtcggtccctccgacgtccgtacggaccgtaacggtacggtcgttagtaacttttaagttacgtttcgcgttacgttaccttacgtaagttacgttacggaacgttaaggttaagtttaacgttaacggttttacggtttacggggttaacgggggtttacccgggggaaccggggggttaaccgtaacggggttcccgggtaaccgggtttaccgggttaacgggacccgtaaccgggaaccccggtaaccgggtccccgttaccccggtcccccgggtttacggttaccccgtacccgtttccggttaccccggtttaccccccg

SEQ ID NO: 7417 - DNA, 742 bp, Homo sapiens
  misc_feature: GYAE6OF02GCB9A.23.71.G05.1.454.CMB.1.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
tcagacgcgagtatcacgaccggtgctcgatttagtgtcgtcgcaagagagaggggggggtcacaagaggcagcgctctcgggacgtctccaccatggcctgggctctgctgctcctcactctcctcactcaggacactagggtcctgggccctagtctgccctgactcagcctgcctccgtgtcgtgggtcctccgtggactacggtcgactccgaccgtctccgtagccacgtacggaacccgnagttgagttggttaggtaacttttanagttcgtctcggtacggtaacctacgttacctccccgaaggaccaaaaccgaccccccctaaagtcctaactttaccgtttagtacggacggtacctaacgacggtcccggtacccgtacggttacggggttttctacggttccgtccgtttccgtcgtccgggtacccttccgtaacgtcgttaccggactaaccggtacccgccgttaccgacgtaccctctaccgtccgtacggtccctacgccgtaccgcgtaaccggtacgacgtcttacgttaagttcgttattcggacttcgcctaagtactcgacgtcacgttaagttaacgtcggtttacgttacgggttacgggtccggggtacgggtaacgtacgggtcggtaacggttccgtaacggtacgtacccggcgttaccgcgttacccggtcccggtccgttaaccgtcccgttaccgtcccgttaaccccg

SEQ ID NO: 7418 - DNA, 320 bp, Homo sapiens
  misc_feature: GYAE6OF01DL6X7.21.21.B10.1.454.CMB.1.raw
  modified_base (271)..(320): a, c, t, g, unknown or other
  misc_feature (271)..(320): n is a, c, g, or t
tcagtcgtcgctcgcacgaccggtgctcgatttagtgtcgtcgcaagtaggtagggagggggtcaggctggaacctgaggggcaggtggaggctgacgatgttggcgactttatttttgcatgcgaaaatacagactggccttggacgttcgcctggggaccaggttaggaaatcaaacgaactgtggctcgcaccatctgttccttcactcttccccgcctattcctgacctcgtctcctaactgagcgggtctgggcaagggcgcatgnnnnnnnnnnnnnnnnnnnnnnnnnnnnnnnnnnnnnnnnnnnnnnnnnn

SEQ ID NO: 7419 - DNA, 569 bp, Homo sapiens
  misc_feature: GYAE6OF01DK8B5.21.21.B10.1.454.CMB.1.raw
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaaggtgtccagtgtgaggtgcaactggtggagtctgggggaggcctggtcaagccgtggggggtcccctgagactcttctgtgaagcctctggattcaccttcagtggctatagcatgaactggtccgccaggctccgaggggaaggggctggagtgggtctcatccgttagtagtagtagtagttacatatactacgcagactcagtagaagggccgattcaccatcctcagacgacaacgccaaagactcactgtatctgacaaatgaaatacgccctaggagacggccggaaggaccgacgggcttggtagttattacgtgtggcgaagacggtaaccgttaggggttacggttactttttaaccgtacttactttacgttagttgggttaaacg

SEQ ID NO: 7420 - DNA, 615 bp, Homo sapiens
  misc_feature: GYAE6OF01CDJDS.21.21.B10.1.454.CMB.1.raw
  modified_base (307)..(307): a, c, t, g, unknown or other
  misc_feature (307)..(307): n is a, c, g, or t
tcagtcgtcgctcgcacgaccggtgctcgatttagtgtcgtcgcaaggggggctctgagagaggagccttagccctggattccaaggcctatccacttggtgatcagcactgagcaccgaggattcaccatggaactggggctccgctgggttttccttgttgctgttttagaaggtgtccagtgtgaggtgcaactggtggagtcgtggggggaggcctgggtcaacggccgtggggggtccctggagtactcttctgtgaacgcctctggattcaccttcagtgctatagcatgaactgggtccncgagctccgagggaagggctgggagtgggtctcagtccgttagtagtagtagtagttacatatactacgcagactcgagtggaacggccgattcacatcctccagaacacaacgaccaagaacctcgactagtactacgtagaccaaagtgaaactgacccgtaggaacggacgggacccggaagggaccaaccgggtctggttagttagttaccgtggtacggacggtaaggaccggttaaccggtttaagggggtacgttttaccttttaaccgaactttacctttacgttaggttgggttaacgg

SEQ ID NO: 7421 - DNA, 632 bp, Homo sapiens
  misc_feature: GYAE6OF01CJ0JJ.21.21.B10.1.454.CMB.1.raw
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgcttgttttagaaggtgtccagtgtgaggtgcaactggtggagtcgtgggggaggcctggtcaaggccgtggggggtccctgagactcttctgtgaacgcctctggattccaccttcagtggctatagcatgaacgtcgggtccgccgaggcctccgaggggaaggggcgtgggaggtgggtctcgagttcgttagtagtagtagtagttacatatactacgcagactcgagtaggaacgggtccgtattaccacctattccgtaccaaggaacgaccaaacgccaaacgaacctcacttgtatctagactaaatgaatacgcctaggaagacggcccggtaaggacctacgggtcttggtacgttaacttacgtgtacggaccggtaaggtaaccggttacccgggtttaggggtaccgtttaccttttttaaacctaccgtttactttcgtaaggtttcgggttaacgg

SEQ ID NO: 7422 - DNA, 304 bp, Homo sapiens
  misc_feature: GYAE6OF01CV9TW.21.21.B10.1.454.CMB.1.raw
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (261)..(264): a, c, t, g, unknown or other
  misc_feature (261)..(264): n is a, c, g, or t
  modified_base (266)..(304): a, c, t, g, unknown or other
  misc_feature (266)..(304): n is a, c, g, or t
tcagtcgtcgctcgcacgaccggtgctcgatttagtgtcgtcgcaagagaggagggggtcaggctggaactgaggggcaggtggaggctgacgatgttggcatttatttttgcatgcaaaatacagactggccttggacgttcggcctgggggaccaggttggaaatcaaacgactgtggctgcaccatctgtcttcatcttccgccatctgactcgtctctactgacgcgggctggctaaggcgcatagntgcagcancnnnncnnnnnnnnnnnnnnnnnnnnnnnnnnnnnnnnnnnnnnn

SEQ ID NO: 7423 - DNA, 1039 bp, Homo sapiens
  misc_feature: GYAE6OF01CIMWA.21.21.B10.1.454.CMB.1.raw
  modified_base (156)..(156): a, c, t, g, unknown or other
  misc_feature (156)..(156): n is a, c, g, or t
  modified_base (167)..(167): a, c, t, g, unknown or other
  misc_feature (167)..(167): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactgggctcgctggtttcctgtnctgttagagtntcagtgtgaggtgacaacgtggtggagtcggtgggggacgtccgtggtacgaacggtccggtcgggggtccctggacgtacctcgttcgtaggtacgacgtccttcgtaggtacttaccgtaccgttcgaggtcggtacctagtacgtacgtagttacggtaaccgtcggggttaccccgaccgtacgggtaccgtaaccgggaagggggtacggggtacgttacggggtaacggttccgggtaccgttacgtaccggtttaacccggtttaaggttaacggtttaacggttaaacggtttaacgtttaacgtaacgtttaaacccgttaaaccggttaccgggaaacctttaacggggttaaaccccgtttagggtaaacgggttaacggggtaaacccgggttacccgttaaaccgttaacccgtaaaccggtttaccgttaccccggttaacccggtaaaacgggtaaaccccggtaaacccgtaaaaacccggtaacccgttaaaaccgttaaacccgttaccgttaacccgggttttaaccggtaacctttaaccggtaaacccgttaaaacggtaaaaccggtttaacggtaaaccggtttaacggtaacccggtttaaacgggaaccggtaaacccgggttaacccggggtaacggttaaaccgggtaccgggtttacccgttaacgggttttacggtttaaaccgtttaaccgggttaccggttaaacgggtacccggtaacgggtttaaaaccggggtttaacggggttttaaacccgggggtttaccttttaaaccggttttaaacccgtttacggttaacccggttaacgtttttaaggggtaccggttttaaacccgggg

SEQ ID NO: 7424 - DNA, 719 bp, Homo sapiens
  misc_feature: GYAE6OF01AMN8D.21.21.B10.1.454.CMB.1.raw
tcagtcgtcgctcgcacgaccggtgctcgatttagtgtcgtcgcaaggggcgtctgagagaggagccttagccctggattccaaggcctatccaccttggtgatcagcactgagcaccgaggattcaccatggaactgggctccgctgggtttccttgttgctgttttagaggtgtccagtgtgtaggtgactaacgtggtggagtcgtgggggagccgttggtcgaagccgtgggggtccctgacgtactcttctgtgacgcctctggtattccacttcagtcggctatagctagtgaacgtcgggtcccgccaggcctaccggacggggaaggggcgttacgggaggtaggggttccgtcgtagttccggttagttaggttacggttagttaacggtttactaagttaacgttaaccgtaccgtaccgtaacggtaacctacggtaacgtacggggaacggggtacccgtattaaccgtacccgtaacttccgttacccaagtacgaccgtaacccgaccaaacgaacttaccgacttacgttactaccgtagtacctaacgtaagtaccgtacgaccgttagaacggtaccggacgtacgggaccgtacgacggttagtacggttacgttactgggtacgcggtagtacggtaccggttagggttaccgttacgtttttaacccgtagttaacccttttctaacgttggttacggg

SEQ ID NO: 7425 - DNA, 687 bp, Homo sapiens
  misc_feature: GYAE6OF01A8T1J.21.21.B10.1.454.CMB.1.raw
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaaggtgtccagtgtgaggtgcaactggtggagtcgtgggggaggcctggtcaagccgtggggggtccctgagactcttctgtgaacgcctcgtggtattccacctttcgaggtggctatagctagtgaacgtcgggtcccgccgaggcctaccggagggggaacgggggcgtaggggaggttcggggtcctacgtacgttccggtttaaggttacggttaaggttaaggttaacgtttaactaattaacttaaccgtacgacgacgtactcgaggtaggaacggggccgtacttccaacctacttcctaccgagacgaaccaaccgaccaaagaacctcaacttgtactcgtacgactaaagtgaatacgaccgtaggaacgacggacccggaaggacccgacgggtcttaggttacgttaacttacgtggtacggacggtaaggtacggtaccgggtttaggggtacctttaccgttttaacgtacctttaacgtttcgttaggttgggttaacg

SEQ ID NO: 7426 - DNA, 751 bp, Homo sapiens
  misc_feature: GYAE6OF01DD8AK.21.21.B10.1.454.CMB.1.raw
  modified_base (318)..(318): a, c, t, g, unknown or other
  misc_feature (318)..(318): n is a, c, g, or t
  modified_base (512)..(512): a, c, t, g, unknown or other
  misc_feature (512)..(512): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcacatggactgggctcgcgttggtttccttgttgtcttgtttagagtgtcagtgtgaggtgacacgtggtggagtcggtggggggacggtcgtggtacgaacggtccgggttcggggggtccctaggacgtaccttcgttcgtggtaggaacgtccttcgtggtacttcctaccttcgaggtgacttatacgtnagtacgacgtcgggtaccgccgacggccgtaccggaagggggacggggtcgtaggggtacggtcgggtctacgtacggttacggttaaggtaacggttaggttaacgttacgttaactaattaacgtacgtaacgacgaacgtacgtagaacggtacgggaacggtcctacttaccaccgtactcctaacgganaacgaccctaaacgaactaaacgaccttacgacttagtacgttacgagtaaactaagtagtaacgtacggtcctaaaggggccgtaaccgggtaccgggtaagacccgttacggtcgttaaggttactacgttaggtacggcggtaaaccgttaagggttacccggtttaacgggtttaggggttaacctttttaccctttaaacgttcctttaacgttcgttaagggtaggttacggg

SEQ ID NO: 7427 - DNA, 746 bp, Homo sapiens
  misc_feature: GYAE6OF01CYGGC.21.21.B10.1.454.CMB.1.raw
  modified_base (562)..(562): a, c, t, g, unknown or other
  misc_feature (562)..(562): n is a, c, g, or t
  modified_base (574)..(574): a, c, t, g, unknown or other
  misc_feature (574)..(574): n is a, c, g, or t
  modified_base (616)..(616): a, c, t, g, unknown or other
  misc_feature (616)..(616): n is a, c, g, or t
  modified_base (639)..(639): a, c, t, g, unknown or other
  misc_feature (639)..(639): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggacgtgggctccgtcttgggtttccttgttgtcttgtttagagtgtcagtgtgagtgctacgtggtggagtcggtgggggacggtccgttggtacgaacggtcccgggttcggggggtccctaggacgtaccttcgtttccgtggtacggaacgtccgttccgttaggtactttcctacccgtttcgaggttacgggtcttaagtacgtctagtacggtaaccggtcggggtacccgccgtacggtccgtccgggaagggggtaacgggcgtagggtggttcggtctcgtagttcgttagtaggtgtaaaaagttcgttaactattactactacgactacgactacgaggtaggaacgggtacctagttaccgacctataccctacgaaggtaaccacgtaaaccgaaccaaataacctcaacgtatactnacgaataagtanaacgtcgtacgtagaacgtcggaccgaagggactacccggtnttaacgttagttaacgttacggnggttaccggaggtaagggtaccgggtttaaaccggtttaggggttaaaccgttttcttttaacccgtaacttttacccggttttataaggtttacggggttaacggg

SEQ ID NO: 7428 - DNA, 774 bp, Homo sapiens
  misc_feature: GYAE6OF01DO2N2.21.21.B10.1.454.CMB.1.raw
  modified_base (251)..(251): a, c, t, g, unknown or other
  misc_feature (251)..(251): n is a, c, g, or t
  modified_base (327)..(327): a, c, t, g, unknown or other
  misc_feature (327)..(327): n is a, c, g, or t
tcagtcgtcgctcgcacgaccggtgctcgatttagtgtcgtcgcaagggggctctgagagaggagccttagccctggattcccaaggcctatccacttggtgatcagcactgagcaccgaggattcaccatggaacgtgggcctcccgcttgggtttttccttgttgcttgttttagaaggtgtccagtgtgaggtgcaacgtggtggagtcgtggggggacgccgtggtcaggccggttgggggtccccngagtcctcttcgtgtagaacgccttcgtggtacttccaccctttcagtcggcttatagcatgaaccgtgggtcccnccgagctaccggaggggacggggcgtgggaggtcgggtctacgtacgttaccggttaggtagtaagttggtaagtttacgaatttactaccgtaacgccaacgtacttacgaggtaggtaaacggggccctagtttaccaaccgtacttacccgtaccaacggtaaccgaaacccgaaacgaacccgtaaaacggtaaaccctacccgttaacgttaggttaaccttacgtacgtaacctaaagtaacgttaaacgtaccggtcccgttaaagggaccgtaaccgggtaccgggaaggacccgtaaaccgggttcgttaacgggtcttttaacgttacggtagggtccgtaacggaacgggttaacgggttaacccggtttaggggttaacccggtttaccttttaaccgttaacctttacctttacgttaggttcggtttaacggg

SEQ ID NO: 7429 - DNA, 583 bp, Homo sapiens
  misc_feature: GYAE6OF01A3JHA.21.21.B10.1.454.CMB.1.raw
  modified_base (457)..(457): a, c, t, g, unknown or other
  misc_feature (457)..(457): n is a, c, g, or t
  modified_base (497)..(497): a, c, t, g, unknown or other
  misc_feature (497)..(497): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaaggtgtccagtgtgaggtgcaactggtggagtctgggggagcctggtcaagccgtggggggtccctgagactcttctgtgagcctctggtattcaccttcagtggctatagcatcgaactgggtcccgccgaggcctccgaggggaacggggctagggagtggggtcctcgagttcccgttagtagtagtagtagttacatatactacgcagactacagtaggaacggccgattaccactactcctccaggacgaactaaccgcaacgaactcactgtatcgtanactaaatgaataggcctagacgacgcgaacggacaccggnttacggtagtattaccgagtcggacgagggacgtaccggtttaggggacgttacttttacgtacttacgtttatagtggttaacgg

SEQ ID NO: 7430 - DNA, 649 bp, Homo sapiens
  misc_feature: GYAE6OF01BOIR1.21.21.B10.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (386)..(386): a, c, t, g, unknown or other
  misc_feature (386)..(386): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcacatggaactgggctcgctggttttccttgttgcttgtttagaaggtgtcagtgtgagtgcaacgtggtggagtcgtggggacgcctggtcaagcgtcggggtccngacgactcttgngtggacncgtgnggatcgtacttgngtgctatacgnacgttaggacgtcgggtaccncgacgggtcctaccggaaggggaacgggtcgtagggtaaggtcggtactacgtacgttaccgttagtagttacgtaaggtactaanattaacgtacgtacgactagactacgagtaacgggacggactacgtacctacgtactccgtacgaaggactaaaccgacgaaaccgtaataactactaaccgtagtactacgtacaacgtaaagtaagtaacgtactacgagaacggcgaacggacgtacgacggtacttgtaagttctacggtgaacggcgtaagtaccggtaacgttaggggtaacctttacggtttaaactacgttaagttcgttaaggtcggttaaggg

SEQ ID NO: 7431 - DNA, 807 bp, Homo sapiens
  misc_feature: GYAE6OF01CWGFU.21.21.B10.1.454.CMB.1.raw
tcagtcgtcgctcgcacgaccggtgctcgatttagtgtcgtcgcaagggggctctgagagaggagccttagccctggattccaaggcctatccacttggtgatcagcactgagcaccgagattcaccatggacgtgggctccgcttgggttttccttgttgcttgttttagaaggtgtccagtgtgaggtgacaacgtgggtggagtcggtggggggacgtccgtggtacgaaggtccggttcggggggtcccctggacgtaccttctttcgtggtacgaacgtccttcgtggtactttcccaccgtttcgaggttcggtacttaagtacgtacctaagttacggtaaccggttccggggtaccccgacccggtacgggtacccgtaccgggaagggggtaaacggggtcggttggggtacggttcggggttaccttcgttaacgtttaccggtttaaggttagttaaggttaaggttacgttaactaagttaacctaacgtacgactaacgtacctacgaggtaaggaaccgggtctacgttaccaccgttacgtaccctacgaacggaaccgaaaccgaaacccggtaaccgtaaaacgtaacccgtaccgttaacgtaagttacgtaccgtagaaacttaaaagtgaaaccgttacgtacgaaggtaccggaccggtacccgggaacgtacgaacggtgttaggttacgttacttacggtggtacgaggtaagtaccggttacggttaagggttaccttttaacgttaacccgttaacttagtttacgtaagttgggttaacgg

SEQ ID NO: 7432 - DNA, 715 bp, Homo sapiens
  misc_feature: GYAE6OF01DD4GH.21.21.B10.1.454.CMB.1.raw
  modified_base (556)..(556): a, c, t, g, unknown or other
  misc_feature (556)..(556): n is a, c, g, or t
  modified_base (601)..(601): a, c, t, g, unknown or other
  misc_feature (601)..(601): n is a, c, g, or t
  modified_base (626)..(626): a, c, t, g, unknown or other
  misc_feature (626)..(626): n is a, c, g, or t
  modified_base (633)..(633): a, c, t, g, unknown or other
  misc_feature (633)..(633): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaacgtggggctccgcttgggttttccttgttgcttgttttagaaggtgtccagtgtgaggtgcaacgtggtggagtcgtgggggagcctggtcaacggccgttggggggtccctggacgaccttcttcgtaggtgaacgcctcgtaggactttcctaaccctttcgaacgttgggtaccttaagtacgactaagttaacggaaccgttccggggtcccgaccgtacgggtaccttaaccgggaacgggggaaggggtcctaggggtaggttcgggtctacgtaacgttccggttaaaggtaggttagtaagtacggttaacaagttaataccgtaacgacgaacgtacgttacgaggttacggaacgggtacctattaccaactacttcctaccgaagaccaacgtaacgcctaaaaggtaccnctagtattacgctacggaactaaagtgaactcggactggaaccgngccgtagactacggtttacggttanaacttgnggtacgaacggtagtacggtttaaaccggttaggttacctttaacttttacaaccttagtttacggtaagttgggttaaacg

SEQ ID NO: 7433 - DNA, 766 bp, Homo sapiens
  misc_feature: GYAE6OF01B5L9U.21.21.B10.1.454.CMB.1.raw
  modified_base (664)..(664): a, c, t, g, unknown or other
  misc_feature (664)..(664): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaacgtggggctccgcttgggttttccttgttgtcttgtttagaggtgtccagtgtgaggtgcaacgtggtggagtcggtgggggtaggccgtggtcaacggtccggttacgggggggtccctaggacgtaccttccttcgtagtacggaacgtcctcgttcggtacttcctacctttcgtagggtggtctaagtacgctagtaggaaccggttcggggtcccgccgacgggccgtacgggagggggacggggtcgtgggtaggtcgggtctacgtacgttaccggttaaggttaggttagttacggttacgttaactaacttaactaaccgtacgtaccgaacggtaccgtacggtaagggtacgggaaacgggtacccgttaacttacccgtaacctacgttacccgtaaccggaacgtaacgtaaacccgaaaccccgaaccaaacgtaaccctacctaagttcgttaacgtcgtaacaacgtaaacgttagaacgtacgtccgtaggacggacggaccggaagtaccgnggtactaggttcttacgttgtggtcgacggtacggtacgggttaccggttagggttaccctttacgttttacctaacgtttacctttaggtgttaggtacgg

SEQ ID NO: 7434 - DNA, 678 bp, Homo sapiens
  misc_feature: GYAE6OF01D4R3O.21.21.B10.1.454.CMB.1.raw
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
  modified_base (483)..(483): a, c, t, g, unknown or other
  misc_feature (483)..(483): n is a, c, g, or t
  modified_base (614)..(614): a, c, t, g, unknown or other
  misc_feature (614)..(614): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgcttgttttagaaggtgtccagtgtgaggtgcactggtggagtcgtggggggaggcctgggtcaacggccggttcggggggttccctggacgtaccttcttctgtgaacgcctcgtggtattccgtacctttcgaagttggccttaattagctaatacggtaaaccgttcggggtaccccgccgtacgggtccttacccggaaggggggaacgggggtccgtggggtacggttcgggtcttacgacgttccgtttaaggtagttagtagttacgttacatactacgtacncagtactnagtggaacggcctagttccaactnttcctacgagaacgaaccaaacgccaaagtacctccgaacgtgtaactccgttagaacctaaagtgtaaacgtcgtacctagggaagaccggacccgaagggacccgaggtcttaggtacgtactttacgnggtagccgtaagaggtaccgttagggtactttccttttaacactttacgttactagtggtaacg

SEQ ID NO: 7435 - DNA, 780 bp, Homo sapiens
  misc_feature: GYAE6OF01ARG9W.21.21.B10.1.454.CMB.1.raw
  modified_base (199)..(199): a, c, t, g, unknown or other
  misc_feature (199)..(199): n is a, c, g, or t
  modified_base (495)..(495): a, c, t, g, unknown or other
  misc_feature (495)..(495): n is a, c, g, or t
tcagtcgtcgctcgcacgaccggtgctcgatttagtgtcgtcgcaagggggctctgagagaggagccttagcccgtggattccgaaggcctatccacttggtgatcagcactgagcacgagattcaccatggaacgtggggactcgtcgttagggttttccttggttgcttgttttaagacgtgtccagtgtgaggtgntaacgtggtaggagtcggtgggggtacgtccgtaggtcgtaacggccggttacggggggtccctggacgtaccgttccgttacgttggtacgtaacgtccttacggttggtacctttacccgtacgttaccgtaggtacggtacttacggttaacggcgtaagtcggtaaaccggtccgggtaacccgtccgacggtacgttcccggaaggggtaacgggtcggtaggtacggtgggtactcgtacgtttacgtagttaggtaataggtacgttacgaatacgtacgtacacgtanaccgtcgtaggttacggaccggtaccgtacttacccgaacgtacttaccgacgaacgaacgaaacccaaccgaacgtaaactaacctaccgtagtaactacgtccgaagtaacgtaaacgtagaacgtaacgaccgtacggtaacgaacgtacggaaccgtaccgacggtacgtttaggtaacttacgttacgggtacgtacggtacccggtaaggtaccggttacggttaaggttacggttaaccgttttacctactttaacccgtatttacggtgttaaccgg

SEQ ID NO: 7436 - DNA, 275 bp, Homo sapiens
  misc_feature: GYAE6OF02F3R8V.21.21.B10.1.454.CMB.1.raw
  modified_base (249)..(275): a, c, t, g, unknown or other
  misc_feature (249)..(275): n is a, c, g, or t
tcagtcgtcgctcgcacgaccggtgctcgatttagtgtcgtcgcaagaggtaggaggggtcaggctggaactgagggcaggtggaggctgacgatggttcggcatttattttgcagtgcaaatacagactggccttggacgttcggcctgggaccaggttggaaatcaaacgaactgtggctgcacatcctgtcttcatcttcccgcatctgactcgtctctactgagcgggctggcaaggcgcatagnnnnnnnnnnnnnnnnnnnnnnnnnnn

SEQ ID NO: 7437 - DNA, 280 bp, Homo sapiens
  misc_feature: GYAE6OF02I3L9F.21.21.B10.1.454.CMB.1.raw
  modified_base (254)..(280): a, c, t, g, unknown or other
  misc_feature (254)..(280): n is a, c, g, or t
tcagtcgtcgctcgcacgaccggtgctcgatttagtgtcgtcgcaagaggagagggggtcaggctggaactgaggggcaggtggaggctcgacgatgttggctatttatttttgcatgcaaaatacagactggccttggacgttcggcctggggaccaggttggaaatcaaacgaactgtggctgctaccatctggtcttcatccttcccgccatctgactcgtctctactgagcggctggcaaggcgcatagnnnnnnnnnnnnnnnnnnnnnnnnnnn

SEQ ID NO: 7438 - DNA, 270 bp, Homo sapiens
  misc_feature: GYAE6OF02FN23B.21.21.B10.1.454.CMB.1.raw
  modified_base (253)..(270): a, c, t, g, unknown or other
  misc_feature (253)..(270): n is a, c, g, or t
tcagtcgtcgctcgcacgaccggtgctcgatttagtgtcgtcgcaagagaggagggggtcaggctggaactgagggcgaggtggagacgtgaccgatgttgcattattttgcatgcaaatacagactggccttggacgttcggcctgggaccaggttggaaatcaaacgaactgtggcctgctaccatcctggtcttcatccttcccgccatctgactcgtctcactgagtcgggctggcaaggcgcgatagnnnnnnnnnnnnnnnnnn

SEQ ID NO: 7439 - DNA, 253 bp, Homo sapiens
  misc_feature: GYAE6OF02JSU2R.21.21.B10.1.454.CMB.1.raw
  modified_base (246)..(253): a, c, t, g, unknown or other
  misc_feature (246)..(253): n is a, c, g, or t
tcagtcgtcgctcgcacgaccggtgctcgatttagtgtcgtcgcaagaggagaggggtcgaggctggaactgagggcaggtggaggctgacgatgttggcatttattttgcatgcaaatacagactggccttggacgttcggcctggggaccaggttggaaatcaaacgaactgtggctgcaccatctgtcttcatcttcccgccatctgactctctctactgagcgggctggcaaggcgcatagnnnnnnnn

SEQ ID NO: 7440 - DNA, 516 bp, Homo sapiens
  misc_feature: GYAE6OF02H6JIP.21.21.B10.1.454.CMB.1.raw
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggtttccttgttgctgttttagaaggtgtccagtgtgaggtgcaactggtggagtctgggggaggcctggtcaagcctggggggtccctgagactcttctgtgaagcctctggattcaccttcagtggctatagcatgaactgggtccnccaggctccgagggagggctggagtgggtctcatccgttagtagtagtagtagttacatatactacgcagactcagtgaagggccattcaccatctccaganacaacgccaagaactcactgtatctgcaaatgaatgcctgagagccgagacacggctgtgtattacgtgtgcgagagtaccgttagggtagtcttttacacttacttctagtggtag

SEQ ID NO: 7441 - DNA, 522 bp, Homo sapiens
  misc_feature: GYAE6OF02HVGZJ.21.21.B10.1.454.CMB.1.raw
  modified_base (465)..(465): a, c, t, g, unknown or other
  misc_feature (465)..(465): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaaggtgtccagtgtgaggtgcaactggtggagtctgggggaggcctggtcaagcctggggggtccctgagactcttctgtgaagcctctggattcaccttcagtggctatagcatgaactgggtccgccaggctccgagggaaggggctggagtgggtctcatccgttagtagtagtagtagttacatatactacgcagactcagtgaagggccgatcaccatctccagagacaacgccaaagactcactgtatctgacaaatgaatagcctagagagccgaggacacggctgngtattactgtgcgagacgtaccttagggagtcttttactacttacttctatggtacg

SEQ ID NO: 7442 - DNA, 515 bp, Homo sapiens
  misc_feature: GYAE6OF02GG9SU.21.21.B10.1.454.CMB.1.raw
  modified_base (469)..(469): a, c, t, g, unknown or other
  misc_feature (469)..(469): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaaggtgtccagtgtgaggtgcaactggtggagtctgggggaggcctgggtcaagcctggggggtccctgagactcttctgtgaagcctctggattcaccttcagtggctatagcatgaactggtccgccaggctccagggaagggctggagtgggtctcatccgttagtagtagtagtagttacatatactacgcagactcagtgaagggccgatcacatctccagagacaacgccaagaactcactgtatctgacaaatgaatagcctagagagccgagacacggctgtgtattacngtgcgagagaccttagggtagtcttttacacttacttctatggtag

SEQ ID NO: 7443 - DNA, 458 bp, Homo sapiens
  misc_feature: GYAE6OF02FZQKY.21.21.B10.1.454.CMB.1.raw
  modified_base (257)..(257): a, c, t, g, unknown or other
  misc_feature (257)..(257): n is a, c, g, or t
  modified_base (263)..(266): a, c, t, g, unknown or other
  misc_feature (263)..(266): n is a, c, g, or t
  modified_base (269)..(269): a, c, t, g, unknown or other
  misc_feature (269)..(269): n is a, c, g, or t
  modified_base (273)..(274): a, c, t, g, unknown or other
  misc_feature (273)..(274): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (362)..(363): a, c, t, g, unknown or other
  misc_feature (362)..(363): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
tcagtcgtcgctcgcacgaccggtgctcgattttagtgtcgtcgcaagtaggtaggagggggtacaggctggaactgaggggacaggtcggagggctgacgatgttggcatttattttgcatgacaaatactagacttggccttgggacgttcggcctggggaccaggttggaatcaaacgactgtgctgcaccatctggtcttcatccttacccgcatcgtcgactcgtcgtctactgacgcgggctggcaaggcncatagnnnngtnatgnngcgcngngcagctgagngngngngncncnctntnacacacacacncacanagcgngnancncacacacanananananatananangnnanananacntcncncagagacncgtctctctngngngagtatanatananatntctctctctctctctcgtcgtctacgaccgtaccgtccnctc

SEQ ID NO: 7444 - DNA, 553 bp, Homo sapiens
  misc_feature: GYAE6OF02IRD8N.21.21.B10.1.454.CMB.1.raw
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaaggtgtccagtgtgaggtgcaactggtggagtctgggggaggcctggtcaagcctggggggtccctgagactcttctgtgaagcctctggattcaccttcagtggctatagcatgaactgggtccgccaggctccgaggggaaggggctggagtgggtctcatccgttagtagtagtagtagtacatatactacgcagactcagtgaagggccgattcaccatctaccagacacaacgccaaagaactcactgtaatctgactaaatgaatagcctagagagccgaaggaccacgggtactggtagtaacgttacgtgtggacgaggtaacgtaccgttaaggggtagtccttttaacgtacttaccttctagtggttacg

SEQ ID NO: 7445 - DNA, 550 bp, Homo sapiens
  misc_feature: GYAE6OF02I80OB.21.21.B10.1.454.CMB.1.raw
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
  modified_base (471)..(471): a, c, t, g, unknown or other
  misc_feature (471)..(471): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaaggtgtccagtgtgaggtgcaactggtggagtcgtgggggaggcctggtcaagccgtggggggtccctgagactcttctgtgaagcctctggattcaccttcagtggctatagcatgaactggggtccgccgaggctccgaggggaaggggctggaggtgggtctcgatccgttagtagtagtagtagttacatatactacgcagactcagtagaacgggcgtattcacatcncagagacaacgcaagacncatntatctgacaaatnaactagcctagacgagaccgacgacgacggntgtagtattactggtgcgaagtacgtaacgtttagggtaggttacttttacgtaaccttacttacgttagtgggttaag

SEQ ID NO: 7446 - DNA, 587 bp, Homo sapiens
  misc_feature: GYAE6OF02JB7MW.21.21.B10.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (515)..(515): a, c, t, g, unknown or other
  misc_feature (515)..(515): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgtttagaggtgtccagtgtgaggtgcaacgtggtggagtcgtgggggaggcctggtcaagccgtgggggtccctgagactcttctgtgaagcctcgtggtattcaccttcaggtcggctagtagcagtacgaacgtgggtcccnccgaggcctccgagggacggggctgggagtgggtcnctacgtcgttagtagtagtagtagtactatatacgtacgcagtactcgagtcggaacgggtccgtatccgacctacttccaacccgagacgaaccgaaccgaccgaaagtaacctcgactagtaactcgtacgaactaatcgaatcgactagagaccgcggagacacggtntgtgtacttcgtgacgtagagtacgtaaccgtttagggacgttctttactacctcgtttactagtggtaacg

SEQ ID NO: 7447 - DNA, 604 bp, Homo sapiens
  misc_feature: GYAE6OF02F2RT4.21.21.B10.1.454.CMB.1.raw
  modified_base (367)..(367): a, c, t, g, unknown or other
  misc_feature (367)..(367): n is a, c, g, or t
  modified_base (409)..(409): a, c, t, g, unknown or other
  misc_feature (409)..(409): n is a, c, g, or t
tcagtcgtcgctcgcacgaccggtgctcgatttagtgtcgtcgcaaggggggctctgagagaggagccttagccctggattccaaggcctatccacttggtgatcagcactgagcaccgaggattcaccatggaactggggctccgctgggttttcctgttgctgttttagaggtgtccagtgtgaggtgcaactggtggagtcgtgggggaggcctggtcaagccgtggggggtccctgagactcttctgtgaacgcctcgtggattcaccttcagtggctatagcatgaacgtgggtcccgccaggcctccgaggggaacgggctgggaggtggtctcattccggttagtagtagtagtagttanatatactagcagactagagtagaacgggcctatccacatccncaagacgaaccaacgaccaaagtacctacgacttgttaactcgtagactaaatcgaaatcgcctaggaagacgacccggaaggaaccgacggtcgttaggtacgttagttacgtggtacggaacggaaggtaccggttaaccggtttaggggtaccgttacttttacgaacctttacttcgttagtggttaacgg

SEQ ID NO: 7448 - DNA, 602 bp, Homo sapiens
  misc_feature: GYAE6OF02FW9ZV.21.21.B10.1.454.CMB.1.raw
  modified_base (346)..(346): a, c, t, g, unknown or other
  misc_feature (346)..(346): n is a, c, g, or t
  modified_base (467)..(467): a, c, t, g, unknown or other
  misc_feature (467)..(467): n is a, c, g, or t
  modified_base (476)..(476): a, c, t, g, unknown or other
  misc_feature (476)..(476): n is a, c, g, or t
  modified_base (505)..(505): a, c, t, g, unknown or other
  misc_feature (505)..(505): n is a, c, g, or t
  modified_base (513)..(513): a, c, t, g, unknown or other
  misc_feature (513)..(513): n is a, c, g, or t
tcagtcgtcgctcgcacgaccggtgctcgatttagtgtcgtcgcaagggggctcgtgagagaggagccttagccctggattccaaggcctagtccacttggtgatcagcactgagcaccgaggattcaccgatggaactggggctccgctggttttctgttgctgtttagaggtgtccagtgtgaggtcgcaacgtggtggagtcgtgggggaggccgtggtcgaacggtccggtcgggggggtccctggacgtacttcttcgtggtgaacgcctcgtggattcaccgtcgaggtggctatagcagtcgaacgtcggtccgcgaggctccgaaggggagggctggnggtgggtctcgatccgttagtacgtagtagttagttacatatactacgcagtactacgaggtagaacggcgtactcactatcgccagacgacaacgtacaactacacactgtactgtacanaaatgtaanacgctagagacggaccggtagacgtacgnttacggtnttacttacggtgtacggcgtaacgtgggtaacccgttaggggttacttacgttttactacgtttaccgttacgtttagtgggtttacgg

SEQ ID NO: 7449 - DNA, 616 bp, Homo sapiens
  misc_feature: GYAE6OF02GBOQY.21.21.B10.1.454.CMB.1.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (506)..(506): a, c, t, g, unknown or other
  misc_feature (506)..(506): n is a, c, g, or t
tcagtcgtcgctcgcacgaccggtgctcgatttagtgtcgtcgcaagggggcgtcgtgagagaggagccttacgccctggattccaaggcctatccacttggtgatcagcactgagcaccgaggattcaccatggaactgggctcgctggtttctgtgctgtttagaggtgtcagtgtgaggtgcaacgtggtggagtcgtgggggaggcctggtcaagccgtggggggtccctggagactcttcgtgtgaagcctcgtgtacttcaccttnagtcggctatagcatgaacgtgggtccncgaggctccgaggggacgggctgggaggtcgggtctcgagtccgttagtagtagtggtagttacatatactacgcagactagagtaggaacggaccgtattaccaccgatcgtaccgaggaacgacgaacgcaaacgtactacactagtactacgtgactaaatgaaactcggtacctaggaacgacgtaccggaaggctaacggngttacggttagttacttcgtaggtaccggacgaaggtaaccggttaccgttagggggttacttaccgttttaacggtaaccttacgtttaccgttaggtacggttaacgg

SEQ ID NO: 7450 - DNA, 626 bp, Homo sapiens
  misc_feature: GYAE6OF02F5NFN.21.21.B10.1.454.CMB.1.raw
  modified_base (298)..(298): a, c, t, g, unknown or other
  misc_feature (298)..(298): n is a, c, g, or t
  modified_base (370)..(370): a, c, t, g, unknown or other
  misc_feature (370)..(370): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaaggtgtccagtgtgaggtgcaactggtggagtcgtgggggaggcctggtcaagccgtgggggtccctgagactcttctgtgaagcctctggattcaccttcagtggctatagcatgaactggtccncaggctcgagggagggcgtggagtggctcatcgttagtagtagtagtagtacattagtactacgcagtactnagtgaagggtccgacttcactatctaccagacgacaacgacaaagacctcactgtactctgaccaaagtgaatacgtccgtaggaacgtacgggacccggaagggaaccgtaccgggtacgtttcggtacgttaacgttttacgtacggtgggtaaccggaagggttaaccggtacccggttttaagggggtaaccgtttacccgtttttaaccggtaaccgttaccttttacggttaagttacggggtttaacgg

SEQ ID NO: 7451 - DNA, 742 bp, Homo sapiens
  misc_feature: GYAE6OF02J0JZL.21.21.B10.1.454.CMB.1.raw
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaggtgtccagtgtgaggtgcaactggtggagtcgtgggggagcctggtcaaggccgtgggggtccctgagactctctagtgagtcctacgtggtattcgaccttcgagtggcttatagctagtacgaacgttcgggtacccgccgaggccgtaccggaaggggaaggggtccgtgggtaagggttcgggtaccttacgaacgttcccggttaaggttacggtacggttagttacgttaaccgtattacgtacgtaccgagaggtcctagtaggtaggaacgggtcctacttaccgacctactccgtacacgaacgaccgaaccggacctaaggtaacctcctaacgtcgttactacgtcgaactaaactagaaacgtagaccggttaggaaccggtacgggtaacccgggaacggacggtaaacccgggttacgtacgggtttacgtttaaccgtttacggtacggtacggaacggtaacgggtaacgttaacccgggttaaggggtttacggttacccgtttttaacccggtaactttaccgttttaagttacggtttacggttaacggg

SEQ ID NO: 7452 - DNA, 577 bp, Homo sapiens
  misc_feature: GYAE6OF02GN9Z8.21.21.B10.1.454.CMB.1.raw
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
  modified_base (459)..(459): a, c, t, g, unknown or other
  misc_feature (459)..(459): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactggggctccgctgggttttccttgttgctgttttagaaggtgtccagtgtgaggtgcaacgtggtggagtcgtgggggagccgtggtcaagccgtggggggtccctgngactcttctgtgacgcctcgtggtatcaccttcagtcggctagtagcatgaacgtggtccgccaggctccgaggggacgggntgggagtgggtctcacgttcgttagtagtgtaagtagttacatatacacgcagtactcagtgagggccagttccacntcncganagaaccacgcaaagaactccacgngttactctgaaccaaagtgaagtacncgtagaacgtacgaccggtagaccgacggcttaggagttaatccgtaggtgcggaagtaaccggttgtttaacgggtattacgtttttaccaaccgtttctagttacgttaggtacgg

SEQ ID NO: 7453 - DNA, 671 bp, Homo sapiens
  misc_feature: GYAE6OF02IC2BF.21.21.B10.1.454.CMB.1.raw
  modified_base (186)..(186): a, c, t, g, unknown or other
  misc_feature (186)..(186): n is a, c, g, or t
  modified_base (562)..(562): a, c, t, g, unknown or other
  misc_feature (562)..(562): n is a, c, g, or t
tcagtcgtcgctcgcacgaccggtgctcgatttagtgtcgtcgcaagggggctctgagagaggagccttagccctggattccaaggcctactccacttggtgatcacgcactgagcaccgaggattcaccatggaactgggctccgctggtttccttgttgctgtttagagtgtcagtgtgaggtncaatggtggagtcgtggggaggcctggtcaagccgtgggggtccctgagactcttctgtgaagcctcgtggtattccaccttcgagtggactatagctagtgtaacgtcgggtcccgaccgaggccgtccggaaggggagggcgtaggaggtcggtctcgacgttccgtagtagtagtagtagtactatatactacgactacgtactacgagtagggaacgggcctaagttccaaccgtatccgaccgtaaggaacgaaccgaaccggacctaaaacggtaacctcgaacgttagtaactcgtaacgaacctaaagtcgaaacttcgacccgttaaggacgtaaccgggacccggaacggaccgtaaccggggttnttacggttaacgtacgttacgtggtacggaacgtacggtacggttaacggtttacgggtttacgttaaccttttacgtacctttaaccgtttagttacgtaggttacgg

SEQ ID NO: 7454 - DNA, 677 bp, Homo sapiens
  misc_feature: GYAE6OF02HLXF3.21.21.B10.1.454.CMB.1.raw
  modified_base (304)..(304): a, c, t, g, unknown or other
  misc_feature (304)..(304): n is a, c, g, or t
  modified_base (461)..(461): a, c, t, g, unknown or other
  misc_feature (461)..(461): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcacatggaactgggctccgctgggttttccttgttgcttgtttagaaggtgtccgagtgtgaggtgacaacgtggtggagtcgtggggaggcctggtcaagccgtgggggtccctggagactcttctgtgaagcctctggacttcacttcagtgcgtatagcagtgaactggggtacccncaggccttccgaaggggacgggcgtaggacggttcgggtctcgtagttccggttaagtacggtagttaggttacgtttaacgaacgttaattacgtaccgacgtaacgtaaccgttcgtaagggttacgaaacggggtcccgtaagtcccgtaaacnctttaccgtaccaaaggttaaccgaaccgaagtaccaaacgaaaccttcgaaccgttagttactcgacgtaacaagtagaacgttacgcctagggacgtcgaccgacggactccgggactgttacgttacgtcgtagtacggcggtaacgacgttaccggttaggttacgttaccctttttacgaaccgttccgtttaacgtggttacctaacggg

SEQ ID NO: 7455 - DNA, 364 bp, Homo sapiens
  misc_feature: GYAE6OF02F63NN.21.21.B10.1.454.CMB.1.raw
  modified_base (173)..(173): a, c, t, g, unknown or other
  misc_feature (173)..(173): n is a, c, g, or t
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (310)..(364): a, c, t, g, unknown or other
  misc_feature (310)..(364): n is a, c, g, or t
tcagtcgtcgctcgcacgaccggtgctcgatttagtgtcgtcgcaagagaggagggggtcaggctggaactgaggggcaggtggaggctgacgatgttggcatttattttgcatgacaaaatacagactggccttggacgttcggcctgggaccaggttgaatcaaagactgnggactgcaccntctgtctcatcttcccgacatcncgtactcgtctctactcgacggcggtnagggtcaagggtcgaccgtaagtacngtncaatgaactcaagtcaacngccaattggancttagcatcctgcttannnnnnnnnnnnnnnnnnnnnnnnnnnnnnnnnnnnnnnnnnnnnnnnnnnnnnn

SEQ ID NO: 7456 - DNA, 698 bp, Homo sapiens
  misc_feature: GYAE6OF02F5GXO.21.21.B10.1.454.CMB.1.raw
  modified_base (410)..(410): a, c, t, g, unknown or other
  misc_feature (410)..(410): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcaccatggaactgggctccgctggttttccttgttgcttgttttagaaggtgtccagtgtgaggtgacaacgtggtaggagtcgtgggggaggccgtggtcaacgccgtggggggtccctgagactcgttctgtgaacgcctcgtgtattccaaccttcagtggactatagcatggaacttcgggccaccgaggtctacccggaggggaacgggcgtagggaggtcgggtctacgagtttccgttaggtacgttaagtaggttacttaacagttaactacctacgntacgaactcgagtacgaacgggcctaacttccacctgtacccgtaccgtaagaacgaaccgtaaccgaacccgaaagaaacccttaccgtaacgtttagttacgttccgttaacgaaccctaaagtacgtaaacgaccgtacgttagggacggtaacggaccggaacggtaaccgaggtaccgttagtacgttaacttaccgtggtacggcggtaacggtacggttaccggttaagggttaccgttacctttttaacgtacgtttacttacgttagttaggttaacgg

SEQ ID NO: 7457 - DNA, 712 bp, Homo sapiens
  misc_feature: GYAE6OF02JHAA4.21.21.B10.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagtgtcgtcgcaagggggctctgagagaggagccttagccctggattccaaggcctatccacttggtgatcagcactgagcaccgaggattcacatggacngggctcgctggtttcctgttgctgttttagaaggtgtccagtgtggaggtgcaactggtggaggtcgtgggggaggctggtcaagccgtgggggtccctggagacttcttcgtgtagagcctcgtggtatcctccgttcgaggtggtactagtacgcataggtaacgtcgggtacccgtcccgaggccgtaccggacggggaacggggtcggtagggtaggtcggggttaccgtcgtacgttacgttaggttagtaggttacggtagttacagttataccgtacgtacgacgacgtactaggtacggtaacggaccggtacttacccgactactccgtaaccctagtaacgaaccgtaacgacctaagaccctacggtactaggttactccgtaactagtaacaggtaactacgaccgtagtaggaccgtacgacgggtacgacgttactgttaacgtttacgttacgtacggtacggtggacggtaaggtttaacccgggtaacggttttaaccgggtttaccttttaaccgtttaacccggtacgtttttaaccgtagggttaggtttaacccggg

SEQ ID NO: 7458 - DNA, 825 bp, Homo sapiens
  misc_feature: GYAE6OF02JAM8N.21.21.B10.1.454.CMB.1.raw
  modified_base (292)..(292): a, c, t, g, unknown or other
  misc_feature (292)..(292): n is a, c, g, or t
  modified_base (566)..(566): a, c, t, g, unknown or other
  misc_feature (566)..(566): n is a, c, g, or t
tcagtcgtcgctcgcacgaccggtgctcgatttagtgtcgtcgcaaggggcgtctgagagaggagccttagcctggattccaaggctatccacttggtgagtcagcactgacgtcaccgaggattcaacctagtggaacgtggggcctaccgcttgggtttccttggttgcttagtttagaaggttgtacctagttgtggaggttagctaacgtggtacggtagtccggtgggggacgtccttagggtaccaaggtccggtacggggggtacccttagacgtacttccgttntacggtagaaccgtccgtagtcggtacgttacctaccgttcgtaggtgtacttaagtgacgtagtacgtacggtccggtacccgacgacggtacctaccggtaacggggtaacgggtactaggggtacggtttaccgggcttaaccgtcgttaaccggttaagttacgggttaactaagggtttacgtaagtaactacggttaacgtaccgtacgtacgattaccggagttaacgggaacggtctaaggttaccactacgtacccgtacgtaanaacggaacctaccgtaactaaaccggacctttacgaacgtttaccggaaatttccggtaactaactaaacgtacggtaagtacccctaacgggtagtaccggtaaacgtacccgggtaagtacccggttaaccgtacggtttaacgtgttaacgttttaccgcggttacggaccgttaaggaacccgtaagggtttaacggttaacggtaccttttaaccgtaaacgttttacgaacgtttaccggtgtaaccccgggg

SEQ ID NO: 7459 - DNA, 520 bp, Homo sapiens
  misc_feature: GYAE6OF01BY3YK.19.5.A05.1.454.CMB.1.raw
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagntgtggcgtctattactgtacaacaatattanagaaaggttccggggaactttccgggcccttagggactaagggtggagatcgaagacgaacgttggtaggcctggccaaccgtattacgtgttcttcgacttcccg

SEQ ID NO: 7460 - DNA, 512 bp, Homo sapiens
  misc_feature: GYAE6OF01B1U47.19.5.A05.1.454.CMB.1.raw
  modified_base (426)..(426): a, c, t, g, unknown or other
  misc_feature (426)..(426): n is a, c, g, or t
tcagtactctcgtgcacgaccggtgctcgatttagatagatagacagggcaggggcagcaagatggtgttgcagacccaggtcttcatttctctgttgctctggatctctggtgccttcggggacatcgtgctgacccagtctccagacacactggactgtgtctctgggcgaggagggccaccatcaactgcgaggtccagcgagaggtatttgacagacccaacagtaagaactacttggcttggtatcagtcagaaaaccaggacagcctcctaaactgctcatttagttggcagtcgtacccggaattggggtccctgttcgattcagcggcagcgtgtctgggacagtatttcgactctcaccatcagcagccctgcaggctagaagatgtggcgttctattactgtacaactaatattanagaacgtccgagggtacctttcggcccttgggtactaagggtgagatacgagacgtaatggtggctgcacctatctgtcttctacg

SEQ ID NO: 7461 - DNA, 497 bp, Homo sapiens
  misc_feature: GYAE6OF01AT0P9.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcgtctattactgtacaacaatattatagaagtccagggtactttcggcctagggactaaggtggagatacgagacgaatggtcggcttagcaccatctgtcttctacg

SEQ ID NO: 7462 - DNA, 482 bp, Homo sapiens
  misc_feature: GYAE6OF01ATNSD.19.5.A05.1.454.CMB.1.raw
  modified_base (478)..(478): a, c, t, g, unknown or other
  misc_feature (478)..(478): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcgtctattactgtacaacaatattatgaaagtccagggtactttcggccctgggactaaggtgagatcagcgatgtgctgcacatctgtntctc

SEQ ID NO: 7463 - DNA, 499 bp, Homo sapiens
  misc_feature: GYAE6OF01EVS1Y.19.5.A05.1.454.CMB.1.raw
  modified_base (480)..(480): a, c, t, g, unknown or other
  misc_feature (480)..(480): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctagaagatgtggctgtctattactgtacaactaatattaatagaaacgtccgaagggtacctttcggcccttagggactaagggtgagatcgagagaactgnggctgacacatctgtcttc

SEQ ID NO: 7464 - DNA, 576 bp, Homo sapiens
  misc_feature: GYAE6OF01EATG6.19.5.A05.1.454.CMB.1.raw
  modified_base (289)..(289): a, c, t, g, unknown or other
  misc_feature (289)..(289): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcggtgtaagcttctggattcaggtttacacatattggatcggctgggtgcgccagcagcccgganaaggcctggagtggatgggaatcatctatcctggagactctgatgccagatacacttccgtccttacaacggccgagtccacctactttcacgccgaacaacgtccactcacgccacccgcctacctcgcacgtacggaacacgcctacggaccggccgtaccgggaccgacggccgggcgttaccgtaacgtttacgtcggtcgccggacgtcaactttacgaaaagttggggtacggggtcgggtacggtagggggtttcgggtttttggtaggttttaccgggg

SEQ ID NO: 7465 - DNA, 525 bp, Homo sapiens
  misc_feature: GYAE6OF01ARFLZ.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagccggacaaggcctggagtggatgggaatcatctatcctggagactctgatgccagatacactccgtccttaccgaaggccgagtcacctattcacgccgacagtcatcagcaccgcctacctcgcacgtcgaacacgcctacgaccggccgtacggaccgacgcggcgtctacgttacgtgtcgcgtacgactacgttcgaaagtgggtacggcggacgtagggttggtttggtgtttcggg

SEQ ID NO: 7466 - DNA, 720 bp, Homo sapiens
  misc_feature: GYAE6OF01DHXC5.19.5.A05.1.454.CMB.1.raw
tcagtactctcgtgcacgaccggtgctcgatttagatagatagacgaggcaggggcagcaagatggtgttgcagaccctaggtcttcatttctctgttgctctggatctctggtgccttcgggacagtcgtggctgacccagtcgttccagacacacttggctgtcgtctcgtgggcgaggacgggccaccagtcaactgcggaggtccaggccgagtacgttagttttcgacacgacccaactacgtaagaactacttggcttggtatcagactaagaaacctaggacacgtcctacctaaacgtcgcctacgtactttacgttggggactagtaccggtaaccgggtaagttcggggtccctaggtccgtaagttcgaacggcggtacgaaggtcgtagtacgtaggactagtacttcactctacaccgtatacacgccacgtcctagaccgtaggacctaaggaacgtagtacgggtacggtacggttacttaacgtttaccgtacgtaacctaaaacgttaattaacgttaacgtaacggtaaaccggttaccggtaacggggttaccccgttttaccggggaccccgttaacggggtaccgttaaagggttcgggtaaagttaacgttaccgaaacggttaacccggaagtttcgggcggtaccgtacggaaccgtaaaccggtagttaacgttcggtttacgttccgtacccgg

SEQ ID NO: 7467 - DNA, 523 bp, Homo sapiens
  misc_feature: GYAE6OF01EEMV2.19.5.A05.1.454.CMB.1.raw
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggatctctgaggatctcgtgtaagacttctggattctaggtttactacatattggatcggctgggtncgcagcagcccgganaaggctggagtggatgggaatcatctatcctggatactctgatgccagatacactccgtctccaaggccagtcactattcacgcgacaagtcatcacgcaccgcctacctcgcagtacggaacacgccgtgaccggccgtacggacgacggcggcgtacgtacttacgtcgtgcgacgctattacgaaaagtggggtacgggcggtacgtaggggtttggtttggtgtttcggg

SEQ ID NO: 7468 - DNA, 510 bp, Homo sapiens
  misc_feature: GYAE6OF01C8KYJ.19.5.A05.1.454.CMB.1.raw
  modified_base (292)..(292): a, c, t, g, unknown or other
  misc_feature (292)..(292): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggtattcaggttttactacatattggatcggctgggtgcgccagcagcccgganaaggcctggagtggatgggaatcatctatcctggagactctgatgccagatacactccgtccttcaacggccagtccactatttcacgccgacaagtccatacagccaccgcctacctcgcagtcgaacagcctgacggccgtcggacacgcggcgtctacttacngtgcgagnattacaaagtgggtggcggacgagggttggtttgtgtttacggg

SEQ ID NO: 7469 - DNA, 505 bp, Homo sapiens
  misc_feature: GYAE6OF01BXR59.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggtatcagcagaaaccaggacagcctcctaaactgctcatttatggcatctacccgggaattgggtccctgtccgattcagcggcagcgtgtctgggacagatttcactctcaccatcagcagcctgcaggctagaagatgtggcgtctattactgtacaactaatattatagaaagtccgtagggtactttcggccgttagggactaagggtggagtactcgaaggacgtaacgtggtcggctgcctacatctgtcttcgtac

SEQ ID NO: 7470 - DNA, 570 bp, Homo sapiens
  misc_feature: GYAE6OF01DZ2OB.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagcccggacaagggcctggagtggatgggaatcatctatccgtggagactctgatgccagatacactccgtccttccgaaggccgagtcaccatttcacgccgacaacgtccatcacgccacccgtcctacctcgcaggtacgaacgacgaccgtcggaccggacccgtcggacgacggccggtacgtcttacgttacgtggtcggcggacgtactaacgttaacgaaaacggttggggtacgggtcgggtacgggtaggggtttgggttttggtaggttttaccgggg

SEQ ID NO: 7471 - DNA, 488 bp, Homo sapiens
  misc_feature: GYAE6OF01CHSUW.19.5.A05.1.454.CMB.1.raw
  modified_base (383)..(383): a, c, t, g, unknown or other
  misc_feature (383)..(383): n is a, c, g, or t
  modified_base (480)..(480): a, c, t, g, unknown or other
  misc_feature (480)..(480): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattggcatctacccggaaattggggtccctgtccgattcagcgcagcgtgtctggacagatttcactctcaccatcagcagcctgcaggctgaagatgnggcggtctattactgtacaaacaatattatgaaagtccagggtactttccggcctgggactaaggtgagatcgagacgactgtggctgctacatctntcttcgac

SEQ ID NO: 7472 - DNA, 596 bp, Homo sapiens
  misc_feature: GYAE6OF01B1MAA.19.5.A05.1.454.CMB.1.raw
  modified_base (292)..(292): a, c, t, g, unknown or other
  misc_feature (292)..(292): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggatctctgaggatctcgtgtaagacttcgtggattcaggtttactacattattggatcggcgtgggtgcgccagcagcccgganaaggcctggagtggagtgggaatcatctagtcctggagactctgatgccagactacacgtcccgtccttacgaacggccgagtccacctattacgacgaccgactacgtaccatcacgccacccgccctaccgtcgacgacgtacggaacgacgccgtacggaccggcccgtaccgggaccacggccggtccgttacgttacgttacgtcggtcggtaccggagtacgtaacgttaacgaaaaggttcggggtacgggtacgggtacggttaggggtttgggtttttggttacggtttccgggg

SEQ ID NO: 7473 - DNA, 506 bp, Homo sapiens
  misc_feature: GYAE6OF01A1RBK.19.5.A05.1.454.CMB.1.raw
  modified_base (460)..(460): a, c, t, g, unknown or other
  misc_feature (460)..(460): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagcccggacaaggcctggagtggatgggaatcatctatcctggagactctgatgccagatacactccgtcttccgaaggccgagtcacctatttcacgccgacaacgtccatcagcaccgcctacctgcagtgaacacgcctgacggccgtcggacagcggcgtctagttactgtgcgngcattcaaagtgggtcgggcggcgtagggttggtttgtgtttcggg

SEQ ID NO: 7474 - DNA, 575 bp, Homo sapiens
  misc_feature: GYAE6OF01DQ8WL.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtgaggaaggcccggggatctctgaggatctcgtgtaagacttctggattcaggtttactacatattggatcggctgggtgcgcagcacgcccggacaaggcctggagtggagtgggaatcgatctatccgtggagactctgagtgcagactacactcccgtcctccgaacggccgagtcacctacttcacgccgacaacgtccatcacgccacccgcctacctcgccagtcggaacacgccgtacgaccggccgtccggaccgacggccgggaccgtccgttaagttaccgtggtcggcgacggactaagtttacgaaaaggttcggggtacgggtccgggtacggtagggggtttgggttttgggtagttttccggggg

SEQ ID NO: 7475 - DNA, 673 bp, Homo sapiens
  misc_feature: GYAE6OF01EBR0P.19.5.A05.1.454.CMB.1.raw
  modified_base (237)..(237): a, c, t, g, unknown or other
  misc_feature (237)..(237): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgaggacgggccaccatcaactgcaggtccagcgagtagttattttgaacacgaacccaacagtaaanaactacttggtcttaggtatcagacaacgaaacaggacacgacctacctaaactcgctactaagtttagtcgggactacgtaccgtaacccggggtaaagtttcgggggtccccttcggttaccgattccgagccggcaggtcgtagtcgtgggactagtacttcactctacacctatcagcacgcctagacgtaggactagaagtagtcggtaggtcgttacttaagttacgtagtaaccaaacttaattaagttaagtaacggtaaacgtaccggtaacggggttaccgtttaccgggacccggttaagggtaaccggttaagggtacgggtaacgtaccgtaacggaacggtaaacggtaacggttcgggtacgggtaccgtacggaaccctaacgtacgttacccgtttacggttccctttccgttaacccg

SEQ ID NO: 7476 - DNA, 542 bp, Homo sapiens
  misc_feature: GYAE6OF01DFVSG.19.5.A05.1.454.CMB.1.raw
  modified_base (331)..(331): a, c, t, g, unknown or other
  misc_feature (331)..(331): n is a, c, g, or t
  modified_base (439)..(439): a, c, t, g, unknown or other
  misc_feature (439)..(439): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggatctctgaggatctcgtgtaagacttctggattcgtaggtttactacatattggatcggctgggtgcgcagcagcccggacaaggccgtaggagtggagtgggaatcgatctatccgtgganactcgtgatgccagactacacctccgtccttcgaaggtccgagtccacctactttccacgccgaacaacgtccactcacgccaccgtccctaccgtgcagtacgaacncgccgtcgaccggccgtacggacgacgcggcgttcgtattacgtgtcgcgagtcagttacgaaagtgggtcggcgggtcgtaggggttgtttggtgtttcggg

SEQ ID NO: 7477 - DNA, 519 bp, Homo sapiens
  misc_feature: GYAE6OF01BRJ2Z.19.5.A05.1.454.CMB.1.raw
  modified_base (223)..(223): a, c, t, g, unknown or other
  misc_feature (223)..(223): n is a, c, g, or t
  modified_base (389)..(389): a, c, t, g, unknown or other
  misc_feature (389)..(389): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagaccccaanagtaagaactacttggcttggtatcagcaagaaaccaggacagcctacctaaactgctcatttattggcatcgtaccgggaattcggggtccctgtccgattcgagcggcagcgtgtctgggacagtactttcactctcaccatcagcagcctgcaggctgaagtntggtggcgtctattactgtacaaactaattagttatacgtaaacgtccgtagggttacctttcggcccgtagggactaagggtggagtatacgagacgtaatggtcgctgacctacatcctgttctctac

SEQ ID NO: 7478 - DNA, 585 bp, Homo sapiens
  misc_feature: GYAE6OF01CYDS4.19.5.A05.1.454.CMB.1.raw
  modified_base (154)..(154): a, c, t, g, unknown or other
  misc_feature (154)..(154): n is a, c, g, or t
  modified_base (335)..(335): a, c, t, g, unknown or other
  misc_feature (335)..(335): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccgaggtgcagctggtgcagtctggagcagaggtgaggaagcccggggatctctgaggatctcgtgtaagcttcgtggtattctaggtttactactatattggatcggctgggtgcgccagcaggcccggagaacggccgtggagtggagtgggaatcatctagtccgtggacnctctgatcgccagtactacctactcccgttccttaccgaacggtccgacgtcctaacctacgtttacgacgtaccgaactaacgtccactaccgacgccacccgtccctaccgtcgacgacggtacggaacgacgccgtacggaccggtccgtacggacgacggccggtcgtacttattacgtcgtgacgacgactattacgaaaggttgggtcggcggtacggtaggggtttgtttggtcgtttacggg

SEQ ID NO: 7479 - DNA, 556 bp, Homo sapiens
  misc_feature: GYAE6OF01B8QBL.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtgaggaagcccggggatctctgaggatctcgtgtaagacttctggattcaggtttactacatattggatcggctgggtgcgcagcaggcccggacaaggcctggagtggatgggaatcatctatccgtggagactctgatgccagactacactccgtccttcgaacggccgacgtcacctactttcacgccgaacaacgtccatacacgccaccgccctaccgtcgcgaagtacggaacacgccgtacggaccggccgtccggacgacggccgggcgttactacttacgtgtcgcgacgtcaagttacaaacggtggggtacgggtcggacggtaggggtttcgtttggtcgtttacgggg

SEQ ID NO: 7480 - DNA, 808 bp, Homo sapiens
  misc_feature: GYAE6OF01CGQFZ.19.5.A05.1.454.CMB.1.raw
  modified_base (254)..(254): a, c, t, g, unknown or other
  misc_feature (254)..(254): n is a, c, g, or t
  modified_base (290)..(290): a, c, t, g, unknown or other
  misc_feature (290)..(290): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggatctctgaggatctcgtgtaaagcttctggattcaggtttactanatattggatcggctgggtgcgccagcaggcccgganaacggcctggagtggatgggaatcatctatccgtggagtactcgtgaatcggaccaagtactacctacttcccggttccctttacccggaaacgggtcccgtaacggttcctaacccgtaacttttaccgacggacccgtaaaccgtaaacgtaccctaacttaccgaaccgacccgtaaccccggtaccccgttaaccccgtacggtaccgtaaccgggttaacgggaaacccgtaacgggtaccccgttaccggggtaaccccggggtaccccggttacccggggaacccggtaacccggggtacccggggtcccgggttacccgtttaaaccgttttaacccggttacggggttaccgggtacccgggtaacggttacccgttaaacggttttaaacccgggtaaaaaaagggtttccgggggggttaccgggggtaccggggttaacccgggggttaagggggggtttttcggggtttttttaacggggtttagggtttttaaccccggggggg

SEQ ID NO: 7481 - DNA, 744 bp, Homo sapiens
  misc_feature: GYAE6OF01ALIWS.19.5.A05.1.454.CMB.1.raw
tcagtactctcgtgcacgaccggtgctcgatttagatagatagacagggggtcgtccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaaggcccggggatctcgtgaggatctcgtagtaagcttcgtggattcgtaggtttacactattagttggattcggcgtggggtgccgccaggcacggccccggaacaagggccctaggggaggtggagtaggggtaatcgaagttcttaacgtccgtagggagtaccttcgtaggaagtcggacccaaggtactaccaccgttcccgttacccttaccgaaacgggtcccgtacgttaccaacccgttattaccaccggtacccgtaacgtaaacgtacccgtaacttaccgaaccgacccgtaacccggtacccgttaacccgtacggtaccgtaacggtacggaaccgtaacggccccgttacgggacccgggtcccgtaccgggaaccgtaccgggtacccggtaccggttaccgttaaccgtttaccggtcggttaccgtaccggtaacggtaccgttaacgttaaccggtaaaacgggttcggggtacgggtccgggtacgggttaggggttttcggttttaggtccggtttaccgggg

SEQ ID NO: 7482 - DNA, 659 bp, Homo sapiens
  misc_feature: GYAE6OF01D33Q9.19.5.A05.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (296)..(296): a, c, t, g, unknown or other
  misc_feature (296)..(296): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctctcctggctgttctccaaggagtctgtgccgaggtgcagctggtncagtctggancagaggtgaggaacgcccggggatctcgtgaggtatctcgtagtaagacttcgtggattcgaggtttactacatattggatcggctgggtcgcgccagcacgcccgganaacggccgtggagtggagtgggaatcaagtctactcgtggacactgtgatcgcagtactacacctcccgtccttaccgaacggtcccgaacgtccaacctactttcaacgaccgaacaacgttaccactacacgcccaacccgccctaccgtcgaccgtaacgtacggaaccacggcccggtacggacccgggtccgtaccgggaccgacggaccggtccgttaaccgttaacgtttaaccggtcggttacggaccgtaacggtacttaacgttaacgaaaacgggtttcggggtacgggtaccggggtaccgggtttaagggggttttacgggtttttaggttagggttttaacccgggggg

SEQ ID NO: 7483 - DNA, 712 bp, Homo sapiens
  misc_feature: GYAE6OF01B0X54.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaaggcccggggagtctctgaggatcgtcgtagtaagactttcgtggtacttcgtaggttttaactacgtattagttggattcggtcgttggggtcgccgccgagccgacggccccggaagaacggccgtagggaggtaggagtgggaactcgagttcgtaacttccgtaggagtactcgtagtacgtcgaccgaagtactacctaccgttcccgtccgttaccgaaacggcccgtacgtacctacctactttaccgacgaccgaactaacgtaccgtacgtaccgacgacccgaacccgtacccgttaccgtcgtaccgaacggtacggaaccgtaccggtcccgtacggacccggtacccgtaccgggaaccggacggtaccggtaccgttaccgttacgttaccgtcggtacggaccggacgtacgttaacgttaacggaaaagggttggggacgggttacgggtacgggtttaggggttttcggttttagggttacggttttaccggggg

SEQ ID NO: 7484 - DNA, 520 bp, Homo sapiens
  misc_feature: GYAE6OF01A7CZK.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgacagacccaacagtaagaactacttggcttggtatcagcagaaaccaggacagcctacctaaactgctcatttattgggctatcgtacccgggtaaattcggggtccctgtccgattcagcggcagcgtgtcgtgggacagtatttcactctcacatcagcagcctgcaggctagaagatggtcggcgtctattactgtacaaactaatattatagtaacgtcgaagggtaccgtttcggccgtagggtactaagggtggtagatacgagtacgtagtggtggctgacctactatctcttcttctaccg

SEQ ID NO: 7485 - DNA, 606 bp, Homo sapiens
  misc_feature: GYAE6OF01EDHUN.19.5.A05.1.454.CMB.1.raw
  modified_base (334)..(334): a, c, t, g, unknown or other
  misc_feature (334)..(334): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtgaggaagcccggggatctctgaggatctcgtgtaagcttctggattcgtaggttttacactatattggatcggctgggtcgcgccagcacggcccggagaacggcctgggagtggatgggaatcatctatccgtgganacgtcgtgatcgccagtactaaccaccgttcccgttccttaccgaaggccgtagtaccacctatttccgacgaccgaacaacgtccactacacgcacccgtcctaccgtcgacgtagtacggaacgcgccgtacgaccggtccgtacggacgacggccggtcgttacctagttacgtggtacggccggtaacgtacgtaagttaaccgaaaaggttcggggtacgggtccgggtagggttaggggttttcggttttggtcggtttaccgggg

SEQ ID NO: 7486 - DNA, 579 bp, Homo sapiens
  misc_feature: GYAE6OF01A1CZD.19.5.A05.1.454.CMB.1.raw
  modified_base (291)..(291): a, c, t, g, unknown or other
  misc_feature (291)..(291): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggatctctgaggatctcgtgtaagacttctggattcgaggtttactacattattggatcgactgggtgcgcagcacgcccgganaaggcctggagtggatgggaatcatctatccgtggagactctgatcgccagactacaccttccgtaccttccgaaggcccgagtccacctactttcacgccgaacaacgtccactcacgccaccgtcctacctcgaccagtacggacacgccgtagacccggtccgtaccggacgtacggccggtaccgtacgtacgttacgtgtacggtccgagacctacgttaacgaaaggttggggtacgggtcgggtacgggttaggggtttcggttttaggtgtttaccgggg

SEQ ID NO: 7487 - DNA, 700 bp, Homo sapiens
  misc_feature: GYAE6OF01EPC8P.19.5.A05.1.454.CMB.1.raw
  modified_base (155)..(155): a, c, t, g, unknown or other
  misc_feature (155)..(155): n is a, c, g, or t
  modified_base (169)..(169): a, c, t, g, unknown or other
  misc_feature (169)..(169): n is a, c, g, or t
  modified_base (291)..(291): a, c, t, g, unknown or other
  misc_feature (291)..(291): n is a, c, g, or t
  modified_base (367)..(367): a, c, t, g, unknown or other
  misc_feature (367)..(367): n is a, c, g, or t
tcagtactctcgtgcacgaccggtgctcgatttagatagatagacagggggtctccctcactgcccagctgggatctcagggcttcattttctgtccctccaccatcatggagtcaaccgccatcctcgccctcctcctggctgttctccaaggntctgtgccgaggtncagctggtgcagtctggagcagaggtgaggaacggcccggggatcgtctggaggactctcggtagtaaacgctttgtggatttcgtaggtttactactattagttggatcggcgtggggtcnccggccaggccgacggccccgggaacaacgggtccctagggtaggtacgggagttaggggaattcaagtcttaacnccgttaggaactctcgtgactcgcctagactaccgacttcccgtaccttaccgaagggtcccgtagtaccctaaccgtactttccgacgtacccgaactaacgtacccaacgtcacgtaccgacccggtacctaccgtacggaccgtaacggtacggaaccctacggtcccgtacgaccgggtacccgtaccgggaaccgtcggtacccgggtcgtaaccgttacgtaccgttcggtagacccggtagtacttacgttaaaccgaaagggttcgggacgggtaccgggtacgggttaggggttttcgggttttacggtcgggtttaccggggg

SEQ ID NO: 7488 - DNA, 715 bp, Homo sapiens
  misc_feature: GYAE6OF01BS5SH.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccgttcgggacatcgtgctgacccagtcctccagacacacgtggctgtgtctcgtgggcgagacggccaccatcaactgcgaggtccagcgagtagttatttgacacgaacccaaatagtaaacgaacttacgttgggtacgtttaggtactacgaaggaccgaaacggaaaaccgagggaacctacgtacccttaaccttaaacgtcgtacttactaatttagtcggactacgtacccggtaaccggtaagttccgggtaccctgtccgtagttcgacggtcggacaggtcgtgtcgacgggactagtactttcacgttctaccacgtactccgaagctacgcccgtaggacgacggtacgtaaggtaaacgtggttcgggtgggttaccgttacgtttaacgtttacgtacgttaaacctaaacgttaagtttacttaaacggtaacggtaaaccggttccgggtaacgggttacccggtttaccggacccgggttaaggtaaccggttaacgggtaggaacgtaacttaggaaccggtacgtaacgtcgggtcgacgtacgaaccgtacgtacttaccggtcttacccgtcgttacccg

SEQ ID NO: 7489 - DNA, 769 bp, Homo sapiens
  misc_feature: GYAE6OF01DI7GQ.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctcgtgaggtatcgtcgtgtaaagtacttcgtggtattcgtaggttttactaacattagttggattccgggcgttggggtcgccggccaggccgaacggccccggaaagaacgggccgttggggaaggttgggaagtggggaaactcgaattctaacgtccgtagggaactacttcgtaggtaactcggacccgaagtaactacccgtacccgttccccggttaccctttacccggaaacgggtcccgtaacgttacccgtaacccgtaacttttacccgaaccggtaccccgtaaaccgtaacgtacccgtaacttaccgacgtacccgaaccccggtaccccttacccgtacggaccgaacggttaacggaaccgacggtcccgtaccggacccggtacccgtacggaccgacggtcccgggtaccgttaccgttaacgtttaccgtcggtacgggtaccgacggtactaacggtttaacgtaaaaacgggttggggtaccggggtcgggtacgggttaggggttttacgggttttggttaacggtttaccgggg

SEQ ID NO: 7490 - DNA, 675 bp, Homo sapiens
  misc_feature: GYAE6OF01D6FUL.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagacacactggctgtgtctcgtgggcgaggagggcccaccatcaactgcaggtccagcgagagtattttgacagacccaacagtaagaactacgttggcttggtatcagacaagaaaaccaggacagcctacctaaactgctctatttagttgggctatccgtaaccgggaagtttcggggtccctgtccgtattacgagccggacacggcgttagtcgtagggactagtacgtttccactcctacacctatcgacgccagccctaggacgtaggcgtaggaaagtcgttggtcgggtacgttacgttaacttacgtacggtaactaaaacgtaatttaagttaaagtaacggtaaacggttcccggtaaacggggttacccgttttaccgggaccccgtttaagggggaaccgtttaaaggggtagggtacgtaacgtaaccggaacggtaaaccggtaacgttgggtaacgggtccttacggacccgtaaacccgtatttaccgttaccgtttccgttaccgttaacccg

SEQ ID NO: 7491 - DNA, 580 bp, Homo sapiens
  misc_feature: GYAE6OF01AHGO0.19.5.A05.1.454.CMB.1.raw
  modified_base (243)..(243): a, c, t, g, unknown or other
  misc_feature (243)..(243): n is a, c, g, or t
  modified_base (436)..(436): a, c, t, g, unknown or other
  misc_feature (436)..(436): n is a, c, g, or t
tcagtactctcgtgcacgaccggtgctcgatttagatagatagacagggggtctccctcactgcccagctgggatctcagggctttcatttttctgtccctccaccatcatggagtcaaccgccatcctcgccctcctcctggctgttctccaaggagtctgtgccgaggtgcagctggtgcagtctggagcagaggtgaggaagcccggggagtctctgaggatcgtcgtgtaagctttcgnggtattcaggtttactacatattggatcggctggtgcgccagcagcccggacaaggccgtggagtcggatgggaatcatctatcctggagactcgtgatcgcagatacactccgtcctccaacggccgagtccactactttcacgccgacgaacgtccatcacgaccaccgcctaccgtgcctaggtcgaacncgccgtggaccggccgtcggaccgtgcccggtcgttacgttacgttacgtccggtacgcggacgtaccgttaactacgtaaaacgttgggggtacggaccggggttacgaggggtttcgggtttttgcggttttttaccggggg

SEQ ID NO: 7492 - DNA, 953 bp, Homo sapiens
  misc_feature: GYAE6OF01CD1M5.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtggagggaacggcccggggagtcctcgtggaggtatcgtacggtagtaacgtactttcgtggtactttacgtagggttttaaccttaactattagtttgggagttccgggtccgttgggggttacgcccggccgaaggccgtaacgggcccccgggtaacgaaacggggtcccgttagggggtaacgggtcggggtaaggttcggggggtaaacttccgtaacgtttacccgttaacgtttcccggttaaggggtaacggtaacccgtttacggttacggtaacgttaccggacccgtaaacgggtaaaccttaaccccgtaaccccgtttaccccccggttttaccccgtttaaccccggaaaccggggtaccccggtaaccggttacccgtaaccccgttaaccgtttttacccgaaccggtacccccggtaaaccgtaaaccgttacccgtaacgttacccgaacggtaccccgtaaccccgtaccccgttacccgtacggtaccgtaacgggtaaccgggaaacccgtaccgggtaccccgtaccgggtaaccccgggtaccccggtaacccggggaacccgtacggggtacccgggtaccggttaaccgtttaacggtttaccggttcggttacgggtaccgggtacggtaccgttaaccgttaaaccggtaaacgggttacgggggtaccgggtaccgggtacgggtttaagggggtttcgggtttttacggttacggttttacccgggggg

SEQ ID NO: 7493 - DNA, 714 bp, Homo sapiens
  misc_feature: GYAE6OF01B1QQ3.19.5.A05.1.454.CMB.1.raw
  modified_base (154)..(154): a, c, t, g, unknown or other
  misc_feature (154)..(154): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccgaggtgcagctggtgcagtctggagcaggaggtgaggaacggcccgggggatctcgtaggaggtacttcgtcggtagtaaacggtctttcgtgggtatttccgtaaggtttttaacctaactagttaagtttgggaacttccgggcgttgggggttcgccggccgaggccgaacgggccccggaagaacgggcccgtagggtacggtggagtaggggaatcgattcgtaacgttccgttgggacgtacttcgtagtactcgacctaggaaccttacacccgtttcccgtcccttaccggaacggccgtacgtacctaccgtactttacgacgaccgactaacgtaccagtccagcccaccgtaccctaccgtcgactacggtacgaacgacgaccgtacggacccgggcctacgggaccgcggccggtccgtacttacgttacgtcggtacgacggtacgtacgttaacgttaacgtaaagggttggggtacgggtacggggttttaggggtttagggtttttcggttacggttttcgggtaaccgggggg

SEQ ID NO: 7494 - DNA, 646 bp, Homo sapiens
  misc_feature: GYAE6OF01B5STO.19.5.A05.1.454.CMB.1.raw
  modified_base (156)..(156): a, c, t, g, unknown or other
  misc_feature (156)..(156): n is a, c, g, or t
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
tcagtactctcgtgcacgaccggtgctcgatttagatagatagacagggggtctccctcactgcccagctgggatctcagggcttcattttctgtccctccaccatcatggagtcaaccgccatcctcgccctcctcctggctgttctccgaaggngtctggtgccgaggtgcaggttggtgcagtctggagcgaggaggnggagggaacggccggggatctgtggaggatctcggtagtaagcttcgnggtattcgtaaggtttacctanattagttggatcggcgtgggncgcagcgacgaccgganaacggtctaggagtggaagtgggaatcaacttcgtaatccgtaggacgtactcgtagatcgacagtactaccacgttcccgtaccttacgaacggtccgacgttccacctagttacaccggtaccgaacgtaacgttacctaacgtaccaacggacccacccggtaccctaacgtcgtaccgaaggtacggaacaccggaccgttaccggaccgggtcccgtacggaccgacgggccgtacgttacgtacgtagtgacgacgagacgtagtacggtaaaggtcgggtaaggtcgggtacggttacgggtttggtttacgtggtttcgggaacggggg

SEQ ID NO: 7495 - DNA, 809 bp, Homo sapiens
  misc_feature: GYAE6OF01A27K1.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatccctcgccctcctcctggctgttctccaaggagtctgtgccgaggtgcagctgggtgcagtctggagcgaggaggtggagggaacggcccggggagtctcgtggaggtatcgtcggtagtaagtctttcgtggtattcgtaggtttacctacagttagttggtatcgggtctggggtcgccgccgaggccgacgggaccccggaacgaacgggtcccgttaggggacggttgggaaggttaggggtaaactcgacttcgttaacgtcccggtagggaacgtacttcgtgtactcgaccaagtacctaacctacccgttcccgtacccttaccggaaacgggtcccgtacgttaccctaaccttacgtttacccgaaccggtacccgtaaaccgtaaaccggtccctaacgtaccgaaccggacccgaaccccgtaccccgttacccgtacggccggtaacgggtacgggaaaccgtccggtacccgtaccgggaaccccgggtcccggtaacccggggaaccggtaccggggtacccgggttaccgttaccgttaaccgtttaccgtggttaccggaccggtaacgtaccgttaaacgtttaacggtaaaacgggttcgggggtacgggtaccggggttacgggttagggggttttacgggttttggttacgggttttaccggggg

SEQ ID NO: 7496 - DNA, 593 bp, Homo sapiens
  misc_feature: GYAE6OF01BXF3Q.19.5.A05.1.454.CMB.1.raw
  modified_base (225)..(225): a, c, t, g, unknown or other
  misc_feature (225)..(225): n is a, c, g, or t
  modified_base (402)..(402): a, c, t, g, unknown or other
  misc_feature (402)..(402): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgaggagggccaccatcaactgcaggtccagcgagagttattttgacagacccaanagtaagaactagtggcttgatcagcagaaaccaggacacgcctactaaactgcctactattttagtgggactacgtaccgtaaccgggtaattcggggtccccttgtccgtattcgaggcggcagcgtgtcgtagggacagtatttccacttcacacatcagcacgcctgcacggtngaagagtggtcggtacgttacttagttacgtacgtaccaaataattaacttagtaacgtaaacgtccggtaaggttacccgtttccggcccgttagggaacggttaacggtagggacgaagttaccgaaggtaccgtaagttggtacgggtccagacccctacacgttcttaccggttcttccgttacccg

SEQ ID NO: 7497 - DNA, 583 bp, Homo sapiens
  misc_feature: GYAE6OF01C5IVA.19.5.A05.1.454.CMB.1.raw
  modified_base (156)..(156): a, c, t, g, unknown or other
  misc_feature (156)..(156): n is a, c, g, or t
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
tcagtactctcgtgcacgaccggtgctcgatttagatagatagacagggggtctccctcactgcccagctgggatctcagggcttcatttttctgtcctccaccatcatggagtcaaccgccatcctcgcccctcctcctggctgttctccaaggngtctgtgccgaggtgcagctggtgcagtctgggagcaggaggtgagggaacggcccggggatctctggaggatctcgtgtaagtcttcgtggattcgaggttttactacatattggatcggctgggtncgccagcagcccgganaaggcctggagtggatgggaatcatctatccgtgganactctgatgaccagtactaccacctccgtcccttacgaacgggtccgagtccacctactttccacgccgacaacgtccatcacgccaccgtccctaccgtcgacgtacgtacggaacgacgccgtacggaccggccgtcggacgacgccggtcgttacgttacttacgtcgtcgcgacgtactacgttacgaaaggtggggtagggtaccgggtacggtaggggtttggtttggtggtttccgggg

SEQ ID NO: 7498 - DNA, 553 bp, Homo sapiens
  misc_feature: GYAE6OF01EV81D.19.5.A05.1.454.CMB.1.raw
  modified_base (154)..(154): a, c, t, g, unknown or other
  misc_feature (154)..(154): n is a, c, g, or t
  modified_base (188)..(188): a, c, t, g, unknown or other
  misc_feature (188)..(188): n is a, c, g, or t
  modified_base (332)..(332): a, c, t, g, unknown or other
  misc_feature (332)..(332): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccgaggtgcagctggtgcagtctggancagaggtgaggagcccggggatctctgaggatctcgtgtaagactttctggattcaggtttactacatagttggatcggctgggtgcgccagcagcccggacaaggcctggagtggatgggaatcgatctatccgtggagactngatgcagatacactccgtcttcgaaggccgagtccacctacttacacgaccgacaacgtcctatcacgccacccgtcctacctcgacgagtacgaacgacgccgtacgaccggccgtacggacacggcggtcgtacttacgttactggtagcggtacgactaagttacgaaaagttgggtacggtcgggcggtaggggtttggtttaggtgtttaccgggg

SEQ ID NO: 7499 - DNA, 676 bp, Homo sapiens
  misc_feature: GYAE6OF01DL8CH.19.5.A05.1.454.CMB.1.raw
  modified_base (318)..(318): a, c, t, g, unknown or other
  misc_feature (318)..(318): n is a, c, g, or t
  modified_base (360)..(360): a, c, t, g, unknown or other
  misc_feature (360)..(360): n is a, c, g, or t
tcagtactctcgtgcacgaccggtgctcgatttagatagatagacaggcaggggcagcaagatggtgttgcagacccaggtcttcatttctctgttgctctggatctctggtcgcccgacggggacatcgtgatcgacccagtctccagactccctggctgtgtctcgtgggcgagcgggccacatacaactcgacaacgtccaacgccaactaacttcttttacactacgttaccaaactaaatacgaaaaacttacttaagtcttacggtaccagacaagagaccaggacagcctacgtagctgctctatttacgnggctacgtaccgtaccgggaacgtcccgggtcctggaccgtnttacgaggtcggacgtacggtcgggtcgtaggggactacgttacgtttccacgttccttaccaaacccgtattcgaacgctaaccggtcctacggacgtacgggctaggaaacggttgttcgggtcggttacttaagttttaatttaagttacgtaactaaacgttaattttaatttaactttaacgttacgtttacggtacggttaccgggtttacggaaaccggtaacgggtaaccgtaagggtcgtaatacgtacgacgtaacgttgtgtaggctacgacctaccgttatcgttcttccttctacgttccccg

SEQ ID NO: 7500 - DNA, 748 bp, Homo sapiens
  misc_feature: GYAE6OF01BYWEM.19.5.A05.1.454.CMB.1.raw
  modified_base (154)..(154): a, c, t, g, unknown or other
  misc_feature (154)..(154): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccggaggtgcagcgtggtgcagtcgtgggagcaggaggtggaagggaacggccccggggagttcgtcgtaggaggtacttcgtacggttagtaacgtctttcgtaggtacttcgtacggtttactactagttagttggagtcggtgtgggtcgcgccgagccgacggcccggacgacggccgtgggaggtggagtagggatcgattcgtacgtccgtaggacgtacgtcgtagagtcgaccgtaagtactaccgtaccgttcccgtacccgttaccggaacggaccgtacgtacctaccgtacgttacgaccgttttttaccgaacgtaacgtacctacgtaccgaccgacccgtacccgtacccgtaccgtacgtacgtacggtacggaaccgtacgtacccggtacggtacccggtacccggtaccgggaccggtaccgggtacccgggtaccgttaccgttaccgttacggttacggtacggtacggtacgtacgtaacggttaaacggtaaacgggttacggggtacggggtaccgggttacgggttaggggttttcgggttttggttacgggtttaccgggg

SEQ ID NO: 7501 - DNA, 595 bp, Homo sapiens
  misc_feature: GYAE6OF01AEZQX.19.5.A05.1.454.CMB.1.raw
  modified_base (328)..(328): a, c, t, g, unknown or other
  misc_feature (328)..(328): n is a, c, g, or t
tcagtactctcgtgcacgaccggtgctcgatttagatagatagacaggtggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggatctctgaggatctcgtgtaagacttctggtattcaggtttactacatattggatcggctgggtgcgccagcagcccggacaaggcctgggagtggatgggaatcatctatccgtgganactctgatgccagatacactccgtccttccgaaggccgagtccacctactttcacgccgacaacgtccatcacgccacccgccctacctcgacgagtacggaacacgcccgtacggaccggtcccgtcggaccgacgggccgggccgttacttacgtttaccgttgggtacggccggaggtacctacgtttaaccgtaaaaagggttcgggggttacggggtcgggtaccgggtaggggggttttgggtttttgggtttaaccgggg

SEQ ID NO: 7502 - DNA, 880 bp, Homo sapiens
  misc_feature: GYAE6OF01EOR2W.19.5.A05.1.454.CMB.1.raw
  modified_base (154)..(154): a, c, t, g, unknown or other
  misc_feature (154)..(154): n is a, c, g, or t
  modified_base (337)..(337): a, c, t, g, unknown or other
  misc_feature (337)..(337): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccgaggtgcagtctggtgcagtcgtggagcgaggaggtggaacgggaacgggtcccggggagttccgtacgtaggacggtacttccgttacggttaggtaaacgtccgtttcgtaggtaactttcgttaaggttttacacgtaatttagttggaacgttcgggtcgttgggggtcnccggtccgaaggcccgaacgggacccccggtaacgaacggggtcccgtaggggtaacggtggggtaacggttaggggtaaactttccgaacgtttaccgtttaacggtccccggttaagggaacgttacccgtttcggtaaggtaccgttccgggaaccgtaaggttaaacccttacccgtaacccggtttacccccggttttacccggttaaaccccggaaacgggggtccccttaaacggtaccccgttaacccgttaaccggtttaccggaaccggtaacccgtaaaccgttaacccgtacctaacgtacccgtaaaccgtacccgtacccgttaaccgtacgtaccgtaacggttaacggaaccgtaccggtacccgtacggtaacccggtccggtacggaccgtaccgggccggttaccgttaccttacgtttacgtcggtacgtaccggtacgtacttaacggttacgaaacgggttcgggtacggtacgggtacgggttagggtttaggttttcggtacggtttcgggaaccgggg

SEQ ID NO: 7503 - DNA, 620 bp, Homo sapiens
  misc_feature: GYAE6OF01BLUOO.19.5.A05.1.454.CMB.1.raw
  modified_base (174)..(174): a, c, t, g, unknown or other
  misc_feature (174)..(174): n is a, c, g, or t
  modified_base (226)..(226): a, c, t, g, unknown or other
  misc_feature (226)..(226): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgagngggccaccatcaactgcaggtccagcgagtagttattttgacagaacccaanagtaacgactacttggcttggtatcagcaacgaaaccaggacacgcctacctaaactgctctatttatggcatacgtaccggtaagttcgggtccctgtcgattcagcgnagcgtgtcnggacagtattcactcncacntcagcngctgacagctagaagtgtggtacggtcggttacttaagtttacctacgttacaaacgtaatttattaaagtagtaaacggttaccggtaacggggttaccgttttaccgggacccggttaggggtaaacggttaacgggtgggtaaacgtacgttaccggaaacggtaaccgttaacggttcgggttcggtacccgttaggacccgttaaccctacgtttcccgttacggtttccctttagttaccccg

SEQ ID NO: 7504 - DNA, 915 bp, Homo sapiens
  misc_feature: GYAE6OF01BO1FC.19.5.A05.1.454.CMB.1.raw
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
tcagtactctcgtgcacgaccggtgctcgatttagatagatagacaggggtctccctcactgcccagctgggatctcagggcttcattttctgtcctccaccatcatggagtcaaccgccatcctcgccctcctcctggcttgttctccgaaaggtgtctggtgccgaggtgcagctggtgcagtcgtggagcaggaggtggaaggaacggcccggggtatctcgnggaggtnttcgttcgtaggtaaacgtctttcgtggtatttcgtaaggtttactactagttgttggagttcggtcgtgggtgccgaccgagtccgacggaccggaacgaacgggtccgtagggtaggtacggtaagtacggggtaaactcgtagttaccgttacgttaccggtaggaacggtaccttcgggtacggtaacgttaccggaaccgtaacggttaaacccgttacccgtttaacccccggttaccccggtttaccccgttttaaccggaaaacgggtccccggttaaccgtttaccccgttaacccgtttaaccgtttttaccgaccggtaaccccgtaaaccgttaaacccggttaccctaaacgttaaccggaaacccggaccccgttaaacccccgggtaccccgtttaacccggttaaccggaaccgtaaccggggttaaccggaaacccgttaacggtccccggttaacgggacccccgggtacccgggttacccgggaaccggtaccgggtacccgggttacgttacccgtttaacgtttaccggttacggttaacgggccgtaaacgtaccccgttaaaggttaaacccgttaaacggggttcggggtaccgggtaccggggtttaacggggttaggggttttttacgggttttggttaacgggttttaccggggg

SEQ ID NO: 7505 - DNA, 751 bp, Homo sapiens
  misc_feature: GYAE6OF01BW3H5.19.5.A05.1.454.CMB.1.raw
  modified_base (154)..(154): a, c, t, g, unknown or other
  misc_feature (154)..(154): n is a, c, g, or t
  modified_base (307)..(307): a, c, t, g, unknown or other
  misc_feature (307)..(307): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccgaggtgcagctggtgcagtctggagcagaggtgaggaagcccggggatctctggaggactcgtcggtagtaacgtacttcgtggatttcgaggttttactacgattagttggagtcggcgtgggtgcgccagcacggcccgganaacggcctggagtggagtagggatcatctactccgtaggacgactcgtgattcgacctaaggacttaaccgacccgttcccggttaccctttaccgaaccgggtccgtacgttacccgtaaccctaacgttttccgaacggtacccgaaccgtaaacgttacccaacgttacccgaaccgacccgtaaccccggtacccttaacccgtccgtaccggtacggtacgggtaaccgacgggtacccgtacgggtacccgggtaccccgttaccgggaaccgacggggtaccccgggtaccggtttacccgttaaccgtttaccgttacgggtacggtaccgggtaacggtacttaacgttaaaccggtaaaagggtttcgggggtacggtaccggggtacgggttaagggggttttcgggttttaggtttacggttttaccggggg

SEQ ID NO: 7506 - DNA, 613 bp, Homo sapiens
  misc_feature: GYAE6OF01BL60Z.19.5.A05.1.454.CMB.1.raw
  modified_base (287)..(287): a, c, t, g, unknown or other
  misc_feature (287)..(287): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggatctctgaggatctcgtgtaagacttctggattcaggtttactacatattggatcggctgggtgcgcagcagccgganaggcctggagtggatgggaatcagtctagtccgtggacgacgtcngatgccagactacnctccgtccttaccgaaggccgagtaccacctactttaccacgaccgacaacgtccactcacgccacccgtccctaccgtcgacctacggtacggaaccacggcccgtacggacccgggtcccgtacgggaacgacggccgggtccgttacgttacgtttacgtggttacggaccgtacggacgtaagtttaaccgaaaaggttcggggtacgggtccggggtacggttagggggtttacggggtttttggtacggttttaccggggg

SEQ ID NO: 7507 - DNA, 781 bp, Homo sapiens
  misc_feature: GYAE6OF01AK1D1.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccgttcgggacatcgtgctgacccagtcctccagacacacgtggctgtgtctcgtgggcgaggcgggccaccatacaacgtgcgaggtccaggcgagtagttatttgacacgaacccaacgtagtaacgacttacgttggcttaggtatcaaggccaagtaaaacccgagggtacacgtccctaccgtaaactcgctacgtaagttttagtcgggactacgttacccgggtaaacccgggtaaggtttccggggtacccctcggtacccgtagtttaccgaagggtcccggtacggacggtcggtacggttccggagggtacctaaggttcctttaccgtaccgttccctaacccaaccgtacgttcgaaccgggtccaaccggtccgtacgggtacgtaaccgggtcgtaacggtaaggtggttcgggtcgggtccgttagtttacgtacgtacgttaactaaacttaagttaagttacgtaaacgggtaaccgttaccgggtacgggtttacccggttaccgggtaaccgggtacgggtaacgttacggggacggtacgtaacggtaccgaaacggggtaccgtacgggttacggtacgggtccttaccgggaaccttaccggttaacttccggtttacccgttcccggtttacttaccccccggg

SEQ ID NO: 7508 - DNA, 782 bp, Homo sapiens
  misc_feature: GYAE6OF01AGWEY.19.5.A05.1.454.CMB.1.raw
  modified_base (158)..(158): a, c, t, g, unknown or other
  misc_feature (158)..(158): n is a, c, g, or t
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
  modified_base (265)..(265): a, c, t, g, unknown or other
  misc_feature (265)..(265): n is a, c, g, or t
  modified_base (315)..(315): a, c, t, g, unknown or other
  misc_feature (315)..(315): n is a, c, g, or t
tcagtactctcgtgcacgaccggtgctcgatttagatagatagacagggggtctccctcactgcccagctgggatctcagggcttcattttctgtcctccaccatcatggacgtcaaccgccatccctcgccctcctccgtggcttgttctccaaggngtctgtgccgaggtgcagctgggtnctagtcgnggagcgaggagggtgaacggaacgggcccggggtatcgtcgtggacgtctcgtacggtagtaaacgtctttcgnggtactttcgtaggtttaacactagtagttcggacttcggtgtcgggtcnccgtaccgagccgacggacccggaagacggtcgtaggcggttaggagtacggaactcagttcctagtccgtaggacgtactcgtagactacgactaagtacctacgtacccgttcccgttacctacggacgtccgtactacctaccgttacgttaccgaccggtaccgacgttaaccgtacctaacgtaccgtaacgaccccgtaccccgttaccgtacccggtaacgaaccgggtaacggtacgtaaacccgtaccggtccggtaaccggggtacccggtaacccgggtaccgggtaaccggtacgggttacccggggttaaccttaccggttttaccgtacggtacccggttacggaccgtaaccggtaacttaacggttaaaccgggttaacgggttaccggggtcgggttacccgggttagggttaaggggttttcggtttacggttacgggttacccggggg

SEQ ID NO: 7509 - DNA, 678 bp, Homo sapiens
  misc_feature: GYAE6OF01AVQMT.19.5.A05.1.454.CMB.1.raw
  modified_base (154)..(154): a, c, t, g, unknown or other
  misc_feature (154)..(154): n is a, c, g, or t
  modified_base (309)..(309): a, c, t, g, unknown or other
  misc_feature (309)..(309): n is a, c, g, or t
  modified_base (535)..(535): a, c, t, g, unknown or other
  misc_feature (535)..(535): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccgaggtgcagcgtggtgcagtctggagcgaggaggtggagggaacggcccggggagtctcgtaggaggtacttcgtcgttagtaacgtctttcgtaggtactttcgtacggtttactactattagttggacgtcggtcggtgggtcnccgcacgccgacggacccggaaggacggtccgtagggacggtaggacgtagggtaactcgtaattccgtacgtccgtaggacgtactgtagacgtacgacacgtaactacgtccttcccgtctacggacgccgtatacccacttactacgacgtacctaacgtaacgtcctaacaccgtaccgaccctacccgtacccgttccgagtaccgtaacggtacgaaccncggtaccgtaccgggaccggtaccgtaccgggacgacgggtccggtacgttacgtacttagacggtcgaacgtcgtactaagttaacggagggttcgggtacggcggttacgggtttaggtttcggtttgtcggttaccgggg

SEQ ID NO: 7510 - DNA, 611 bp, Homo sapiens
  misc_feature: GYAE6OF01BFBX4.19.5.A05.1.454.CMB.1.raw
  modified_base (430)..(430): a, c, t, g, unknown or other
  misc_feature (430)..(430): n is a, c, g, or t
  modified_base (600)..(600): a, c, t, g, unknown or other
  misc_feature (600)..(600): n is a, c, g, or t
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagaccacactggctgtgtctcgtgggcgaggagggccaccatcaactgcgaggtccagcgagtagttattttgtacacgacccaacaagtaagaacttacttggcttggtatcagacaacgaaaccaggacacgccctacctaaactgctactaagtttagtcgggactacgttaccggtaaccccgggtaaaggttccggggtacccttcgtccgtacttaccgaggcgcgagtcgtcgtcgtgggactagtactttcacttcacacctatccgatccagcctcgngacgtcgtagaaggtacgtggtacggtcgttacgttaacgtacttacgtaactaactaatttagttaagtacggtaaacgtccggaagggttaccttccggacccgttaggacgtagggtgaacgtgtacgtaacgacgtaagtcggtgactacgaccacgtacttcgtntcgttcgtccg

SEQ ID NO: 7511 - DNA, 863 bp, Homo sapiens
  misc_feature: GYAE6OF01DNG4L.19.5.A05.1.454.CMB.1.raw
  modified_base (155)..(155): a, c, t, g, unknown or other
  misc_feature (155)..(155): n is a, c, g, or t
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgcccctcctcctggctgttctccaaggngtctgtcgccgaggtgcagctggtncagtcnggancaggaggtgaggaacggcccggggatctcgtggaacggtacttcgtacgtgtaaacgcctttcgtggtaattacctaagggttttaacctaacgtattaagtttagggtattccgggtcgttcgggggtacgaccggaccgaggaccaacggacccccgggaagaaacgggcccgttagggagtagggtagtagggtaatacgtacttacgtaactcccgtaggtaagaccttacgtacgtatacggaccctaaagtacgtaacctaaccggttcccgttaacccgttaccgaaacgggtacccggtacgtaccctaacccgtaacgtttacccgaaccgtacccggtaaacctaaccggttacccaaacgtaccgtaaccggaaccccgtaaccccggtaaccccttaaacccgtcggtaacccggtaaacggttaacgggaaacccgtaacgggtaccccgttaaccgggtaaccccgggtaccggtacccgggaaccggtaaccgggcccgggttaccgttaacgtttaacccgttaacgtttacggtacgggtaccgtaaacggtacccgtaaacgtttaacggtaaaaacgggttcgggggtaacgggtaccgggtaacgggttagggggtttttacgggttttaggttaaccggttttaaccggggg

SEQ ID NO: 7512 - DNA, 750 bp, Homo sapiens
  misc_feature: GYAE6OF01CR976.19.5.A05.1.454.CMB.1.raw
  modified_base (157)..(157): a, c, t, g, unknown or other
  misc_feature (157)..(157): n is a, c, g, or t
  modified_base (185)..(185): a, c, t, g, unknown or other
  misc_feature (185)..(185): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
tcagtactctcgtgcacgaccggtgctcgatttagatagatagacaggggtctccctcactgcccagctgggatctcgaggcttctattttctgtcctccaccatcagtggagtcaaccgccatcctcgccctctcctggcttgttctaccgaaggngtctggtcgaccgaggtgcagcgtggtnctagtcgtggagcgtaggaggtggaacggacggcccggggattcgtcgaggaaggtctacgtcgtagtaagtcttcgtaggtacttacgtaggtttacctaatagtagttcggacgttccgggngttgggcnccgacgaggaccaccggacccggaacgtaacggccgtaggtaacggtagggtatacgggtaaacttcaaagttcgttaacgttccgtagggtaaactccttagtggtaacgtcggacaagttaccaaccgttcccgttcctacccgttaaggaacggtccgactaccgtaaccttagttaccacgtaccgacgaacgtcctacgacacgaccgtacctacgtaccgtagccgtaacgtacgaaccgcgtacccgtacggaccggtacccgtacggaaaccgcgggtaccgtaccgtttagtactttaccgggcggttacgtaaccggtacgttaccgttaaacgtttaaacgggaacggttcgggggttcgggaacccgggtttagggtttaccggggttttcggttttacgggtaacggttttaccgggggg

SEQ ID NO: 7513 - DNA, 865 bp, Homo sapiens
  misc_feature: GYAE6OF01ARLUB.19.5.A05.1.454.CMB.1.raw
  modified_base (157)..(157): a, c, t, g, unknown or other
  misc_feature (157)..(157): n is a, c, g, or t
  modified_base (229)..(229): a, c, t, g, unknown or other
  misc_feature (229)..(229): n is a, c, g, or t
tcagtactctcgtgcacgaccggtgctcgatttagatagatagacagggggtctccctcactgcccagctgggatctcagggcttcattttctgtcctcaccatcatggagtcaaccgccatccctcgcccctcctccgtggctgttcctccaaggngtctgtgccgaggtgcagcgtggtgcagtcgtggagcaggaggtggacggaacggcccggggtattcgtcgnggaggacttcgtcggtataacgtcttcgtggtattcgtaaggtttacagtattacgttggagttccgggtcgttcggggtcgccgaccgagcccgtaccgggaccccggaaagtaacgggtcccggtagggaacgggttacgggtaagttcggggaaaacctcgttacgttccgttaaccgtttcccgggagggtaaaccgttaccgttcggtacgtaccgtacgaacccgtaagtaaccggtttaacccctacccgggtttacccccgtttacccgttaaacccgggaaaccggggttaccccgtaacgggttaacccccttaaccgtttaaccgttttaccccgggaccggtaaaccccgtaaaccggttaacccgttaacccaacggttaccggaacccgttcccccggaaacccgtttaccccgttaacgtcggaacccggttaggacccggggtaaaccgtacggccccggttaacggcccgggtacccgtaccggggtaaccgcggtacggggttacctaccgttaacgttcggttcggcggtacgtacgtagttaacgtacggttaaaggtccggggtaggtacccggttagggttaggtttttcgggtttaggtccgtttaaccgggg

SEQ ID NO: 7514 - DNA, 665 bp, Homo sapiens
  misc_feature: GYAE6OF01ECVM7.19.5.A05.1.454.CMB.1.raw
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagcgtggtgcagtctggagcagaggtgaggagcccggggatctctgaggatctcgtagtaagtcttcgtggacttcgtaggtttactactattagttggatcggcttggggtcncctcacgcacggcccgganaggcctgggagtggagtgggaatcgatcgtactccgtgggaactacttcgtagatcgacccaagtactacctaccgttcccgtaccttccgaaacggtcccgaatcctacctactttaccgacgtaccgaacgtaacgtaccacgtacacgaccacccgtcctaccgtcgaccgtaggtacggaacacggtccgtacggaccggtcccgtaccgggaccgacgggtaccgggtaccgttaccgttaacgttacgttcggtacggtccgggtactaacgttaaccggtaaaagggttccggggtagggtaccgggtacggttacggggtttaggttttaggttacgtttcgggtaaccggggg

SEQ ID NO: 7515 - DNA, 707 bp, Homo sapiens
  misc_feature: GYAE6OF01A6VPH.19.5.A05.1.454.CMB.1.raw
  modified_base (225)..(225): a, c, t, g, unknown or other
  misc_feature (225)..(225): n is a, c, g, or t
tcagtactctcgtgcacgaccggtgctcgatttagatagatagacaggcagggcagcaagatggtgttgcagacccaggtcttcatttctctgttgctctggatctctggtgccttcggggacatcgtgctgacccagtctccagacacactggctgtgtctcgtagggcgagagggccacatcaacgtgcaggtccagcgagtagtagttttgacagacccaanagtaagactactggcttggtatcagacagaaaccaggacacgcctacctaaatcgcttctaatttgtgggctaacgttccgtaaacccgggtaaagttcggggtacccttaggtaccggtacttccgaaggtcccggtcgtaggtcggtttacgcggttaggggaaccaaggttacttaccgtaaccttcgtactaacccgattcccgaagacctacgccgttacggacgtaaggtccgttaaaggaaacggtagttacgggtacgggtaccgggttactttaacgttaccgtacggttaaccaaacttaaagttaacgttaagacgtaaccgttaccggtaacgggtacccgttttacggacccggttacgggtaacgtaagggaccgtaaggtacgtaacgacggtaaccgtaacgtcggttacggtacctaacggtaccctaaacgttactacccgttacgtacccgttccgtaacccg

SEQ ID NO: 7516 - DNA, 877 bp, Homo sapiens
  misc_feature: GYAE6OF01DLSS2.19.5.A05.1.454.CMB.1.raw
tcagtactctcgtgcacgaccggtgctcgatttagatagatagacagggggtctccctcactgcccagctgggatctcagggcttctatttttctgtccctccaccatcatggagtccaaccgccatcctcgcccctcctcctggcttgttctccgaaggagtcgtgtcgccggaggtgcagcgttggtcgcgtaggttcgtgggagacgagggagggtaggaacgggaaccgggcccgggggtattcccgttcgtagggaacggtacgttaccggttacggttaaggtaaccgtaccgtttacggttaggttaaccttttaccggttaacggttttaaacctaacgttaagtttacggtttacgggtacggttccgggtcggtttacgggggcgaccggtaccgacggaccggaacccgggaccccgggaaacggaaccggttccgggtaagggggtacgggttagggtacgggttaagggtaacttaaccgtacgtttaccgttaaccggtcccggtagggtaaaccgttcgttaccggtagtaaccgtacggaaccgtaaacgtaccgttaacccgttacccgtttaccccggttaccccgttaaacggaaccgggtacccgttacgtaaccctaccgtttaacgtacccgaccgtaacccgtaaccgtaacgtacctacgtaaccgacccgtacccgtaccccgtaccgtaccgtcggaacgtaacgtaaccggaaccgccgtccggtaccggacccggtccggtacggacgtcggtccgtacgttactgttacgcgtagacgtacgtacgtaagttacggacgggtgggccggtaaggtcggtttaagggtttcgttagtcgggttaacggg

SEQ ID NO: 7517 - DNA, 642 bp, Homo sapiens
  misc_feature: GYAE6OF01BMC3M.19.5.A05.1.454.CMB.1.raw
  modified_base (154)..(154): a, c, t, g, unknown or other
  misc_feature (154)..(154): n is a, c, g, or t
  modified_base (188)..(188): a, c, t, g, unknown or other
  misc_feature (188)..(188): n is a, c, g, or t
  modified_base (386)..(386): a, c, t, g, unknown or other
  misc_feature (386)..(386): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggntctgtgccgaggtgcagcgtggtgcagtctggancgaggaggtggagggaacggcccgggggtatcgtcgtggaggattcgtacggttgtaaacgtcttcggtggtacttcgtaggtttactacattagttggagtcggtagtggggtcgccgtcgacgcgacggaccggacgaggtccgtagggaggtggagtgggaactcgtactctacgtcgaggtactacgtcgtagngtgacctagtactacctacttcccgtaccttacgacggaccgtacgtcctaactacgttaccgacggaccgtaacacgtcctacgacacgcctacccgaccgtacctcggacctaggtacgaacgtcggccgtacggcccggtacgtaccggcgtacggcggtcgttacttacgttactggcgacgagtacaacggttaacgaggttgggtcggtacggtagggttagggtttcggttttaggtggtttaccgggg

SEQ ID NO: 7518 - DNA, 758 bp, Homo sapiens
  misc_feature: GYAE6OF01BIUO7.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggatctcgtgaggatctcgtgtaacgacttcgtggtattcgtaggtttactactattagttggatcggcgtgggtgcgcagcacggcccggtacaacgggcctagggacgtgggacgtggggaatcgaagttctacgtccgtgggacgtaacttcgtagaatcgaccaagtaactaccaccgttcccgttacccgtttaccgaacgggtacccgtacgtaccctaaccgtacttttaccgacgtaccccggaacgtaaacccggtaccctaacgtaccgtaaccggacccgtaacccccggtacccgttaacccgtcggtaaccgtaacgggttacgggaaaccctacggacccgtacgggacccggtacccggtacgggaccgacgggtcccgggtaccgtaaccgttacggtttaccgttacggtaccggtaccggtaacgtaccgttaacgtttaaacccggtaaaagggttccgggggtacgggtcccggggtaacgggttaggggggttttagggtttttacgggttaaggttttaccccgggggg

SEQ ID NO: 7519 - DNA, 792 bp, Homo sapiens
  misc_feature: GYAE6OF01BA69K.19.5.A05.1.454.CMB.1.raw
tcagtactctcgtgcacgaccggtgctcgatttagatagatagacagggggtctccctcactgcccagctgggatctcagggcttctattttctgtcctccaccatcatggagtcaaccgccatcctcgccctcctcctggctgttctccaaggagtctgtgccgaggtgcagcgtggtgcagtctggagcgaggaggtggagggaacggcccggggtatctcgtgaggatcgtcgtagtaagtctttcgtggtacttcgtaggtttaactaactattagttggagtcggtcgtgggtgccgccgagccgacggcccggaacgaacgggtccgtagggagtgggagtagggaatcgtatctacgtccgtaggacgtactcgtagtatcgactacgactaccgaccttcccgtcctttaccggaacggtccgtacgtacctaccgtaactttccgaacggtacccgaacgtaacgtaccaacgttaccgaacgtacccgtaacccgtacccttaccgtacgaccgtaacgggtacggaaacccgacggtacccgttaaccggggaaccccggtacccggtacccgggtaacccggaccgggtacccgggtaccggtttaaccgttaaccgtttaccggttacggtaccgggtaaccggtaacggtacccgttaaacgtttaaaacccgggtaaaaacggggtttcggggggttaacggggttacccggggttacgggtttaaaggggggtttttcgggtttttaagggttaaccgggttttaacccggggggg

SEQ ID NO: 7520 - DNA, 856 bp, Homo sapiens
  misc_feature: GYAE6OF01B7167.19.5.A05.1.454.CMB.1.raw
  modified_base (153)..(153): a, c, t, g, unknown or other
  misc_feature (153)..(153): n is a, c, g, or t
tcagtactctcgtgcacgaccggtgctcgatttagatagatagacagggggtctccctcactgcccagctgggatctcagggcttcattttctgtcctccaccatcatggatcaaccgccatcctcgccctcctcctggctgttctccaaggngtctgtgccgagtgcagcgtggtgctagtcgtggagcaggaggtggagggaacggcccggggtatcgtcgtggacggtattccgtacggttagtaaacgtacctttcggtaggggttaactttaccggtaacgggtttttaacctaacctagtttaacggtttacgggacgtttccggggtcggttgggggttcgcccggtacccgaaggtcccgaaccggggacccccggtaaagtaacgggtccgtaggggacggtttagggaaagtaggggtaaactcgtaacgttccgtaacgtcccggtagggaaccgttacttcgtaagtaccgtcgtaaccgtaagtacctaacccgtaccgttaccccgttacccgttaccggaaaccgggtccgtaaccgttacctaccgttactttaccgaaccggtaacccgtaacgtaaccgtaccgtactacccgaccgtaccccgtaacccgttaccctaccgtacgtaccgtaacgggtaccggaaccgtacggtacccgtaccgggaccggtcccggtaaccggaccggtaccggtaccggtaccgttacgttaacgttcggtcggtaccggtaccgtacgtacgtaaacggttaaccggaacgggttcggggtaccgggtacggggttacgggtttaggggttttacgttttacgggtaccggttttacccggggg

SEQ ID NO: 7521 - DNA, 683 bp, Homo sapiens
  misc_feature: GYAE6OF01AZJO1.19.5.A05.1.454.CMB.1.raw
  modified_base (334)..(334): a, c, t, g, unknown or other
  misc_feature (334)..(334): n is a, c, g, or t
tcagtactctcgtgcacgaccggtgctcgatttagatagatagacagggggtctccctcactgcccagctgggatctcagggcttcattttctgtccctccaccatcatggagtcaaccgccatcctcgccctcctcctggctgttctccaaggagtctgtgccgaggtgcagctggtgcagtcgtggagcaggagggtggagggaacggcccgggggattcgtcgtggaggtactcgtcggttagtaagtactttcgtggtatttcgtaaggttttactactagttagttggatcgggtcgtgggtcgccgtccgagccaacggccccggaanaacggccgtaggaggtggtagtagggtaaactctaatcgtaatccgtaggacgtactcgtgactcgaccaagtactaccgtacctcccgttcctaaccgacggccgtacgtccacctacgttccgacgtccgaacgtaacgtccactacgacgacccgacccgtacccgtaccgtgaccgtaacggtacgaaccgtaccgccggtacggacccggtacccgtacggaccggtacggtccggtaccgtacgttacgtacgtcggttcgacggacgtactaacgttacgtaaacgggtcgggtacgggtacggtacgggttagggtttcggtttaggtcggtttaccgggg

SEQ ID NO: 7522 - DNA, 669 bp, Homo sapiens
  misc_feature: GYAE6OF01B6G4L.19.5.A05.1.454.CMB.1.raw
  modified_base (187)..(187): a, c, t, g, unknown or other
  misc_feature (187)..(187): n is a, c, g, or t
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctctcctggctgttctccaaggagtctgtgccgaggtgcagctggtgcagtctggancagaggtgaggagcccggggatctctgaggatctcgtgtaagcttcnggattcaggtttacactatattggatcggctgggtncgccagcaggcccgganaggcctggagtggatgggaatcgatctatccgtggacgactctgatcgacctagactacacgttcccgtaccttaccgaacggcccgtaagtcctacctatttaccgacgtacccgaacgtaacgtacccacgtaccgacgacccgtacccgtaccctacccgtcggtaccgtaacggtacggaaccgtacggacccgttacgggaacccgggtcccggtaccgggaccgaacgggtcccgggtacgttaccgttacgtttaccgttacggtaccggacggtacgtacgttaacgtttaacggtaaaacgggttgggggtacggggtaccgggttacgggttagggggtttgggtttttacggttacggttttaccgggggg

SEQ ID NO: 7523 - DNA, 859 bp, Homo sapiens
  misc_feature: GYAE6OF01D642Q.19.5.A05.1.454.CMB.1.raw
  modified_base (155)..(155): a, c, t, g, unknown or other
  misc_feature (155)..(155): n is a, c, g, or t
  modified_base (179)..(179): a, c, t, g, unknown or other
  misc_feature (179)..(179): n is a, c, g, or t
  modified_base (198)..(198): a, c, t, g, unknown or other
  misc_feature (198)..(198): n is a, c, g, or t
  modified_base (337)..(337): a, c, t, g, unknown or other
  misc_feature (337)..(337): n is a, c, g, or t
tcagtactctcgtgcacgaccggtgctcgatttagatagatagacagggggtctccctcactgcccagctgggatctcagggcttctattttctgtcctccaccatcagtggatcaaccgccatccctcgccctcctcctggctgttctcaaggngtctgtgccgaggtgcagcgtggngctagtcgtgggagcaggngggtaggagggaacggcccggggattccgtcgtggaggtattcccgttacggttaggttaagtcctttggttacggtacttttcgtaacgttttaactaacgttagttaagttgggtacgttcgggtcggtggggttcncccggacgacggccgaccgggacccggaacggaacggtcccggaggggtagggtaggaaggtgggaacttccgattccgtaacgttccgtagggaacgtaacctttgacgtacgtcgaaccgtaacgtaacgtttcccctaccgtttaccccgggttaccctaaccggaacccggggttaccgtaaccggttacccctaacccgtttaacgtttaccgggtaacccggtaaccccgtaacggttaaacgtacccctaacgtacccgtacccgacccgtacccgtaacccgtacccgtacggtaacgtacggtaaccggaccgtcggtaacccggtaccgggaccgtaccccgggtacgaaccgggtaccgggtccggttacggttaccgttacggtttaccgtcggtaccggtacggtaccgtttagaaacccggttttaaggaacggggttcgggtaccggggtaccggggtttaggttacgggggtttttggggtttacgtttccggtttaccggggggg

SEQ ID NO: 7524 - DNA, 688 bp, Homo sapiens
  misc_feature: GYAE6OF01CYMK9.19.5.A05.1.454.CMB.1.raw
  modified_base (363)..(363): a, c, t, g, unknown or other
  misc_feature (363)..(363): n is a, c, g, or t
  modified_base (429)..(429): a, c, t, g, unknown or other
  misc_feature (429)..(429): n is a, c, g, or t
  modified_base (549)..(549): a, c, t, g, unknown or other
  misc_feature (549)..(549): n is a, c, g, or t
  modified_base (647)..(647): a, c, t, g, unknown or other
  misc_feature (647)..(647): n is a, c, g, or t
tcagtactctcgtgcacgaccggtgctcgatttagatagatagacgagggggtctccctcactgcccagctgggatctcgagggcttctatttttctcgtccctccaccatcatggacgtccaaccgcctactccctcgcccctcctcccgtggtcttcgttcctaccgaaggtcgtcgtgtcggccggagggtgcgagtcgtggtcacgtagtcgtggagtacgaggagggtacggaagggaccgggacccgggtagtcgtcgtaggacgtacgttcgttacggtaagttaacgttcgttacgtagttacgttccgtaaggtttacctaagtagttaggttggacgttcgggacgttgggcnccggacgcggaccgacccggtacccgaagtacgggctaggggtaaggtgtaaggtagataccgtanccgttagccgtggactgtactgacgtcgaacgtatacgactacccgtctaccgtagacggcctacgtcacttacgtacgacgaaccgacacgtacacgacaccgccgacccaccggtacncgacgacgtacgagaccgtacgaccggaccgtcgtaccggcacgggtccgttacggtacttacggtactgacgcgtagtacgaacgttagtaacgggnggtcggtacgggtgttacggttaggttcggtacgttacggg

SEQ ID NO: 7525 - DNA, 853 bp, Homo sapiens
  misc_feature: GYAE6OF01D9C0W.19.5.A05.1.454.CMB.1.raw
  modified_base (192)..(192): a, c, t, g, unknown or other
  misc_feature (192)..(192): n is a, c, g, or t
  modified_base (795)..(795): a, c, t, g, unknown or other
  misc_feature (795)..(795): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagcgtggtgcgtagtctggacncaggaggtgaggggacggcccgggggattcctcgtggaggtactcgttcggttagtaagtacttcgtggtacttcgtaaggtttactaacgtattagttaggacgttccgggcggttaggggccgaccggccccgaggccgtaaccggggacccccggaacggtaacggggtcccggtaggggtaagggttacgggtaaggttacggggtaaacttaccgactttaccgttacgttcccggtaagggaacgttcctaccgtagtactaccgggacctaacggtaaaccttaccgttaaccccgttccccgtttacccgttaaaccgggacccggtacccggtaaccgttaaccctaacccgttaacgtttacccggaaccgtacccccggaaacgtaaaccggtccctaagtacccgtacccggaacccctccccgtaacccgttaccgtaccggtaccgaacgggttacggaaacccgcggtcccggtacgggaaccccggtccgtaccgggaaccgtaccggcccgggttaccgttaacgttaacgttaccggtcggtacgaggtaccgttactaacggttaacggaaacgggttccgggnggggttaccgggttaggttttacggggttttcgggtttagttccgggtttaacggggg

SEQ ID NO: 7526 - DNA, 664 bp, Homo sapiens
  misc_feature: GYAE6OF01B3N6I.19.5.A05.1.454.CMB.1.raw
  modified_base (153)..(153): a, c, t, g, unknown or other
  misc_feature (153)..(153): n is a, c, g, or t
tcagtactctcgtgcacgaccggtgctcgatttagatagatagacagggggtctccctcactgcccagctgggatctcagggcttcattttctgtcctccaccatcatgagtcaaccgccatcctcgccctcctcctggctgttctccaaggngtctgtgccgaggtgcagctggtgcagtctggagcagaggtgaggaacggcccgggggatctcgtggaggactctcggtgtaacgtactttcgtggtactttcaggttttaactactattagttaggagttcggctggggtgcgccaaggtccgacggccccggaagaacgggcccgtaggggacggtagggacgtggggtaaactcgtattccgtattcccgtgggactacgtcgtgaacgtgccaatactaccgacgtcccgttctaccgacggcccgtacgttaccacctattacctacgaccgaactaacgtactactacacgaccgtacccgtacctcctcgacgtacgtacggaacgacggtccgtacgtaccggcccgtaccgggacgacggccgggtccgtacgttaacttcgttacggtacgacggtacggtactaacgtacgtaaaacggttggggtacggtcgggtcggtagggtttgggtttacggttaggtttccggg

SEQ ID NO: 7527 - DNA, 938 bp, Homo sapiens
  misc_feature: GYAE6OF01EX9Q7.19.5.A05.1.454.CMB.1.raw
tcagtactctcgtgcacgaccggtgctcgatttagatagatagacgagggggtctccctcactgcccagctgggatctcagggcttctattttctcgtcctccaccatcagtggacgtaccaacccgcctactccctccgccccttcccgtcctggccttcgtttccacccgaagggagttcttggtacgccggaggttcgcacgtcgtgggtcactacgtcgtaggacgcgaaggtaggggtaggaacggggaaccgggtccccgggggtagttccggttacgtacgggtaaggttcgttaccgtttacggtacgttaaacgttacctttggtacggtttactttaccgttacggttttaacctaacgtagtttacggtggtacgttcgggttcggttcggggtacgcccggtaccgaccggtaccgacccgggacccggaacggtaacgggtccggtacgggtagggtacggtaggtaggtaactcgttacgttacgtaccgtcggtaggtacctacgttcgtacgtacgccgaacgtaacgttacctacccgtaccgtttaccccggtaaccgttaccggaacggtcccgtaacggttacccgtaacctttaccgtttacccggaaccgtaacccggttaaccgtacccgacccgttaacacccggtaccgacccgtaccccgtacccgtaccggtaccgtaccggtacggtaaccggaaccggtaccggttacccggaccggtcccggtacccgggaacggtaccggtaccggggttacccgttaaccgtttacggttaccgtttcgtccgggtaacgtaccgtcgttaaacccgttaaggttaaccgggtaaaggggttcccggggtaagggtacccggggttgggggtttaaccgggtttttcgggttttcgggttcccgggttaacggggg

SEQ ID NO: 7528 - DNA, 865 bp, Homo sapiens
  misc_feature: GYAE6OF01EPGKE.19.5.A05.1.454.CMB.1.raw
  modified_base (213)..(213): a, c, t, g, unknown or other
  misc_feature (213)..(213): n is a, c, g, or t
  modified_base (362)..(362): a, c, t, g, unknown or other
  misc_feature (362)..(362): n is a, c, g, or t
tcagtactctcgtgcacgaccggtgctcgatttagatagatagacgagggggtcctccctcactcgcccagcgtgggatctcgagggtctttctattttctcgtccctaccaccatcagttggaacgtaccaaccgcctactcccttccgccccttcctccgtggtccttgttccaccgaaggtcttcgttggcggccggaggtgacgtcggnggtggtcgagtagttcggagggacgacgtagggacgggtagggaacgggaccggggtccgggttatcgtacggaggaacgttcgtcgtacggttaagtacgtacgttgtacggtacttagtacgttacatagttagtcggtacgtcggnggttacggccgaccggtcgacggtccggaaccggaccgggaaaggttaccgggtccggtagggtaaggttcggaagggtacgtaacttcgtaaacgtttccggtactcgggtaggtactactcggtagacgttacgacttacgtaaacccttccgggttccttaccccggttaacaacccggtacggtacccgttaaaccgttcccttaacggttaacctacccggaaccgtaccgtaaacgttaccccgtacgtacgaacccgtaccggtacccctaccggttaccctacgtcgtaaaccggtcggaacggtccgaacggtcgtaaacccggggcccgtacgggtaccgaggttcccgggccgttacggtttacccgtaggttaccgggtacgaccgtacggttaaacgttaccttaaaggggttaaccccgggaagggttccggggtacgggtaccgggtttagtttaaggggttttcggttagggtcgggtaacccgggg

SEQ ID NO: 7529 - DNA, 784 bp, Homo sapiens
  misc_feature: GYAE6OF01EQ84R.19.5.A05.1.454.CMB.1.raw
  modified_base (146)..(146): a, c, t, g, unknown or other
  misc_feature (146)..(146): n is a, c, g, or t
  modified_base (152)..(152): a, c, t, g, unknown or other
  misc_feature (152)..(152): n is a, c, g, or t
  modified_base (156)..(156): a, c, t, g, unknown or other
  misc_feature (156)..(156): n is a, c, g, or t
  modified_base (167)..(167): a, c, t, g, unknown or other
  misc_feature (167)..(167): n is a, c, g, or t
  modified_base (187)..(187): a, c, t, g, unknown or other
  misc_feature (187)..(187): n is a, c, g, or t
  modified_base (289)..(289): a, c, t, g, unknown or other
  misc_feature (289)..(289): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctctcctggctgttcncaaggngtcngtgccgaggtncagctggtgctagtctggancgaggaggtgagggacggcccggggtatcctgtggagtatcgtcgtagtaagtcttcgtggtacttcgtaggttttactaacgtattagttggagttccggngttagggttcggccgtaccgaggcccgaccggaccccgggaagaaccggggtcccgttaggggagggttgggtaaggttaggggtaaactcgtaacgttacgttaaccgttccggtacgggtacgtaccgttcgtaagtacttaccggacgtaaacggtaccttaaccgtccccgtttacccccggtttacccgttaaccggaaaccgggtcccgtaacgttacccgtaaccgtttaccgtttacccgaccgtacccgtaaacgtacgtaacccgtacgtacccgaccgtaccccgtaccccgtacccgttaccgtcgtacggtacggttaaccgaaccgtacggtacccggtaaccgggtacccggccgttaaccggacgtccgggtccgtaccgttcgttacgttaccgtggtacgacgtacgtacgtaacgtacggtaacgggtgggacgggtcggtacggttgggtttacggtttgtcggtttaccggggg

SEQ ID NO: 7530 - DNA, 925 bp, Homo sapiens
  misc_feature: GYAE6OF01BW4FC.19.5.A05.1.454.CMB.1.raw
tcagtactctcgtgcacgaccggtgctcgatttagatagatagacagggggtctccctcactcgcccagcgtgggatctcgagggtctttctatttttctcgtccctaccacctatcagtggagtaccaaccgcctactccctccgtccccttcccttcccgttcggtccgtttcgtttacctaccgaaagggtcgttcgttcggtcggaccggagggttcgacgaggtcggttgggtacgcgtacggttcggtgggacgacgtagggaggtaggggaacgggaacccgggtccggggttcgttacggtcgtaggacgtacgttcgttaggttacgttaacgtcgtttcgtaggtacgtttacggttaacggtttaacttacgagttttcggttacggtacggttccggtgggttacggcgacccggtcggaaacggcccggaacccgggtacccggaagtaccgggtcgggtaggtaggttagggaaggttacggtactacgtaacgttctacggtccgaggtaacttccgtagtacgagtacccggtacgtacgttaacgtacccgtacccgtttacccgttaacccggaacggtacccgttaccgtaacttaccgtaccgtttaacgtccgaaccgtaccgaacctacgtaaccgaccgtaaccgtaccggcccctacccgtaccgtaccggcggtaaccggtaggaaccccgaaccgtcggtaaccccgtcgggtaaaccccgcgggtacccgaaccggccggttacgttcccgtttaagttacccgggtttacggacggttaccgaccggtaaacgttaacggttaacggttaaacggggtaggttacccggggggtcggttacggggtttacgggttttacgggtttacggttttaacgggttccgggggtaaaccggg

SEQ ID NO: 7531 - DNA, 792 bp, Homo sapiens
  misc_feature: GYAE6OF01BNGJJ.19.5.A05.1.454.CMB.1.raw
  modified_base (188)..(188): a, c, t, g, unknown or other
  misc_feature (188)..(188): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
tcagtactctcgtgcacgaccggtgctcgatttagatagatagacagggggtctccctcactgcccagctgggatctcagggcttctattttctgtccctccaccatcagtggagtccaaccgccatccctcgccctctcctggcttcgtctaccaaggtgtctgtgccggaggtcgcagcgtggtcncgagtcgtggagcgaggaggtcggaaggacggccgggatcgtcgnggacgtntcgtaggtataacgtcttcgtggtacttcgttacgtttaactacttaagttagttaggtcgtcggtcggttcggggtcgccgaccgacggaccgaccgggaccccggaacggacgggtacccggtagggtaccggtaggggtaaggttacgggaaaccttcgtaacgttcgttaaccgtcggttaggaccgttacttcgtaaggtactacgtacgaacgttaaccgttacccgtacccgttcccgttacccgttaccggaacggtacccgtacgtaccgtccgttaccttaccgaaccgtaccggtactaaccgtacgaacgtaccgaccgtacccgacccgtaccgtaaccgcgtaccgacggttacaaccggtaccgtccggaccggtacccggcccggttaaccggacggaccgggttaccggtacccgtttagttaccggttacgtcggaaccgtaccgggtataccggttaagttaacggtaaggggtccgggtacggtacgggttgggtttacgggtttcggtttacggttcggttaaaccggggg

SEQ ID NO: 7532 - DNA, 763 bp, Homo sapiens
  misc_feature: GYAE6OF01CFN2F.19.5.A05.1.454.CMB.1.raw
  modified_base (165)..(165): a, c, t, g, unknown or other
  misc_feature (165)..(165): n is a, c, g, or t
  modified_base (184)..(184): a, c, t, g, unknown or other
  misc_feature (184)..(184): n is a, c, g, or t
  modified_base (485)..(485): a, c, t, g, unknown or other
  misc_feature (485)..(485): n is a, c, g, or t
tcagtactctcgtgcacgaccggtgctcgatttagatagatagacaggcaggggcagcaagatggtgttgcagacccaggtcttcatttctctgttgctcgtggatctcgtggtcgtccggttacgggactagtcgtgacctcggaccctatccacaagaccacngtggtctgtcgtcgtcggngggacgaacggaccggtccaacctatacaacgtgaccgacgggtaccaggtacgtaagttagtttaacgtttacgaacccgaaccaaaccccgtaaagtaaacgtaaacgtaacgttcgttgggtactttaggtactacggacgacggaaaaccaaaccgaggaaccaccgtaccctaacctaactcgcttactttagtttacgcggtacctacgtaccggtaaccggtaggttcccggtccgtagtcgtagtcgacggtccagtcggtcgtcggtacgacggttactacgttaccttccnccgtacctaacccgacaactcgacgtcgcgtaaccgtgacgtaggtaccgtagacggttaggtcggtagtaccgttatacggttaacttacgtaacgttaatacgttaagttacggtaacgtacggtaccgttacgttaccggtaccggtcgtaagggtacctagggtaatacggtcgtaaacgtaccggtacgttaccgggaacggttccttaccgaacccgttccttaaacccggtttcgttacgtttaaccgttcccgtttacccttacccccgg

SEQ ID NO: 7533 - DNA, 706 bp, Homo sapiens
  misc_feature: GYAE6OF01C4YTV.19.5.A05.1.454.CMB.1.raw
  modified_base (161)..(161): a, c, t, g, unknown or other
  misc_feature (161)..(161): n is a, c, g, or t
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
tcagtactctcgtgcacgaccggtgctcgatttagatagatagacagggggtctccctcactgcccagctgggatctcgagggcttcatttttctcgtcctccaccatcattggacgtccaaccgccatcctcgcccctcctcctggctgttctccaaggngtctgtcgccgaggtgcagtctggtnactagtctggancgtaaggaggtggaacggaacggcccgggggattcttcgaggaggtactccggtacgtagttaaacgtcttacgtggttactttacgttaagttttaacacgttaagttacgttagggtacgtcggtacggttgggcgaccgccggaacgtcgaaccgggaccccgtaagaaccggtcggtagggaacggtgggtaagttacgggaattccgaacttctaacggtccgtagggactcgttagtacgatccgacgtaacgtactacccgtaccttcccgtttaccgacgtaaacggtccgaactccctacttacgttacacgtacaaccgtacgtctaacacacgacccaccgtccctaccgcggtaccgtagaccgaaccgacggtccgaaccggacgtacccggtacgaccggtacgtcggtaccttcgttacttacgcgtaggacgtatcgtaaagtacgaaaggtcggtacgcggtaggttgggtttagtggttacgttcgggg

SEQ ID NO: 7534 - DNA, 506 bp, Homo sapiens
  misc_feature: GYAE6OF02H7GET.19.5.A05.1.454.CMB.1.raw
  modified_base (345)..(345): a, c, t, g, unknown or other
  misc_feature (345)..(345): n is a, c, g, or t
  modified_base (457)..(457): a, c, t, g, unknown or other
  misc_feature (457)..(457): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagcccggacaaggcctggagtggatgggaatcgatctatcctggagactctgatgccagatacnctccgtccttccaaggccgagtcaccatttcacgccgacaagtcatcagcaccgcctacctgcagtggaacagcctgaccgccgtcggacagcggcgtctattactgtgcgngctatacaaagtgggtggcggcgtaggggttggttttggtagtttcggg

SEQ ID NO: 7535 - DNA, 501 bp, Homo sapiens
  misc_feature: GYAE6OF02HJ44P.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctatgccgaggtgcagctggtgcagtctggagcagaggtgaggaagcccggggagtctctgaggatctcgtgtaagacttctggattcaggtttactacatattggatcggctgggtgcgccagcagcccggacaaggcctggagtggatgggaatcatctatcctggagactctgatgccagatacactccgtccttccaaggccgagtcaccatttcagccgacaagtccatcagcaccgcctacctgcagtggacagcctgacggcctcggacagccggcgtctattactgtgcgagctattacaaagtgggtggcggcgaggggttggttttgagtttcgg

SEQ ID NO: 7536 - DNA, 511 bp, Homo sapiens
  misc_feature: GYAE6OF02HC27M.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagcccggacaaggcctggagtggatggggaatcatctatcctggagactctgatgccagatacactccgtccttccaaggccgagtcaccatttcagccgacaagtccatcacgcaccgcctacctcgcagtggaacagcctagacgcctcggacacgcggcgtctattactgtgcggagcattacaaagtgggtacggcggcgaggggttggttttaggtagtttcggg

SEQ ID NO: 7537 - DNA, 510 bp, Homo sapiens
  misc_feature: GYAE6OF02GYTZX.19.5.A05.1.454.CMB.1.raw
  modified_base (494)..(494): a, c, t, g, unknown or other
  misc_feature (494)..(494): n is a, c, g, or t
tcagtactctcgtgcacgaccggtgctcgatttagatagatagacaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatcccggggtcctgaccgattcagtggcagcgggtctgggacagatttcactctcaccatcagcacgcctgcaggctagaagatggtggctagttttattattgtacaaactaattatttattattacttcgtgtacgttcggaccgaagggaccaaggtgatatacgagacgtaactggtggctgacacntctgtcttctattccc

SEQ ID NO: 7538 - DNA, 501 bp, Homo sapiens
  misc_feature: GYAE6OF02IMO1J.19.5.A05.1.454.CMB.1.raw
  modified_base (456)..(456): a, c, t, g, unknown or other
  misc_feature (456)..(456): n is a, c, g, or t
  modified_base (493)..(493): a, c, t, g, unknown or other
  misc_feature (493)..(493): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagcccggacaaggcctggagtggatggggaatcatctatcctggagactctgatgccagatacactccgtccttccaaggccgagtcaccatttcagccgacaagtccatcagcaccgcctacctgcagtggaacagcctgacggcctcggacagcggcgtctattactgtgcgngcattacaaagtgggtggcggcgtagggtggttttgngtttcggg

SEQ ID NO: 7539 - DNA, 509 bp, Homo sapiens
  misc_feature: GYAE6OF02IBQ1F.19.5.A05.1.454.CMB.1.raw
  modified_base (236)..(236): a, c, t, g, unknown or other
  misc_feature (236)..(236): n is a, c, g, or t
  modified_base (429)..(429): a, c, t, g, unknown or other
  misc_feature (429)..(429): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagcttntggattcaggtttactacatattggatcggctgggtgcgcagcagcccggacaaggcctggagtggatgggaatcatctatctggagactctgatgccagatacactccgtcttcccaaggccgagtcacctatttcacgaccgacaagtccatcagcaccgcctacctcgcagtaggacagccagaccggcncggacacgcggcgtctattactgtgtcgagcacgttacaaagtgggtacggcgggcgagggttggtttggtagtttcggg

SEQ ID NO: 7540 - DNA, 514 bp, Homo sapiens
  misc_feature: GYAE6OF02IJC57.19.5.A05.1.454.CMB.1.raw
  modified_base (238)..(238): a, c, t, g, unknown or other
  misc_feature (238)..(238): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttcnggattcaggtttactacatattggatcggctgggtgcgccagcagcccggacaaggcctggagtggatgggaatcatctatcctggagactctgatgccagatacactccgtccttccaaggccgagtcaccatttcagccgacaacgtccatcacgccaccgcctacctgcagtcggaacagcctcgacggccgtcggacacgcggcgtctattactgtgcgagcattacaaagtgggtacggcggtcgtaggggttggttttagtagtttcggg

SEQ ID NO: 7541 - DNA, 507 bp, Homo sapiens
  misc_feature: GYAE6OF02GM8LG.19.5.A05.1.454.CMB.1.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtncgccagcagcccgganaaggcctggagtggatgggaatcatctatcctgganactctgatgccagatacactccgtccttccaggccgagtcaccattcagccgacaagtccatcacgcaccgcctacctgcagtcgaacacgcctcgaccggcctacggacacgcggcgtctattactgtgcgagctatacaaagtgggtacggcggacgtagggtggtttagtagtttcgg

SEQ ID NO: 7542 - DNA, 510 bp, Homo sapiens
  misc_feature: GYAE6OF02FU876.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccgggggagtctctgaggatctcgtgtaagacttctggattcaggtttactacatattggatcggctgggtgcgccagcagcccggacaaggcctggagtggatggggaatcatctatcctggagactctgatgccagatacactccgtccttccaaggccgagtcacctatttcagccgacacgtccatcacgcaccgcctacctcgcagtggaacagcctagaccgccgtcggacgagcgcgtctacttacgtgtgcgagctatacgaaagtgggtggcggcgtagggttggtttgtagtttcgg

SEQ ID NO: 7543 - DNA, 567 bp, Homo sapiens
  misc_feature: GYAE6OF02H3T4L.19.5.A05.1.454.CMB.1.raw
  modified_base (224)..(224): a, c, t, g, unknown or other
  misc_feature (224)..(224): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtcctccagacacactggctgtgtctctgggcgagagggccaccatcaactgcaggtccagcgagagttattttgacagacccaanagtaagaactacttggcttggtatcagcaagaaaccaggacagcctacctaaactcgctactatttagttcgggcactcctaaccgggaaattcggggtcctgtccgattcaggcggcagcgtgcgtgggacagtatttcactctacaccatcagcacgcctcgacgaggctagaacgagtggtcggcggttacttatttacgtgtactaaacaatacttaagtagaaacgtccgtaagggtaccgtttccggaccgttaggggaacttaaagggtgaacgatacgaggaacgtaacgtggtcggtactacgactaccgtaattccgtacgtccttactaccg

SEQ ID NO: 7544 - DNA, 516 bp, Homo sapiens
  misc_feature: GYAE6OF02G9JHT.19.5.A05.1.454.CMB.1.raw
  modified_base (466)..(466): a, c, t, g, unknown or other
  misc_feature (466)..(466): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagcccggacaaggcctggagtggatggggaatcatctatcctggagactctgatgccagatacactccgtccttccaaggccgagtcaccatttcagccgacaacgtccatcacgcaccgcctacctcgcacgtggaacacgcctacgacggccgtcggacgagccggcgtctattactgtgcgngcattacaaagtgggtaggcgggcgtaggggtggttttggtagtttcggg

SEQ ID NO: 7545 - DNA, 567 bp, Homo sapiens
  misc_feature: GYAE6OF02GZOEO.19.5.A05.1.454.CMB.1.raw
  modified_base (224)..(224): a, c, t, g, unknown or other
  misc_feature (224)..(224): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagttattttgtacagacccaanagtaagaactacttggcttggtatcagcagaaaccaggacagcctcctaaactgctctatttagttgggcatccgtaacccgggtaaagttcggggtccctggtccgtattcgagcggcagcgtgtcgtgggacagtactttcactctacaccatcagcagcctgcgaggctagaagtatggtcggcgttactagttactgtaccaactaattattaatagtaaacgtccgtaggttactttccggaccgtagggtaacgtaagggtagagtactacgagtaacggtaacgtcggtcggacgttacgacctaccgtagttccttcggtttccttacccttacg

SEQ ID NO: 7546 - DNA, 508 bp, Homo sapiens
  misc_feature: GYAE6OF02FF16D.19.5.A05.1.454.CMB.1.raw
  modified_base (188)..(188): a, c, t, g, unknown or other
  misc_feature (188)..(188): n is a, c, g, or t
  modified_base (274)..(274): a, c, t, g, unknown or other
  misc_feature (274)..(274): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggancagaggtgaggaagcccgggggagtctctgaggatctcgtgtaagacttctggattcaggtttacacatattggatcggctgggtncgcagcagcccggacaaggcctggagtggatggggaatcatctatcctggagctctgatgccagatacactcccgttccttaccaaggccgagtcacctatttcagccgacaagtccatcagcaccgcctacctgcagtgaacagcctgacgcctcggacacgcggcgtctatactgtcgcgacgcacttacgaaagtgggtggcggcgtagggtttggtttaggtatttcggg

SEQ ID NO: 7547 - DNA, 507 bp, Homo sapiens
  misc_feature: GYAE6OF02IJYIB.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgtacagacccaacagtaagaactacttggcttggtatcagcagaaaccaggacagcctacctaaactgctcatttatgggcatcgtaccggaattgggtccctgtccgattcagcggcagcgtgtcgtggacagtatttcactctacaccatcagcagcctgcaggctgaagatgtggcggtcttattactgtacaactaatattatagaaagtccgaagggtacgtttcggccgttagggactaagggtgagatcgaagacgaacgtgtggctggacaccgtatcctgtccttcacc

SEQ ID NO: 7548 - DNA, 528 bp, Homo sapiens
  misc_feature: GYAE6OF02FX0KJ.19.5.A05.1.454.CMB.1.raw
  modified_base (327)..(327): a, c, t, g, unknown or other
  misc_feature (327)..(327): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccgggggagtctctgaggatctcgtgtaagacttctggattcaggtttactacatattggatcggctgggtgctccagcagcccggacaaggcctggagtggatgggaatcatctatcctgganactctgatgccagatacactccgtccttccgaaggccgatccacctattcacgccgacaagtccatcacgccaccgcctacctcgcagtggaaccacgccgtcgaccggccgcggacgacgccggcggtactacttactgtgcgagctatacgaaagtgggtcggcgggtccggtagggttcggttttaggtagtttcggg

SEQ ID NO: 7549 - DNA, 565 bp, Homo sapiens
  misc_feature: GYAE6OF02JAMT2.19.5.A05.1.454.CMB.1.raw
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
  modified_base (430)..(430): a, c, t, g, unknown or other
  misc_feature (430)..(430): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtgagggaagcccggggagtctctgaggatctcgtgtaagacttctggattcgaggtttactactattattggaactcggcgtggggtgcgccagcaggccccgganaacgggcctgggagtggagtgggaatcgattctatccgtggactactnagatcgaccagactacacctccgtccttccgaaggccgatccactattcagccgacacgtcatacacgccaccgcctaccngacagtacgaacacgccgtcggaccgccgtacggaccgagccgggcttcgtattacgtgtcggcgtacgacttacttaacgaaaggttggggtacggtcgggtcggtaggggtttggttttcgtaggtttacggg

SEQ ID NO: 7550 - DNA, 594 bp, Homo sapiens
  misc_feature: GYAE6OF02JBB8G.19.5.A05.1.454.CMB.1.raw
  modified_base (355)..(355): a, c, t, g, unknown or other
  misc_feature (355)..(355): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagttattttgacagacccaacagtaagaactacttggcttggtatcagcagaaaccaggacagcctacctaaactgctctatttatgggacatccgtacccgggtaaagttcggggtccctggtccgtattcaggcggcagcgtgtctggganagtattcactctccacatcagcacgcctgcgaggctaggaagtagtggtcggcggttcttaatttacgtagtacaactaattattagtaagaaacgttccgtacgggtaccttttccgggacccgttagggtaaaccgttaaggggtggtaaggtacgtaacgaacgggtaaccgtaaccgttggggtacggtccgtacggaccgacccgtattccgtacggtttaccttacgttaccg

SEQ ID NO: 7551 - DNA, 637 bp, Homo sapiens
  misc_feature: GYAE6OF02IY5IX.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaaggcccggggagtctcgtgaggatctcgtgtaagtacttcgtggattcgtaggttttaactactattagttggatcggcgtggggtgccgccagcgacggcccggaacaacgggccgtagggaggtggagtgggaatcatctatccgtggactactcgtgatcgacagtactacaccgttcccgtcctaccgaacggtcccgtaagtaccaccgtactttaccacgaccgaacgaacgtaccactaccgacgacccacccgtacctaccgtcgacgacggtacgaacgacgccgtacggaccggcccgtacggacgaccggccgggtccgttacgtacgttacgtcggtacggccgaacgtactaacgttaacgaaacggttgggtacgggtccgggtacggttaggggtttcgggttttaggtacggtttccgggg

SEQ ID NO: 7552 - DNA, 617 bp, Homo sapiens
  misc_feature: GYAE6OF02IMURE.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtatttgacagacccaacagtaagaactacttggcttggtatcagacaagaaaccaggaacagcctacctaaactcgactactattttagttgggcctagtccgtaacccggggtaaagtttcgggggtaccccttcggtaccgtaactttcgacggtccggcacggtcggtagtcgtaggggaactaggtattttccgacttctaccgaaccatccaagccagccctagcgaagggcttaggaaagagttggtcggcgttacttaactttactcgtacaaactaataactttaatagaaacgttccgtaagggtacctttcgggcccgtagggaactaaagggtcggaagagtccaaggtaaccgaacgttcggtagccgtagccgtaacctatcgttacgtccttacgtacg

SEQ ID NO: 7553 - DNA, 585 bp, Homo sapiens
  misc_feature: GYAE6OF02FRQ87.19.5.A05.1.454.CMB.1.raw
  modified_base (188)..(188): a, c, t, g, unknown or other
  misc_feature (188)..(188): n is a, c, g, or t
  modified_base (238)..(238): a, c, t, g, unknown or other
  misc_feature (238)..(238): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggancagaggtgaggaagcccgggggagtctctgaggatctcgtgtaagcttcnggattcaggtttacacatattggatcggctgggtgcgccagcagcccggacaggcctggagtggatgggaatcatctatcctggactactctgatgccagatacactccgtccttcgaaggccgagtccacctactttcacgccgacaacgtccatcacgccaccgcctacctcgccgagtacggaaccacgaccgtacggaccggcccgtaccgggacgacggccggtccgttaccgttattaccgttgtcggtaccggacggtacctaacgttaacctaaaaggttcggggttacgggccgggtcgggttaaggggtttcgggttttaggtacgttttccggggg

SEQ ID NO: 7554 - DNA, 598 bp, Homo sapiens
  misc_feature: GYAE6OF02HQ129.19.5.A05.1.454.CMB.1.raw
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagccggggatctctggagatctgtagtaagactttctggattcgtaggtttactacatattggatcggctgggtgcgcagcncgcccgganaacggccgtggagtggatgggaatcatctatccgtaggagactgtgatcgaccaagtactaccacttcccgtccttaccgaaggcccgagtaccacctacttacacgaccgacaacgtcactcgacgcaccgacctacctcgacagtacgaacacgaccgtacggaccggacccgtacggacgacggccggtacgtaccgttacgttacgtcggttcgacggacgtaccgtaacgttacgtaaaggttgggtacgggtacgggtacggttacggggtttacgggtttttaggtacggtttaccgggg

SEQ ID NO: 7555 - DNA, 570 bp, Homo sapiens
  misc_feature: GYAE6OF02G6OXU.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcgggacatcgtgctgacccagtctccagacacactggctgtgtctctgggcgagagggccaccatcaactgcaggtccagcgagagtattttgtacagacccaacagtaagaactattggcttggtatcagcaagaaaccaggacagacctacctaaactgcctctaatttacttgggctactaccgtaacccgggtaaagtttcggggtccctgtccgtattcgaggcggcagtcgtgtcgtgggacagtatttcactcctcaccatcagcagcctgcaggctagaagtgtggtggcggtcttaattactagttacaaactaattattaagtacgtaaacgttccgaagggttacctttccggacccgttagggtaacttaagggtgaagtacgtacggaagtaacggtaacgtggtcggctagacctactacgtacttcgttcttactacg

SEQ ID NO: 7556 - DNA, 569 bp, Homo sapiens
  misc_feature: GYAE6OF02FSZCW.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctacctaaactgctcatttatgggctatccgtaaccgggtaaagttcggggtccctgtccgattcgagcggcagcgtgtctgggacagtatttcactctcaccatcagcagcctgcgaggctagaagtagtggtacgggtcggttacttaacgttacgttgtaccaaactaattaattatagaaacgttccgtaacgggttaccgtttccgggacccgtagggtaacgttaagggtcgaagtacgtacgaggtaacgtaacgtggtcggtacgtgaccacgtatcgtcgtttacttctacccg

SEQ ID NO: 7557 - DNA, 797 bp, Homo sapiens
  misc_feature: GYAE6OF02IWABX.19.5.A05.1.454.CMB.1.raw
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (244)..(244): a, c, t, g, unknown or other
  misc_feature (244)..(244): n is a, c, g, or t
tcagtactctcgtgcacgaccggtgctcgatttagatagatagacagggggtctccctcactgcccagctgggatctcgagggcttcattttctgtcctccaccatcatggagtcaaccgccatcctcgccctcctcctggctgttctccaaggngtctgtgccgaggtgcagctggtgcagtctggancagaggtgaggaacgcccggggatctctggaggatcgtcggtagtaaagcttcgnggtattcgtaggtttactactattagttggatcggcgtgggtcgcgccagcgacggcccggacgaacggccgtaggagtggacgtgggaatcgatctatccgtaggacgtactctagaactcgacctaagtaactaccaaccgttcccgtacccgttaccggaacggtaccgtaacgtacccgtaaccgttaacgtttaccgaaccggtacccgtaaccgtaaacgttacccgtaacgttaccgaaccggtacccgtaaccccggtaccccttaacccggttcgtaaccgtaacgggttaccggaaaccggtacccggtacccggttacccgggtaaccccgggtaccccgttaacccggggaacccgtaaccggggtacccgggtacccggttaaccgtttaacgtttaacccggttacgggttaccggtaccgggtaaccgttaaccgtaacgtttaaaccggtaaaacgggttcgggggttaaccgggaccgggtacgggttaacggggggttttacggtttttacgggttaacggttttacccgggggg

SEQ ID NO: 7558 - DNA, 718 bp, Homo sapiens
  misc_feature: GYAE6OF02I05NE.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaaggcccggggatctctggaggatctcgtgtaaagtacttcgtggtattcgtaggttttaactaacattaacgtttgggaacttcgggcgttaggggtcgccggcccaaggccaacggccccggggtaacaacgggcccgtaggggaaggttgggaagtggggaaatcgagttcctaatcccgtgggacgtaccttcgtagtatcgcccgtaagaacttaacaccgttcccggtaccctttacccgaaagggcccggtaacgttaccaacctactttacgacgtacccgaacgtaaacgtccgaactacctacgacctaacccgtacctaaccgtcgacctacggtacggaaccgacgtaccgtaccggaccggtacccgtaccgggaccgacggccgggtaccgttacgttacgttacgttacggttcgacggtacggtacctaacgttaacgtaaaggttggggtacgggaccgggtacggtagggggtttacggtttttggtacgttttaccgggg

SEQ ID NO: 7559 - DNA, 607 bp, Homo sapiens
  misc_feature: GYAE6OF02JEBDQ.19.5.A05.1.454.CMB.1.raw
  modified_base (457)..(457): a, c, t, g, unknown or other
  misc_feature (457)..(457): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttcgtggattcgaggtttactacatattggatcggctgggtgcgccagcacgcccggacaaggcctgggagtggagtgggaatcatctatccgtaggacgtactctgactgaccagactacctacgtcccgtaccgttaccgaacggtccgacgtccacctagtttaccacgaccgtaacaacgtccactcacgcacccgtcctacctcgccagtacggaacncgccgtaggaccgtccgtacggacgacggcggtcgtacttacgttacgtcgtcggacggtacgaccttagttaaccgtaaaggttcggggtacgggaccgggtaccggttagggggttttcggtttttacggtacggtttttaaccgggg

SEQ ID NO: 7560 - DNA, 605 bp, Homo sapiens
  misc_feature: GYAE6OF02FL8PD.19.5.A05.1.454.CMB.1.raw
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (432)..(432): a, c, t, g, unknown or other
  misc_feature (432)..(432): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaacggcccggggatctctgaggatcgtcgtagtaagacttcgtggtattcgaggtttacgtactatagttggatcggcttgggtgcgccagcacgcccgganaaggcctggagtggagtgggaatcatctatcctgganactntgatcgcagactacacgtccgtccttaccgaaggtccgagtccactagtttcgacgcccgaacacgtccactcgacgccaccgcctaccngccagtacggaactcgacccgtaggacccggtccgtaccggacgacgggaccggtcgttacgttacgttacgtggtccggtacggaacgtcttaaacgttaacgtaaaagggttcgggtacgggaccgggtaggttagggggttttgggtttttacgtagttttacccggggg

SEQ ID NO: 7561 - DNA, 762 bp, Homo sapiens
  misc_feature: GYAE6OF02I3P4X.19.5.A05.1.454.CMB.1.raw
  modified_base (221)..(221): a, c, t, g, unknown or other
  misc_feature (221)..(221): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggntctcggtgtaagacttcgtggtattcgaggttttacacattagttggattcggcgtgggtcgtaccgccgtagcacggaccccggacgaacgggcctaggggaggttcgggaagtggggaaattccgtaacttcgttaagtcccgtagggaacgtaccttcgtggtaacttcggcccgaagtaacttaccgacctttccccgttacccgttaccgaacgggtcccgtaacgtaccaccgttaacgttttccaacggtaccccgaacgtaacgtccctacgttaccgaaccgccctacccggtacccttaccgttcggaccgacgggttaaccggaaacccgtacgggtacccgttaccgggaacccggtacccggttacccgggaacgaaccgggtcccgggttacccgtttaaccgttacgttttaccgttccgttacggaccgtacggtacttaaccgttaaacgtaaaacggttcggggggtcggtaccggggttacggttacggggttttgggtttttacggtaggttttccggggg

SEQ ID NO: 7562 - DNA, 652 bp, Homo sapiens
  misc_feature: GYAE6OF02JWDG0.19.5.A05.1.454.CMB.1.raw
  modified_base (229)..(229): a, c, t, g, unknown or other
  misc_feature (229)..(229): n is a, c, g, or t
tcagtactctcgtgcacgaccggtgctcgatttagatagatagacaggcaggggcagcaagatggtgttgcagacccaggtcttcatttctctgttgctctggatctctggtgccgttcgggacatcgtgctgacccagtcctccagacacacgtggctgtgtctcgtgggcgagacgggccacatcaactgcaggtccagcggagtagttatttgacacgaacccaanagtaacgaactacgttggcttagggtatcaggaccaagaaaccgaggacacgtcctacctaactcgaccttatatttacgtcgggtacctacgtaccggtaaccgggtaagtttccggggtccctggtaccgtattacgacggacgtcacggtcggtcggtcgtacggggactagtcgtttaccgtatcccgtaccaaccgttactggaactcgaaccgtcctggacgtacggtctagaacgtgtacgggtcggtacgttacgttacgttacgtactaaccgaactaactattaagacgtaacgtcggtacgtaccgttcggtacgtagggaactagggagaagtacgtcggtaacgcggtaacttgggtcgtaacggttcgaaccgttacgtaccgttacgtccgtttaccgtattaccccg

SEQ ID NO: 7563 - DNA, 626 bp, Homo sapiens
  misc_feature: GYAE6OF02FP78Q.19.5.A05.1.454.CMB.1.raw
  modified_base (279)..(279): a, c, t, g, unknown or other
  misc_feature (279)..(279): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctgggagcaggaggtgagggaacggcccggggagtctctggaggatctcgtagtaagacttcgtggtattcgaggtttactacattattggatcggngtgggtgcgccagcacggcccggacaggcctggagtggatgggatcatctactcgtgganactntgatcgacagactaccaccgtcccgtccttaccgaaggcccgtagcctacctatttccacgacccgaactaacgtaccactcgacgaccacccgtcccgtacctcgaccgagtacggtaaccgacgtccgtacggtaccggacccgttaccggacgtacggccggtccgttacttacgtttacgtcggtcggtacggaacgtacgtaacttaacggaaaaggttcgggggtacgggcgggtacgggttaggggtttcggtttttaggtagttttacccggggg

SEQ ID NO: 7564 - DNA, 810 bp, Homo sapiens
  misc_feature: GYAE6OF02H3OFW.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtgagggaaggcccgggggatctcgtggaggattctcgtgtaagactttctggtaattcgtaggttttaacctactaattagttggaagttcggcgttggggtgccgccgaagcgaccggaccccggaacgaacggtccgtagggtaggtagggagtagggggtaaatcgattcctaacgtccgtaggagtaccttcgtgaacttggacctaaggaacttaccgaccttccgttacccttaccgaacggcccgtacgtacctaacctactttccgaacgacccgaaccgtaaacgtacccaattaccgacgtaccgaaccccgtacccttaacccgtcgaccgtaacgggttacggaaacccgtacgggtacccgtacgggacccgggtaccccggttacgggaacccggtacgggacccgggttaccggttacccgtttaaccggttttacccggttacgggttacccggaccgggtaaccgggtaccctttaaaggttaaacccggtttaaaaagggttccggggggttaacgggaccccgggggttaacggttaacggggggggttttttacgggtttttacggggttaacggttttttaacccccggggggg

SEQ ID NO: 7565 - DNA, 565 bp, Homo sapiens
  misc_feature: GYAE6OF02HQJ4D.19.5.A05.1.454.CMB.1.raw
  modified_base (154)..(154): a, c, t, g, unknown or other
  misc_feature (154)..(154): n is a, c, g, or t
  modified_base (458)..(458): a, c, t, g, unknown or other
  misc_feature (458)..(458): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccgaggtgcagctggtgcagtctggagcagaggtgaggaagcccggggatctctggaggatctcgtgtaagcttctggatttcaggtttactacattattggatcggctgggtgcgccagcagccccggacaaggcctgggagtggatggggaatcgattctatccgtaggacgactcgtgatcgccaagactaccaccttcccgttccttacccgaaacggccgtacgtccaccgtactttccgacgcccgaacgaacgtccatcacgccaccgtcctacctcgacagacggaacncgccgtgaccggcctcggacgacggcggtcgtcttagttacgtgtcgacggcgactattacgaaagtgggtacggcggtacggtagggttggttttcgtagtttcgg

SEQ ID NO: 7566 - DNA, 806 bp, Homo sapiens
  misc_feature: GYAE6OF02GBYQ2.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtggagggaacggccccggggagtccgtcgtggaggattccgtcggttagtaaacgctttcgtgggtactttcgtaaggttttacctaactattagttgggacttcggcgtggggtcgccgccgagccgacggccccggaacgaacggccgtagggagtggagtggaatcatctatccgtaggacgacttcgtagactcgaccaaggtacttaccgacccgtttcccgttacccgttacccggaaacggtccccgtaacgttcccgtaacccgttaacttttaccgaaccggtaccccggaaaccgtaaccgttacccgtaaacttacccgaaccgacccgtaaccccgttaccccttaacccgtccgtaaccgtaacgggtaaccggaaaccgaaccgtacccggtaccgggaccccgggtacccggtcccgggaaccgacgggtcccgggtaccgtttaccgttaacgtttaccgttcggttaccgggaccggtaacggtaaccgttaacggtttaaaccgtaaacgggtttacggggttacgggtccggggttaaccgggttagggggtttttacgggtttttacgggtttacggttttaacccggggg

SEQ ID NO: 7567 - DNA, 612 bp, Homo sapiens
  misc_feature: GYAE6OF02FG9EN.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagccgagagtattttgacagacccaacagtaagactacttggcttgatcagcaagaaccaggacacgcctcctaaactgctcatttatggcatccgtaaccgggtaaagttcgggtccctgtaccgattcagcggcacgcgtgtctgggacagtactttcactctccgaaccactcacgcacgtcctgcaggtctagaacgtagtggtaggtccggttacttaacttacgttacgtacccaaataaccttaagttaacgtaacgtaaacggttaccgtaagggttaacccgtttacccgggtacccgttaagggttaaacgtaacgggtagtaagtacgtaacgtacggtaaacgtaacgtcggtacggtcgtaacggtacctaccgtacttccgttacgttaccttacctaaccg

SEQ ID NO: 7568 - DNA, 815 bp, Homo sapiens
  misc_feature: GYAE6OF02HWBAW.19.5.A05.1.454.CMB.1.raw
  modified_base (286)..(286): a, c, t, g, unknown or other
  misc_feature (286)..(286): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtgaggaaggcccggggagtctcgtgaggatcgtcgtagtaagacttctggtattcgtaggtttacctacattagttggatcggctggggtnccgcagcacggcccggaagaacggtccgtggacgtggagtcgggaatcattctacttccgtagggacgtacttcgtagacgtacggccctaaggtaacttaccgacccgtttccccgttaccccttttaacccggaacggggtacccgtacgttaccctaacccttaacgttttaccgaaccggtaccccgtaaaccgtaacgttacccaacgttaccgtaaccggtaccctaacccccgtacccgtttaacccggtccggtacccgtaagggtaccgggaaaaccgtaccggtaccccggttaccgggaacccgggtccccgttaaccgggaaccgtacccggggtacccgggtccggtttaacccgtttaacgtttaaccggttcgggttaccgtccggggtaaacgtacccgttaaacgtttaaaccggtaaaacgggttcggggggttaacggggtcccggggttaacgggtttaggggggtttttacggggttttttacgggtaacggttttttacccgggggg

SEQ ID NO: 7569 - DNA, 841 bp, Homo sapiens
  misc_feature: GYAE6OF02GR4RW.19.5.A05.1.454.CMB.1.raw
  modified_base (192)..(192): a, c, t, g, unknown or other
  misc_feature (192)..(192): n is a, c, g, or t
  modified_base (242)..(242): a, c, t, g, unknown or other
  misc_feature (242)..(242): n is a, c, g, or t
  modified_base (296)..(296): a, c, t, g, unknown or other
  misc_feature (296)..(296): n is a, c, g, or t
tcagtactctcgtgcacgaccggtgctcgatttagatagatagacagggggtctccctcactgcccagctggggatctcagggcttcattttctgtcctccaccatcatggagtcaaccgccatcctcgccctctcctggctgttctcaaggagtctgtgccgaggtgcagctggtgcagtcgtggagcagnggtgaggacggcccggggatctcgtggaggtatctcgtagtaagcttcgnggtattcgtaaggttttactaactattacgtttgggacttcggggcttggggtnccggtaccgtaggccgtacgggccccgggtaacgaacggggtccccgttagggggaacggttcggggaaggttacgggggtaactacggtaattccgttaaacttccggttaagggacgttaccgttcgttacgacgttccggacccgtaaggtaacttaacccgtaacccgtttcccgtttacccttaacccggaaacgggtacccgtacgttacccgtaacccgttacgttttaccgaaccgggtacccgtaaaccgtaaccgttaccgtaacgtaccgaaccgtcccgaaccccggttacccgttaacccgacggtacccgtaaacgggttaccggaaaccggtaccggtacccgtacggggaaccccggtacccggttacgggaaccggtacgggtcccgggaccggtttacctaacgtttcggttacggtaccggtacggtaacgtaccgttaaattaaccggtaaacgggtttcggggtacggtaccggggtaccgggttaggggttttacgggttttcggtaccggttttaccggggg

SEQ ID NO: 7570 - DNA, 829 bp, Homo sapiens
  misc_feature: GYAE6OF02ILMZ7.19.5.A05.1.454.CMB.1.raw
  modified_base (153)..(153): a, c, t, g, unknown or other
  misc_feature (153)..(153): n is a, c, g, or t
  modified_base (230)..(230): a, c, t, g, unknown or other
  misc_feature (230)..(230): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctctcctggctgttctccaaggngtctgtgccgaggtgcagtctggtgcagttcgtggagcaggaggtggaggaacggcccggggatcctcgtggaggtnttcctcggtagtaacgtcttcgtggtattccgtaggtttaactactattagttggatcggcgtgggtcgccggccgagccgtacggaccccggacgaacgggcccgtagggaggtgggtacgtaggggaacttaccgtaacttccttaacgtcccgttacgggacgtacgtacgtaggtacgtccggaccgaacggtaactaccgtacccgtttccccgttacccgtttaacccggaaccgggtcccggtaaccgttaccctacccgttaccgttttaccgaccggtacccggtaaacctaaccggttaccaacgtacccgaacggtacccgtacccggttaccccttacccggtacgtaccggtaaccgggtaccgggtaaaccgaccgggttacccgtaccgggtacccgggtaccccgttaaccgggaacccgaccgggtccggtcccgtttaaccgttacgtttaaccgttcggtaccggttaccggtacggtacccgtaagtttaaacccggtaaggttccgggggtacgggtacgggttaccgggttaacgggggttttacggtttttacgggttacggttttaacccggggg

SEQ ID NO: 7571 - DNA, 639 bp, Homo sapiens
  misc_feature: GYAE6OF02GQ9LR.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagcgtggtgcagtctggagcagaggtgaaggaacggcccggggagtctcgtggaggactcgttcggtagtaagtaccttcgtgggtacttcgtaggttttaactactaattagttggtacgtcggtcgttggggtcgtccggaccgagccgaacggccccggaacgaacgggtccgtagggaggtacgggagtagggaactcgattctaagtccgtaggacgtactgtgatcgactagactacgtacctccgtacctacgacggaccgtagtaccacctacttacacgaccgactaacgtacctacaccacgcccgacctccctacctcgacgacgtacgacgcgaccgtacgaccgccgtacggacgcgcggtcgtacgtacttcgtagtcgacggacgtacgtactaacgtaaaggtgggtacgggcggtcgggtagggtttaggttttacggtacgtttaccgggg

SEQ ID NO: 7572 - DNA, 696 bp, Homo sapiens
  misc_feature: GYAE6OF02I8KUT.19.5.A05.1.454.CMB.1.raw
  modified_base (157)..(157): a, c, t, g, unknown or other
  misc_feature (157)..(157): n is a, c, g, or t
  modified_base (182)..(182): a, c, t, g, unknown or other
  misc_feature (182)..(182): n is a, c, g, or t
  modified_base (199)..(199): a, c, t, g, unknown or other
  misc_feature (199)..(199): n is a, c, g, or t
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
  modified_base (394)..(394): a, c, t, g, unknown or other
  misc_feature (394)..(394): n is a, c, g, or t
tcagtactctcgtgcacgaccggtgctcgatttagatagatagacgagggggtctccctccactgcccagctgggatctcagggcttcattttctgtcctccaccatcatggagtcaaccgccatcctcgccctcctcctggctgttctccgaaggngtctgtgccgaggtgctagttggtncgagtctggagctaggnggtagagggtaacggcccggggattctcgtaggacggtatcgtcggtagtaacgtccttgtagggtattcgtaggttttaacagtattagttggaacgtcgggcttgggtanccgcgaagcacggcccggtaanacggctggagtgatggaactcgatcgtatccgtaggactactgagatcgacctagactacncgttcaccttacgagccgatctactcgttacagtccgactacgacacgtacacgacccgtaccgtaccctacccgtacggaccgtaacgggtaccggaacccgaacgcccgttacggtaccccgggacccgttacgggaaccgaccgggtttaacccgggcccttaacgttaccggtttaacccgtaagggttcaccggacggttaaccctaagtttaaacccggaaaggttccggggttaacgacccggggttagttaaccggggttttaggtttacgttacggtaccgggtaaccggggg

SEQ ID NO: 7573 - DNA, 636 bp, Homo sapiens
  misc_feature: GYAE6OF02GKHZZ.19.5.A05.1.454.CMB.1.raw
  modified_base (153)..(153): a, c, t, g, unknown or other
  misc_feature (153)..(153): n is a, c, g, or t
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctctcctggctgttctccaaggngtctgtgccgaggtgcagcgtgggtcgcagtctggacgcgaggaggtgaggaacggcccggggagtctcgtggaggtactcgtacggtagtaaacgtctttcgtggtatttacgaaggttttacaactattagttggacgtcggngtggggtcgcgccagcacggcccggaagacgcgtgggagtggatagggatcattctagtccgtaggactctgnacgtcgacagactacctccgttcccgtaccgttacgacggaccgtactactacgtacttcgacgaccgtacaacgtcacgtacaccgaccgaccggcctacgcgacgtacgtacgaacctcgccgtaccggccggtccgtaccggacgtacggccgtcggttacttagttaccgtcgacgacggacttacgtaacgttaaacgtaacgggttgggtaccgggacggtacgggtttacgggtttggtttacggttggttaccgggg

SEQ ID NO: 7574 - DNA, 606 bp, Homo sapiens
  misc_feature: GYAE6OF02JZO5J.19.5.A05.1.454.CMB.1.raw
  modified_base (239)..(239): a, c, t, g, unknown or other
  misc_feature (239)..(239): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgagtgcagctggtgcagtctggagcagaggtgagggaagccccggggatctcgtgaggatctcgtgtaagacttcngggattcaggtttactacatattggatcggactgggtgcgtccagcagcccggacaaggcctggacgttggagtggggaaactcattctacgtccagggtaacgactctaggatcgcctaagataccacttcccgtaccttcaacgggtccagtaccactattcacgaccgacgataccatcagcaccgcctactcgctacgtagacgacgctacggaccgtccgtacggaccgacggcgtacgtcgttacgttacgttacgtacggcggtaaccggtctaacgttaaccgtaaaacggttcggggtaaccgggtcgggtaaccggtacggggtttacgggttttacggtaacgttttacccggggg

SEQ ID NO: 7575 - DNA, 651 bp, Homo sapiens
  misc_feature: GYAE6OF02HGBPP.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccgggagtctcgtgaggatctcgtgtaagcttcgtggattctaggtttactactatattggatcggcgtgggtgcgcagcacggccccggacgaaggcctgggacgttgggacgtaggggaatcagtctacgtccgtaggtagacttcgtgtactcgacctaagtactaacctaccgttacccgttcccttacccgaacggtcccgtacgtaccctaacctacttttaccgacgtacccgaactaacgtccacgtcacgccaacccgtccctaccgtcgctacggtacgaacgcgccgtagccggacccgtacggacgacggtccggtcgttaccgttacgttacgtcggtcgtccggaataccgtaattaaccgtaaaaggttcgggggtacggtaccgggtaccggttagggggtttacggtttttacggtaacgttttccggggg

SEQ ID NO: 7576 - DNA, 704 bp, Homo sapiens
  misc_feature: GYAE6OF02F8JB6.19.5.A05.1.454.CMB.1.raw
  modified_base (190)..(190): a, c, t, g, unknown or other
  misc_feature (190)..(190): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctaaaggngcagaggtgaggaaggcccggggatctctggaggatctcgtagtaagacttcgtggattctaggttttacactattagttggatcggcttggggtcgcgcctagccgacggccccggaacgaacggccgtagggacggtgggaacgtggggaaatcgaacttctacgtccgtgggacgtaccttcgtagaacgtcgaccgtaagtactaccgtaccttcccgttcccttaccgaaacgggcccgtaagttccaacctacgtttccgaacgtacccgtaactaaccgtacctacgtaccgaacgcccgtaacccgtccctaccgtacgccgtaacggtacggaaccacgtcccgtacgggacccgggtacccgtaccggaaccgccggaccggtccgttaccgttaacgttaccgtcggtcggaccggtaacgtacctaacgttaacgtaaacggttcggggtacgggtaccgggtaggttacggggtttcggttttacggtaggtttaccgggg

SEQ ID NO: 7577 - DNA, 685 bp, Homo sapiens
  misc_feature: GYAE6OF02JVWVY.19.5.A05.1.454.CMB.1.raw
  modified_base (323)..(323): a, c, t, g, unknown or other
  misc_feature (323)..(323): n is a, c, g, or t
  modified_base (505)..(505): a, c, t, g, unknown or other
  misc_feature (505)..(505): n is a, c, g, or t
  modified_base (659)..(659): a, c, t, g, unknown or other
  misc_feature (659)..(659): n is a, c, g, or t
tcagtactctcgtgcacgaccggtgctcgatttagatagatagacaggcgaggggcagcaagatggtgttgcagacccaggtcttcatttctctgttgctcgtgatctctggtcgcgttcgggacatcgtgctcgaccctatccgtccagacacacgtggctgtcgtctcgtgggcgaggacggcccacataccaacgtcgcgtaggtccgaggacgtaggacgtttattttcggaccaccgaacccaaagacgttaaacgtaacttcgttggcttaggtactacgagaccgaacgaaccgacgacctacgaccttacctaanctactacgttagttacggtacgtactaccgtcccggggggaaaaaccttttgggggtccccccgttggttaccccgaatttccgtagaccgggtccaggtcgtgggttacctgggggaacctaggaattttccgaactcttcgaacccaattcccgagcctagccttgctacggctagaagngtcggtaggcggttcagtttacctgtactaaacctaatagttaactaggaaacgttcccgaaggggtcctttaccggggacccgtttaggggaaccttaagggcgtaacggtatacgaagtacggaacttcggtacgtacttcggactaaccgnttccgtacgttcttcgtacttacccg

SEQ ID NO: 7578 - DNA, 685 bp, Homo sapiens
  misc_feature: GYAE6OF02FTZKE.19.5.A05.1.454.CMB.1.raw
  modified_base (153)..(153): a, c, t, g, unknown or other
  misc_feature (153)..(153): n is a, c, g, or t
  modified_base (323)..(323): a, c, t, g, unknown or other
  misc_feature (323)..(323): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctctcctggctgttctccaaggngtctgtgccgaggtgcagctggtgcagtctggagcaggaggtgaggaacgcccggggtatctcgtaggaggatcgtcggtagtaacgtacttcgtggtatttacgtaggttttaactaactattaagttggattcgggtcgtggggtcgcgccagcgacggccccggaanaacggcctaggacgtggagtagggaatcattctatccgtaggacgtactcgtagacttcgaccagtaactacctaccgtcccgttaccttaccgacggtacccgagttaccctacccttactttaccgaccgtacccgtaactaacgtaccctaacgtaccaacggcccgaccgtcccttaccgcgtacaacggtacggaaccgcgtaccggttacggaccggtcccgtacggacgacggcccggtacgttcttacgttcgtgtcggtacggtacgtccgtaacgttaacgtaaacgggttcggggtacgggaccggttacgggtttacggggtttggttttaccggtagttttaccggggg

SEQ ID NO: 7579 - DNA, 761 bp, Homo sapiens
  misc_feature: GYAE6OF02HXNN9.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtgaggaacggcccggggagtctcgtggaggatcgtcgtagtaagtacttcgtggtacttcgtaggttttaacctactattagttggatcggtcgtggggtcgccgaccgacggaccgaccggaccccgggaacgaacgggtccgtaggggaggtagggaggtaggggaactcgtattacctacgttccgtaggaacgtacctcgtagacgtcgaccgtaagtaacctaaccgtaccgtttccccgttacccgttaaccggaaccggtcccgtaacgttacccgtaacccttacgtttaccgaaccggtacccgaaaccgtaaccgtaccctaacgtaccgaaccggtaccccgtaacccgtacccgttaccgtacgtaccgtaacggtaccggaaccgtacggacccgtacggacccggtccgtaaccggaccgtacggtccggtaccgttacttacgttcgttcggtacgaccggtacgtaccgttaacgttaaacgtaaacgggtcggggtacgggccgggttaacgggttaggggttttagggttttacgtacggtttcgggg

SEQ ID NO: 7580 - DNA, 733 bp, Homo sapiens
  misc_feature: GYAE6OF02JHV0I.19.5.A05.1.454.CMB.1.raw
  modified_base (155)..(155): a, c, t, g, unknown or other
  misc_feature (155)..(155): n is a, c, g, or t
tcagtactctcgtgcacgaccggtgctcgatttagatagatagacaggcaggggcagcaagatggtgttgcagacccaggtcttcatttctctgttgctcgtggatctctggtcgtccgttcgggacatcgtgctacgaccagtctccagacacnctggctgtgtctgtgggcgagacgggcctacatacacgtgcacggtcagcgagtagttatttcgacacgaccaacaagtaacgtaacttacgttggtcgtttaggtatacgagtacaaagaaaccgaggactacggtacccttaaccgaaacgtcgaccttactaagtttacgtcgggactacgttaccggtaacccgggtaaggttccgggtacccgtagtaccgtacgttacgacggtccggacgtacgtcggttcgtcggtagggtacacgttactttccgactcgtactacggacttgacgtacgtacgtcgtacgacgtacgtacgtagggtaacgtcggttggtacgggttccgttaacgttacgttttaccgttacggtaaacctaaacttaagtaacgtttaacgtaacggtaaaccgtaccggttaacgggttcccgttaccgggtaccggttaagggtaaccggtaacgggtagggtaacgtacgttaacgaacggtaaccgtaaacggtcggttaccggaccgttacggtaccgtaacgttcgtcgttacgttccgtacgttacccg

SEQ ID NO: 7581 - DNA, 783 bp, Homo sapiens
  misc_feature: GYAE6OF02IGFWB.19.5.A05.1.454.CMB.1.raw
  modified_base (247)..(247): a, c, t, g, unknown or other
  misc_feature (247)..(247): n is a, c, g, or t
tcagtactctcgtgcacgaccggtgctcgatttagatagatagacagggggtctccctcactgcccagctgggatctctgggcttcattttctgtcctccaccatcatggagtcaaccgccatcctcgccctcctcctggctgttctccaaggagtctgtgccgaggtgcagctggtgcagtctggagcaggaggtgagggaacggcccggggagtctcgtggaggatcgtcgtagtaagacttcgnggattcgaggtttactacatattggatcggcgtgggtgcgccagcacggccccggacaacgggcccgtggacggtggagtggggaatcgatctatccgtggagactcgtgagtcgacccaagtaactacctacccttccccggttacccttttacccgaaacgggtccccgtaacgggttacccaacccgttaactttttacccgaacggtaccccggaaaccgtaaaccggttacccgaaacttacccgaaccggtacccgtaaacccccggtacccccgttaaaccccgttcggacccgtaaacgggttacgggaaaacccgtaccggacccggtacgggtaccccgggcccggttacccggaaccgtacgggtccgggtccggttaccgtttaacgtttaacccgttgggttacggtaccggtacggtaccttaacgtttaaaccgtaaaacggttcgggggttacggggacggggttaccgggttacgggggtttttagggttttttacggttaccggtttttacccggggg

SEQ ID NO: 7582 - DNA, 654 bp, Homo sapiens
  misc_feature: GYAE6OF02I7815.19.5.A05.1.454.CMB.1.raw
  modified_base (154)..(154): a, c, t, g, unknown or other
  misc_feature (154)..(154): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccgaggtgcagctgggtgcagtctggagcagaggtgaggagcccggggatctntgagntcgtcgtgtaagcttcnggtattctaggtttacacattattggatcggntgggtncgcagcaggcccggagaggcctggagtggagtgggaatcatcgttatccgtagggactacgttctacggaatcgaccgaagtacttacctaccttcccggttcccttacccggaacggtccgtaacgttaccaccgttacgtttacgacggaccccgtaacgaaacgtccaacgttcaaccgccgtaacccgccttaccgcgtaccgacggttacggaaaccgcgtaccggtacggacccggtaccgtaccgggaccgaaggtcccgggtacgtacgtttaacgttccgtaggtccggtacggaagtccaagttaaccgaaaggttcggggtacggtccggagggttacggggttggtttttacggtagttttaccgggg

SEQ ID NO: 7583 - DNA, 852 bp, Homo sapiens
  misc_feature: GYAE6OF02GP9T8.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgtctccaaggagtctgtgccgaggtgcagctggtcgcagtctggagcgagaggtgaggaggcccggggatctcgtgaggtatcctcggtagtaacgtacttcgtaggtactttccgtaagggttttaacctactaattagtttcgggtaacttcggggtccgttgggggtacgccggccgtaacgggccgaaacgggtccccccggggaagtaaacggggtccccgttagggggaggttacggggagttagggggaaacttccgtaatcggttaactccggtagggactacccgttcgtacgtacgtcgaacccgtaagtaacgtacccgtaaaccgtttccccggtttaaccttaccccggaaacggggtccccgttaagggttaccccctaacccgttaaccgtttacccggtaaccggtaaccccggtaaacggtaacccgttacccgtacgtaccgaacccgacccaaccccgtacccgttaacccgtacgaccgtacggtaccggaaccgtacggtacccgtaccgggtacccgggtaccgtaccgggaaccggtaccggtacccgggttacccggttacgttacgttacgttacgggttcggaccggtaacggtaacgtaacgttaaccgtaaaacgggttcggggttaaccgggtacgggtaccggtaagggtttcgggtttagggtttacggtttaacgggg

SEQ ID NO: 7584 - DNA, 726 bp, Homo sapiens
  misc_feature: GYAE6OF02IBFWO.19.5.A05.1.454.CMB.1.raw
  modified_base (315)..(315): a, c, t, g, unknown or other
  misc_feature (315)..(315): n is a, c, g, or t
  modified_base (524)..(524): a, c, t, g, unknown or other
  misc_feature (524)..(524): n is a, c, g, or t
tcagtactctcgtgcacgaccggtgctcgatttagatagatagacagggggtctccctcactgcccagctgggatctcagggcttcattttctgtcctccaccatcatggagtcaaccgccatccctcgccctcctcctggcttgttctccaaggagtctgtgccgaggtgcagcgtggtgcagtcgtgggagcaggaggtggagggaacggcccgggggatctcgtaggacggtatcgtcggtagtaagtcttcgtggtacttcgtaaggttttacctaactattaagttgggacgttcgggtcggtggggtcnccggacgagcgacggccccggtaagaacggtccgttagggaggttggaaggtcgggtaaactcgaacgttcgttacgtaccggtaggaccgtactcgttagaacgtcgaccgaatactacccgtaccgttccccgttacgtacccggaggcccgtaacgtaccgtactacgtttaccgaccgtaccgtaacgtaacgtaccacgtaccnccggtaccctaccccgttaccgtaccgtacgacgtacgtacggtaaccgccggtaccgtaccgggtaccggtcccggtaaccggacgtacgggtccgttacgttcgttaacgttcgtggtccggacgtacgtactacgtaacgtaaggtcgggtacggcgggtacgggttagggtttcggttttacggtcggtttaccgggg

SEQ ID NO: 7585 - DNA, 661 bp, Homo sapiens
  misc_feature: GYAE6OF02HRLS1.19.5.A05.1.454.CMB.1.raw
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
  modified_base (299)..(299): a, c, t, g, unknown or other
  misc_feature (299)..(299): n is a, c, g, or t
  modified_base (539)..(539): a, c, t, g, unknown or other
  misc_feature (539)..(539): n is a, c, g, or t
  modified_base (652)..(652): a, c, t, g, unknown or other
  misc_feature (652)..(652): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagtctggtgcagtctggancagnggtgaggaacgccgggagtctcgtgaggntcgtgtgtaagcttctggattcgaggtttactacatagtggatcggtntcgggtgcgccagccgtacgtccccgganaacggtccgtggacgtggacgtagggtaactcgacttctacgtccgtaggacgtacctcgtcggtaatcggacctaagacttaacgtcctcccgttaccgttaccgaacgggtcccgagttacccaacgttactttacgaacgtccgaaacgtacgtacctacgtacacgtccacccgtacctacccgtcgtccgtaacggtcgaacgtacggccgtacgtaccgggtcctaccgggacnccgggtcgtacgtccgttaacttccgtacggtacggaccggtaacgtacgttacgtaaccgtaaacggtcggggttacggacgggtaccggttacgggtttacggttttcggntttaccggg

SEQ ID NO: 7586 - DNA, 699 bp, Homo sapiens
  misc_feature: GYAE6OF02HHP8W.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtcgtggagcgaggagggtggaagggaacggcccggggagtcgtcgtgaggatcgtcgtagtaacgcttctggtattcgtaggtttactactattagttggatcggcgttggggtcgcgaccgaggcgacggacccggacgaacggccgtaggaggtggagtgggaactcatctatccggtaggactactcgtgatcgacagtactaccgtaccttcccgtcccttaccgaacggtcccgtacgtaccgtacctacgtttaccgaaccgtaccgaactaaccgtaccctactaccgaccgacccgacccgtccccttaccgtccgtacgtacgtaccggaacctacgtccgaccggtacccggtcccgtacgggaaccgacggtccggtacgttaccgtacgtttaccgtcggtacggtaccggtaagtaccgttaacgttaaccggtaaaggtttcggggtacgggtacgggtacgggttacggggttttcgggttttacggttacggtttaccgggg

SEQ ID NO: 7587 - DNA, 930 bp, Homo sapiens
  misc_feature: GYAE6OF02ICNOJ.19.5.A05.1.454.CMB.1.raw
tcagtactctcgtgcacgaccggtgctcgatttagatagatagacagggggtctccctcactgcccagctgggatctcgagggcttcattttctgtcctccaccatcatggagtcaaccgccatcctcgccctcctcctggcttgttcctaccaaggagtctgtgccgaggtgcagcgtggtgcagtcgtaggacgcgaaggagggtaggaagggaacgggccccgggggtagtccttcggtaggacggtacttcgtcggttacgtaaagttaccgttcggttaggtacgtttacgttaaggtttttaaacctaacgttaacgtttaggttacgggacgtttccggggtcggtttacgggggtaccggcccggacccggaacggaccgtaaccccggggaacccccggggaaacggtaaccgggtcccgggtaggggtaacggggttaagggtaacgggttaggggaaaacttccgtaacgttttaccgttaacggttacccggtagggtaaccggttaccgtttccggtagtaacgtcggaacccgtaaggttaaccttaacccggttaccccgtttccccggttaacccgtttaacccgggaaaccggtcccgtaaccgttacccgtaaccttacgtttacccgaaccgtacccgtaaaccgtaacccgtaccgtaaccgtaccaccggaccctacccgttacccgttaccgtacgtacgtacgggtaccggaaaccgtccggtacccggtaccggtacccggtccggtaaccggacccggtacggccggttaccgttaacgttacgttacgtggtacgacggtaacgtaccgtaaacgttaaacggtaacgggttcggggtacgggtaaccgggttagggggttttacgggttttagggttttaccgggttagggtttaacccgggg

SEQ ID NO: 7588 - DNA, 755 bp, Homo sapiens
  misc_feature: GYAE6OF02FSXRE.19.5.A05.1.454.CMB.1.raw
  modified_base (154)..(154): a, c, t, g, unknown or other
  misc_feature (154)..(154): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggngtctgtgccgaggtgcagctggtgcagtctggagcagaggtggaaggaacggccccgggggtagtcctcgtggaaggtactcgtcgtagtaaacgacctttcgtggtactttcgtaaggttttactaacctaagttagttggaacttcgggcgttggggtcgtccgccgagccgaacgggccccggaacgaagggccctgggaggtggtagtggggaactcgaagttcctaagttccgtagggatacttcgtaggacttcggacaggtaactacctaccttcccgtaccctttaccggaacggtcccgtaacgttcccgaccgttaactttccgacggtaccccgaactaaaccggttccaacgttaccgaccgtacccgtaaccccgtacccctacccgttcggacgtacggtaacggtaaacccgacggttacccggtaccggtacccgggacccgttacgggacccgtacgggcccggtcgttacgtttaacgtttacgtaggtccggacgggtaactaccgttaacgttaacgtaaacggttggggtacggcgggtaccggttaggggttttcggttttaggttacgtttccggggg

SEQ ID NO: 7589 - DNA, 664 bp, Homo sapiens
  misc_feature: GYAE6OF02G1J8W.19.5.A05.1.454.CMB.1.raw
  modified_base (646)..(646): a, c, t, g, unknown or other
  misc_feature (646)..(646): n is a, c, g, or t
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtcctccagacacacctggctgtgtctctggggcgagagggcccaccatccaactgcaggtccagcgagagtattttgacacgacccaacagtaagaactactggtcgttggtaatccagcaagaaaccaggaacacgcctacctaaatcgctctaagttttagttgggactacgtaccgtaacccgggtaaacgttcgggggttacccccttgttaccccggtattacaaggtccggacagtccgtcggttcgttcggggaacaggttactttaccgtaacttcccgttccaaaccggtacttaccgaacgacgtaccgtaccgttcggacggaccggtacggtagtaacggtaagtggtacggtcggttacgttacgttacgttacgtacaactaaatacttataggtaaacgtcgaacggtaccgttacggtcccgtagggacgtaaggtaggtagtacttacggaacgtcggtaaaccgttgtacggcttcggacgtaccgtancggttcttcgtacgtacc

SEQ ID NO: 7590 - DNA, 812 bp, Homo sapiens
  misc_feature: GYAE6OF02F9QDR.19.5.A05.1.454.CMB.1.raw
  modified_base (158)..(158): a, c, t, g, unknown or other
  misc_feature (158)..(158): n is a, c, g, or t
tcagtactctcgtgcacgaccggtgctcgatttagatagatagacagggggtctccctcactgcccagctgggatctcgagggcttctattttctgtcctccaccatcgatggagtcaaccgccatcctcgccctcctcctggcttgttctacaaggngtctgtgaccgaggtcgcgagcttggtgactaggtcgtaggacgcgaggaggtaggaagggaccggtccggggattcgtcgtaggtaggtcttccgtacgttaggtaacgtcttcgtagggtactttacgttaacggtttaacctacgttaagtttacggttaacggtccgttccggggtggttcgggtaccgtccgaccggttaacggccgtacccgggaccggaaacggtaccgggtccggaggggttacggtaacggtagtacgggtaacttactacgttcgttaacgtcccgggtaagtaccggttacttaccgaggttacaccggacttagaaacccgtttccaacccggtttacccgtaccgtaaccggacggttaccacgttaacctacttacgtcgaccgtaccgacgtacgtaccgtacgtacaccgaacccgaccgttaccctaccggtacgtaccgtacggtaacggtacgaccggtacggttaccggaccggtaccgggtaaccggtacggtaaccggtaccggtacggttaccttacgtacggttcgaccggtacggtacctacgttacgaaaccggttagggccggttacgggcggggtttacggtttacgggttacggtttcggtaccgggtttacggg

SEQ ID NO: 7591 - DNA, 720 bp, Homo sapiens
  misc_feature: GYAE6OF02GEZB5.19.5.A05.1.454.CMB.1.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
tcagtactctcgtgcacgaccggtgctcgatttagatagatagacaggggggtctccctcactgcccagctggggatctcagggcttcattttctgtcctccaccatcatggagtcaaccgccatcctcgccctcctcctggctgttctccaaggagtctgtgccgaggtgcaggttggtgcagtctggagcagnggtgaggaagccggggatctctgaggatctcggtgtaaagcttctggattcgtaaggttttacaacattagttggaactcggcgtggggtncgcctaacggcacggacccggtaanaaacgggtccttagggaaggttgggaacttaggggaaacttccgaattccgtaacgttcccgtaggggacgtaaccttcgtagggtaactcggaccgtaaggtaaacttacgtaaccttcccggttaacccgtttacggaaacgggtcccgtaacgtacctaacccgtactttacgaacggacccgaactaaaccggtccctaagtaccgtaacgacccgtaaacccgcccgttaaccgtcgtactaacgggtacgaaaccgaacgtcccgtacgggaccgtccgtaccgggacgtacggaccggtgttaccgtaagttaacgtcgtacggcgacgtaactaattaccgaaaagtcggggtagacgggtacgggtagggttggttttacggtagtttacggtacggggg

SEQ ID NO: 7592 - DNA, 763 bp, Homo sapiens
  misc_feature: GYAE6OF02G9KQL.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctcgtgggcgaggagggccaccatacaaatgcgaggtccagcgaagagttattttgacacgacccaacgagtaacgtaactacgttggactttaggtatcagtacaacgaaaccaggacacgaccttacctaaactgactacgtatttagttcgggactacgtaccgtaaccggggtaaacgtttcgggggtacccttacggtcctaagttccgacggaccggcgaacggtcgtcggttaccggtaggggaactaggtacttttaccacctttaccgtaccaaccgtacttacgacgtacccgtacgtcccgtaggaccgtaggtaccgtaagggaaacgtaacggttcgggttacggtaccgggtttaaccgtttaactttaacccggttattaaaccgtaaaacttaaagttttaacgttaacggttaaacggtaaaaccgggttaccgtaaccggggtttaaccggtttacccggggtacccgttagggggtaaaccgttaaggggtaccgggtaacgtacgtaccggtaacggtacggtaaccgttggtacgtaccgtacgtaccacgttacgttacgtccgttacttcctaacccgg

SEQ ID NO: 7593 - DNA, 881 bp, Homo sapiens
  misc_feature: GYAE6OF02IE1X2.19.5.A05.1.454.CMB.1.raw
  modified_base (258)..(258): a, c, t, g, unknown or other
  misc_feature (258)..(258): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagctaaggaggtggaagggaacggcccgggggaatcgtcgtggaggtattcgtacgtagtaaacgtcttcgnggtaatttcgtaggtttaacgtactagttattggtatcggcgtgggtcgcgccagacgacggtacccgggaacgaacgggtccgtagggtacggtgggtagtacggggaacttacgattacgttacgtccgttaggaaccgtacgtcgtacgtagtcgaccgtaaggtaacgtaaccgtacccgttacccgtttacccgttaacccggaaaccgggtaccggttaccgtaacccgttaacccgttaccgtttaaccgtaaccgggaacccgtaaaccgtaaaccggttacccgaacttaccgaaccggtaccccgtaaccccggtacccgtttaaccccggtacggtaaccgaaacggggttaaccgaaaccgggtaaccgtaccggttaccggggtacccgggttaacccggtacgggtaacccgggtaaaccgggttcccggggtaccggttttaaaccgttaacgttttacggtccgggttaacggtaccgggaaggttaacccgttaacttaaaaaccggggttaaacggttacccgggggtaacgggggttccggggtaaaccggggtttaacgggggttttaggtttttacccggggtttaggttttacccgggggg

SEQ ID NO: 7594 - DNA, 770 bp, Homo sapiens
  misc_feature: GYAE6OF02GCU74.19.5.A05.1.454.CMB.1.raw
  modified_base (92)..(92): a, c, t, g, unknown or other
  misc_feature (92)..(92): n is a, c, g, or t
  modified_base (151)..(151): a, c, t, g, unknown or other
  misc_feature (151)..(151): n is a, c, g, or t
  modified_base (166)..(166): a, c, t, g, unknown or other
  misc_feature (166)..(166): n is a, c, g, or t
  modified_base (185)..(185): a, c, t, g, unknown or other
  misc_feature (185)..(185): n is a, c, g, or t
tcagtactctcgtgcacgaccggtgctcgatttagatagatagacagggggtctccctcactgcccagctgggatctcagggcttcatttcngtcctcaccatcatggagtcaaccgccatcctcgccctctcctggctgttctccaaggngtctgtgccgaggtncagctggtgcagtctggancagcggtgaggacggcccggggatctcgtggaggtctctcggtagtaacgtactttcggtaggtacttccgtaagggttttaacctaaccgtagttaagttcgggtaacttccgggtacgttggggttccgaccggtacccgaaggtacccgacggtacccggtaacgaacggtccgtacgggtaggtacgggtaagtacggggtaacttcggaacttaccgttaacgtccgtacgggaacgttacctacggtagtacggttcgacccgtaagtacgttaacctaccggttaccccgtttacccttaaccgggaacgggtcccgtaacggttccctaacccggttactttaccgaaccggtacccggtaacgtaacgtaccgtaacgttccgacccggaccgtacccgtaccgttaccgtacggtaaccgtacgggtaaccgaacgtcccggtacgtaccgggtaccggtccgacggtacggaccggtacggtcgttactacgttacgtcgtacgtcggagtacctagtaagtaacggtggtacgggtcgtacggttacgggttggttttacggagtttaccggg

SEQ ID NO: 7595 - DNA, 745 bp, Homo sapiens
  misc_feature: GYAE6OF02HSU3G.19.5.A05.1.454.CMB.1.raw
  modified_base (157)..(157): a, c, t, g, unknown or other
  misc_feature (157)..(157): n is a, c, g, or t
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (358)..(358): a, c, t, g, unknown or other
  misc_feature (358)..(358): n is a, c, g, or t
tcagtactctcgtgcacgaccggtgctcgatttagatagatagacagggggtctctctcactgcccagctgggatctcagggcttctattttctgttcctcccaccatcatggagtcaaccgccatcctcgccctcctcctggctgttcctcaaggngtctgtgcgaggtgcagcgtggtgacagtctggagcaggngggtaggaggaacggccggggatccgtntaggaggtatcgtacggtaggtaacgtcttcgtaggtacttcgtacggtttactaactattagttggtacgtcggtcggtgggtcgtcggaccgcggacgacggacccggaacgaacggccgtcgggtaaggnggtaacggtagggtactacgtacttaccgtatccggtaggaacgtacgttacgtagtacgtcgaacgtagtaacttaacctccgttacccgttcccggtttaacccgaacgggtacccggtacggtaccctaaccgttaacgttaccgtacgacccgtaaacgtaacgtccctaacgtccaacgacccgtacccgtcccttacgccgacgtagggtaccggaacgaccgtcccggacgtacccgggaccgttacccgggaagtccgggtacgccgttaacgttacttacggtaggtccgacggtacgtaccttaacgttaacgaacgggttacggggtacggtaccgggtacggggtttaggggtttccggttttaggttaaccggg

SEQ ID NO: 7596 - DNA, 736 bp, Homo sapiens
  misc_feature: GYAE6OF02IJ5M6.19.5.A05.1.454.CMB.1.raw
  modified_base (114)..(114): a, c, t, g, unknown or other
  misc_feature (114)..(114): n is a, c, g, or t
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
  modified_base (495)..(495): a, c, t, g, unknown or other
  misc_feature (495)..(495): n is a, c, g, or t
tcagtactctcgtgcacgaccggtgctcgatttagatagatagacaggcaggggcagcaagatggtgtgcagaccaggtcttcgatttctctgttgctctaggatctcgtggtntccgttcggggacatcgtcgcttgaccagtctaccagacacacgtggctgtgtcgtcgtggcgaggacggccaccacgtaccaactggacgacggtccgagacgagatttatttacgaactacgacccaaagtaacgtaacgtaacttactggtacttggtactacacgtanaacgaaaccgaggaaccacgtacccctaactaacgtcncgttaccgtaagtttacgttacgggacctacgttaccggtaacccggggtaacggtttcggggttaccctacgtaccggtacgttaccgacggaccggtcgacggtaccgttggttaccggtaggtaacgtacggtttctttaccgacctttcccgaaccaccgtacctanaccgtcgaaccgcgtacgggaagccggtaatacggtaagcggttacggtaccgggtcgttaaccttaataccgttacgtaaacctaagtttaaacgaattttacgaacgggttaacgtacggtaaaccggtttccttaccgggaccgggtttaagtaaacggtagggtaagtacgacgttaacggaaggtacttacggtcgtacggtcactaccgtctgttcccttagtccttccgtaacc

SEQ ID NO: 7597 - DNA, 765 bp, Homo sapiens
  misc_feature: GYAE6OF02I2QMD.19.5.A05.1.454.CMB.1.raw
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
tcagtactctcgtgcacgaccggtgctcgatttagatagatagacagggggtctccctcactgcccagctgggatctcagggcttcattttctgtccctccaccatcatggagtcaaccgcctatcctcgccctctcctggctgttctcaaggacgtctgtgccgaggtgcagcgtggtcgcagtcgtaggagcaggnggtaggaggaacggccccggggtatctctggagtatctacggtagtaactaccttcnggtactcgtaaggttactaactntatggacgtcgacggtggtcgcgcagcaccggacccggacgtaaacggtcgtagggagtagggaacgtagggtaactacgtacttacgtacgttcttacgggacgtacgttcgttagacgttaccgaccgaaagtaccgtaaccgttacccgttaccgttacccttaccggaacccggacgttaacggcctaacccgttaactttaccgacgacccgtaaccgtaagtaccgtacttaccacggtacccacccgttccttaaccgtcggaaccgtacggttacgaaccgtacgttaccggtccgggtaacccggtcccgggtacgtaacccgtcccgggtaccgggtaccggttacgttaccgttacgttggtaccggttaccggacttaaccggttaacgttaaaccgtaaccggggttggggaccggttacggggtttaccgggttaaggggtttcgggtttttacggttacggtttacccgggg

SEQ ID NO: 7598 - DNA, 674 bp, Homo sapiens
  misc_feature: GYAE6OF02G6R1J.19.5.A05.1.454.CMB.1.raw
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcaggaggtgagggaaggcccggggagtctcgtggagatcgtcgtagtaagacgttcgtggtattctaggtttactacgtatagttggtatcggcgtgggtggcgccgagcgacggcccggagaacggccgtgggagtggagtaggggaactcgtatcgtactccgtaggagtacctcgtagattcggaccaacgataacctaccgttacccgttaccttacccgaaacggtccgacgtccacctactttcgacgccgaacgaacgtctactcgacgcccacccgtcctaaccgtcgaccgagtaccggaacgacgtcccgtacgaccggtccgaccggtaccgacggccgggtaccgttcgttaacgtttaccgttcggttacggacggtacggaccttaacgttaacgaaaacgggtttggggtaccgggtcgggtaccgggttagggggttttacgggttttacggttacggttttaccggggg

SEQ ID NO: 7599 - DNA, 875 bp, Homo sapiens
  misc_feature: GYAE6OF02IBL0R.19.5.A05.1.454.CMB.1.raw
tcagtactctcgtgcacgaccggtgctcgatttagatagatagacgagggggtctccctcactcgcccagctgggatctcgagggcttctattttctgtccctccaccatcagtggagtacaacccgccactcctcgccccttccctcccgtggtcttcgttcctaccgaaggtagttctgtcgccggtaggtgcgagcgtggtgactagtcgtggagacgaagggtagggtaggaagggaacgggccccgggggtagttccgttacgtaggacggttacgttcgttacggttaagtaacgttacgttcgtaggtatttaccgtaaggttttaacctaataagttaggttggacgtcgggtgttcggggtgccgaccgagacgaccgggacccggaacgaacgggtcgtagggtaggtacgggaggtagggtaactacgtaacttcttaccgtccgtagggtactacgtcgtaggtacaccgtaccgtaagtactaacccgttacccgttccccgttacccgttacggaaccggttccgtaacgttaccctaaacgtttaacgtttacccggaaccgttaacgaaaccgtttaccaacgtaccgtaaccgtacccgtaaccccggttaacccgtacgttaccggaacgtaaccgggtacggaaaaccgtcccgggtaaccttacgggaccccggtaccggtacccgggaacgtccgggtaaccggttccgttaaccttaaacgtttaccggtggtaacccggacggtacctaaaccggttaaagttaaacggtaacggggttcgggaaccgggtcgggttaccgggttaggggtttttacggtttaggtttacccgggttaggggtaacccgggg

SEQ ID NO: 7600 - DNA, 843 bp, Homo sapiens
  misc_feature: GYAE6OF02H0QEI.19.5.A05.1.454.CMB.1.raw
tcagtactctcgtgcacgaccggtgctcgatttagatagatagacaggcaggggcagcaagatggtgttgcagacccaggtcttcatttctctgttgctctggatctctggtgccttcggggacatcgtgctcgacccagtctccagacaacactggctgtgtctcgtgggcgaggacgggaccaccatcaacgtgacgacggtccagcgagtagttattttagacacgaaccccaagagttaaacgaacttacttggcttaggtatcagacgaagaaaccgaggaaccacgtacctacctaaactcgactactattttagttggacctagtaccggtaacccgggtaagtttccggggtcccgttcggtacccgtacgttacgacggtccggacgaggtaccggtttcggttaccgggttaggaccgtaagttacgttttacccacgttccgtacccaaccgtactaccgacgtcctaccgtcccgtacggacgtaacgggtacgtacgggtaaacgtacggttcgggtacggggttcccgtttaaccgttttaaacggtttacccgtttacggtaaaccctaaaaggtttaacttttaaacgttaacggttaaaccggggttaaaaccggttcccccgggttaaaacggggtttacccctttaaccccggggttcccggttaaacgggggttaaacgtaacggggttaacggtaaccgtaacgtaccggaaacgggttaaccggttaaccgttaggggttacccggaccgtttacggaaaccccttaccggttaacggtttacccgtttaccggttttaccctttaaccggttacccccgg

SEQ ID NO: 7601 - DNA, 873 bp, Homo sapiens
  misc_feature: GYAE6OF02HOF0U.19.5.A05.1.454.CMB.1.raw
  modified_base (93)..(93): a, c, t, g, unknown or other
  misc_feature (93)..(93): n is a, c, g, or t
  modified_base (146)..(146): a, c, t, g, unknown or other
  misc_feature (146)..(146): n is a, c, g, or t
  modified_base (153)..(153): a, c, t, g, unknown or other
  misc_feature (153)..(153): n is a, c, g, or t
  modified_base (179)..(179): a, c, t, g, unknown or other
  misc_feature (179)..(179): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
tcagtactctcgtgcacgaccggtgctcgatttagatagatagacagggggtctccctcactgcccagctgggatctcagggcttcattttcngtcctccaccatcatggagtcaaccgccatcctcgccctctcctggctgttcncgaaggngtctgcgccgtaggtgcagcgtggtnctagtcgtggagcgtaggagggtggaacgggaaccgggcccggggtagtcctcgtagggacggtactcgtacggtagttaacgtcgttcgtaggtacttacgtacggtttaactactagtttagtggacgtcggagttggggcnccgcacgcgacggcccggaagaacggtcgtagggnggtggagtagggtactcaactccgtaacgtccgttaaggaccgtacgtcgtagtaacgtccgtaccgtaacgtaaccgtaacccgttcccgttacccgtttaccccgtaaacccggggaccgggtacccggtaaccgttaaccccgtaacccgttaaccgtttacccggaaaccggtaaccccgtaaaccggttaacccgtaacccgtaacgtacccggtaacccgtacccccgaaccccgttaccccgttaaccggaccggttaaccggtaaacggtaaccgggtaaacccgaccgggttaccggtaaccccgggtacccggggtacccggtaaccggggtaacccggtaccgggtacccgggttacttaaacggtttaaccgttacgggtcgggttaccgaacgtaaccgttaccgttaaacgttaaaccggtaaacggggttcggggtacgggtaccgggttcggggtttacggggttttaggtttttacccgggttagggttaaccggggg

SEQ ID NO: 7602 - DNA, 840 bp, Homo sapiens
  misc_feature: GYAE6OF02GUJNL.19.5.A05.1.454.CMB.1.raw
  modified_base (93)..(93): a, c, t, g, unknown or other
  misc_feature (93)..(93): n is a, c, g, or t
  modified_base (171)..(171): a, c, t, g, unknown or other
  misc_feature (171)..(171): n is a, c, g, or t
  modified_base (182)..(182): a, c, t, g, unknown or other
  misc_feature (182)..(182): n is a, c, g, or t
tcagtactctcgtgcacgaccggtgctcgatttagatagatagacagggggtctccctcactgcccagctgggatctcagggcttcattttcngtcctcacatcatggatcaaccgtcatcctcgccctctcctggctgttccaccaaggcgtctgtcgaccggtaggtcncgagctgggtncgagttcgtaggatcgaggtaggtggaacgggaaccgggtcccggggtaattcctcggtagggaggtacttccggttacggtagttaaacgtctttcggtaggtacttttaccggtaacggttttaactaacgtagtttaaggttcgggtaacgttccgggtacggtttcggggtccgaccggtccgtaagacccggtacggacccggaacggtaacgggtccgtacggggtacggttacgggaggttacgggtatacttacgtccgttaacgtcggtacggagttacctggtacgtacgtcgaccgtaacgtcgtaccttacccggttccccgttaacccgttacgggaaccgtcccggtactacccgttaaccgtacgtttaccgaccggtaacccgtaacgtaaccggtacaccgtaccgaccggtaccctacccgtacccgttaccgtacggtaccgaggtaccggaccgtaccgtaccggtccgggaccggtcccgtacggggactccggggaccgttccgttacggttacgttaccggttcggtacggtcgtaacggtaaccggttaattaaccgggtaacggtccggggtaccgggttcgggttaacgggtttcggggttttacggtttacggtttccgggttaaccgggg

SEQ ID NO: 7603 - DNA, 728 bp, Homo sapiens
  misc_feature: GYAE6OF02HVZQ7.19.5.A05.1.454.CMB.1.raw
  modified_base (147)..(147): a, c, t, g, unknown or other
  misc_feature (147)..(147): n is a, c, g, or t
  modified_base (168)..(168): a, c, t, g, unknown or other
  misc_feature (168)..(168): n is a, c, g, or t
  modified_base (177)..(177): a, c, t, g, unknown or other
  misc_feature (177)..(177): n is a, c, g, or t
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (377)..(377): a, c, t, g, unknown or other
  misc_feature (377)..(377): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttcnccaaggatctgtgccgaggtncagctggtncagtctgggagcaggaggtgagggaacgcccggggtatctcgnggaggactctacggtagtaagtcttcgtggattcgtaggtttacacgtattagttggactcggngtgggcncgcgagccgacgccccggaataacgggccgttagggagtggagtacgggaatcagtcctacgtccgtagggtactacgtcgtagtntacggacaagtactaccgtcccgttacccgttacccgttacgaacgggtcccgtaacgtaccctaccgttactttaccgaccggtaccgaaaccgtaccgtaccgtactaccgaccggtaccctaacccggtccctaaccgtacggtacgacggtacggaaccgtacggtacccgtacgggaccggtacccgtaccgggaccgacgggttaccggtccgttaccgttaacgttccggtcggtacgtaccgggaacgttaccgttaacgttaaacggttaaggtacggggtccgggtacgggttaccgggttaggggttttacggttttacgggttaggtttaacccggggg

SEQ ID NO: 7604 - DNA, 827 bp, Homo sapiens
  misc_feature: GYAE6OF02FLIUB.19.5.A05.1.454.CMB.1.raw
  modified_base (749)..(749): a, c, t, g, unknown or other
  misc_feature (749)..(749): n is a, c, g, or t
tcagtactctcgtgcacgaccggtgctcgatttagatagatagacagggcagggcagcaagatggtgttgccagacccaggtctttcatttctctgttgctctggatctctggtgccttcgggacatcgtgctgacccagtctccagacacactgctgtgtctcgtagggcgagacggtccacatacaactcgacgagtccagcgtaagagttattttacgaacaacgtaccaaatacgttaaacgaacttacgtttaggctttaggtactcaagaccaaggaaacccagtaaccaccgtacctaccgtaaaacgttgaccttacgtacgttttagtcgggtactaaccgttacccggttaaccccggggtaaacgttcccgggggttacccttaggttaccccgtagttcgaacggccgggtacgtcggtccgggttggttccgtaggggacttaacgttacgtttacccaccgttaaccttacccaaaccgtcgttaccgacgaccgtacgcccgtaggtcggtaggtacgtacggtaaaggtacgttcgggtaccgtacggtttcgttaacgtacgtttacgtaaaccgtaatttaaaattccggttaaacgttaaccgggttaaaccggttacccggttaaccggggtaacccggttttaccggtaaccccggggttaacggggttaaacgttaacggggaacggttacgttaacccggtcggtaaaccggtaccggttaaccgnggtttaccccggacgttcgttacccgtaacccgtttaccgttacggtttccccgtttaccgttcccgtttaaccccgg

SEQ ID NO: 7605 - DNA, 805 bp, Homo sapiens
  misc_feature: GYAE6OF02HDDS4.19.5.A05.1.454.CMB.1.raw
  modified_base (312)..(312): a, c, t, g, unknown or other
  misc_feature (312)..(312): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctctcctggctgttctccaaggtgtctgtgccgaggtgcagctggtgctagtctggatacgaaaggtgagggaaccggccggggtatctcgtagacggtacttcgtacggtagtaacgtacttcgtaggtacttcgtaggttttaacctactaattagttggacgtccgggtcgtggggtcncccgacgtacggaccgaacggccccggaaaggaaccggtccgtagggacgtagggacgtaggaactcattctacgtccgtaggactacgtcgtagacgtcggactagtaactaccgtccgttccgtaccgtacgaacgggtcccgtacgttactacttacgttaccgacgtacccgtaacgtaccgtactacgtaccggaccgtacccgacccgttaccgtaaccgttcggaccggtaacggtacccggtaaaccttaccgggtacccttaccggggaacccgttaacccgggtaccgtaaacccgggtacgggtaccccgggtttacgttacccggttaacgttttacccgggtggttacccgggaacggttaaccggttaacgttaaaccggttaaacgggtaaacgggttcggggtacggggttaccgggttaacgggtttaggggttttcgggttttaacgggttacggttttcccgggggaaccgggg

SEQ ID NO: 7606 - DNA, 903 bp, Homo sapiens
  misc_feature: GYAE6OF02I09XY.19.5.A05.1.454.CMB.1.raw
  modified_base (240)..(240): a, c, t, g, unknown or other
  misc_feature (240)..(240): n is a, c, g, or t
  modified_base (292)..(292): a, c, t, g, unknown or other
  misc_feature (292)..(292): n is a, c, g, or t
  modified_base (477)..(477): a, c, t, g, unknown or other
  misc_feature (477)..(477): n is a, c, g, or t
tcagtactctcgtgcacgaccggtgctcgatttagatagatagacagggggtctccctcactgcccagctgggatctcagggcttcatttctgtcctccacatcatggacgtcaaccgcctatcctcgccctccgtcctggcttgttctaccgaaggtctctggtgccgaggtgcagctagggtgacgagtctagggacactaggaggttggaagggaacccggccgggggtattccgtntacgggtaagggtacttccgtaccgggttaggtaaaacggttcgtttacggngggttaaactttcggtaagggtttttaactaaccgaagtttaaggttcggtaacgtccggttcggttacgggtcgaccgggaccctacggtaccgaccgggccccgggtaaacgaaacgggttccgtgggggtaaccgtgggtaacggtttcggggaaagttctacgttacttaccggttaccgngggtaaacgtacgttctaaggacgttacggacctaagggtaacctacggtaccgttaccccttcccggttaccgtacgggttaaccgtaacctccgtaccgttaacttaacccggcgtaaacccgtcgtaaaaccgttccgtaaccttaccgacgtacccgaccgttacccgtaaccttcggacgtacggtacgtaaccggacggtccggttacggacccgggttaccgtaccgggacgtaacccgggtacggtaccgtttaacgaacgttttaccggtcgggtaccgtttaccgggaacctaccgggttaaaagttaacccgggtttaaacggggttaaccggggttaccggggttaaccgggttacccggggttacgggggtttaacggggtttttacggtttaccggtttaaccccggggggg

SEQ ID NO: 7607 - DNA, 795 bp, Homo sapiens
  misc_feature: GYAE6OF02JGF5W.19.5.A05.1.454.CMB.1.raw
  modified_base (156)..(156): a, c, t, g, unknown or other
  misc_feature (156)..(156): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctctcctggcttgttcctccgaaggntctgtcgaccgaggtgcagctgggtgcacgtgtggagcaggaggtggaaggaacgtcccggggagtctcgtaggaggtattcgtcggtagtaacgtccttacgtggtatttcggtaaggttttaacgacgtagtttaagttagggcgtacggtcgtacgggggttctccggacgacgcggaacccggacccgggaacgtacggccgttgggagtacgggaagtacgggtaatctacggtaacgttcgtacctaggggactacgttctaacggtctacggtaccctaaagtaacgttaccaaccggtttcccccgttaactacccgggtaaaccgtcccgttaatcccgtaaaaccgttacgttacccaacgggtaccccaaacgtacgacccttacgaacccggtaccgacccgtaaacccgtacctaaccgttaccggacgtaaacccgggtaacgttaaaccggccggttaaaccgggtcggtaacccggtcggtaaccggacggttaccgcgggttaaaccttcgttaacgttaccgtcggttacgtaacggccgttaataaccggtttaagaaacggggtttcgggtaccggcgggttagggttacgggttttcgttaggtaccggtttacgggg

SEQ ID NO: 7608 - DNA, 680 bp, Homo sapiens
  misc_feature: GYAE6OF02HX1ZQ.19.5.A05.1.454.CMB.1.raw
  modified_base (163)..(163): a, c, t, g, unknown or other
  misc_feature (163)..(163): n is a, c, g, or t
  modified_base (275)..(275): a, c, t, g, unknown or other
  misc_feature (275)..(275): n is a, c, g, or t
  modified_base (404)..(404): a, c, t, g, unknown or other
  misc_feature (404)..(404): n is a, c, g, or t
  modified_base (548)..(548): a, c, t, g, unknown or other
  misc_feature (548)..(548): n is a, c, g, or t
  modified_base (604)..(604): a, c, t, g, unknown or other
  misc_feature (604)..(604): n is a, c, g, or t
tcagtactctcgtgcacgaccggtgctcgatttagatagatagacgagggggtctccctcactgcccagctgggatctcgagggcttcattttcgtgtcctccaccatacatggagtcaaccgccatcctcgcccctcctcctggcttgtttcaccgaaaggngtcgtggtacgccggaggtgacaggtcgtgggtgctagtcgtggagtcgaggagggtggaagggaacgggcccggggatctcgtggtacgatcgtacgtagtaacgtcttgnggtattcgtaggttaccatagtattggagtcggtcgtgggtcgcctacgagcgaccggaccggaacgaacggtcgtaggaggtggtaaggtagggtaactcgtaatacgtacttcgagggactacgtcngtaactcgacgtaagtaactccgtaccgtcccttaccgtacggacggaccggtactacctacgttacttcgacggtaccgtaactacgttccgacttacgaccgaccgtaccgtacccttagccgacgttacggaacggaaccncgtacccgtacgggacccgtaccgtcgaaccggtccggacgtcgtacttacgtcgngtacggtcacgtacttgtaaccgtaagggtgggaccggtggtaggtttcgggttttagttacggtcgtttacgggg

SEQ ID NO: 7609 - DNA, 729 bp, Homo sapiens
  misc_feature: GYAE6OF02HA9KR.19.5.A05.1.454.CMB.1.raw
  modified_base (175)..(175): a, c, t, g, unknown or other
  misc_feature (175)..(175): n is a, c, g, or t
  modified_base (186)..(186): a, c, t, g, unknown or other
  misc_feature (186)..(186): n is a, c, g, or t
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgcccctcctccgtggctggttactccaaggacttctgtgtccgaggtncagtctgggtncagtctggancgagaggtggaggaacggcccggggatcctgtggaggactcgtacgtagtaagacgttcngggtacttcgtaaggtttaacactaagttagttaggatccggtcgtgggtcgaccggccaggaccgtacggcccgaacgaacgggcctaggggagtcgggtagtacggggtaaactctaagttccgttaactccggtaggtaacgtacttagtacgaagtccgacgtaagtactaaccgtctaccccgtacttaaccggaccggttacctacgtaactaccgtacttccgaaccggtaaccaccgtaacgttcctaactccgaaccgtacccgacccgtaacccgtacctacgaccggtaaggtacggaaccgtacggtacccgtacgggtacccgaaccccggtcgtaaacgggccgacgggttcccgttaattacgttacgtagtaacgaggtaacgtacctaaaggtagaaacgggttcgggacggtacgggttccggtagggtttaacggttttcgtagtttaccgggg

SEQ ID NO: 7610 - DNA, 884 bp, Homo sapiens
  misc_feature: GYAE6OF02JAQW2.19.5.A05.1.454.CMB.1.raw
  modified_base (157)..(157): a, c, t, g, unknown or other
  misc_feature (157)..(157): n is a, c, g, or t
  modified_base (397)..(397): a, c, t, g, unknown or other
  misc_feature (397)..(397): n is a, c, g, or t
  modified_base (459)..(459): a, c, t, g, unknown or other
  misc_feature (459)..(459): n is a, c, g, or t
tcagtactctcgtgcacgaccggtgctcgatttagatagatagacagggggtctccctcactgcccagctgggatctcagggcttcattttctgtcctccaccatcatggagtcaaccgcatcctcgccctcctcctggctggttactccaaagggngttctgtggccgaggtcgctagctgggtcgcaggtcgtggagcagacgggtgagggaagccccgggggatcttcgtgacggtatcgtcggttagtaaacggtccttcgttagggtactttaccggtaacggttttaactaaacgtacgtttacgtttacggggtattaccggggtaccgttggggggtccgtacccggaacccgttaacggtaccggaccgggaaccccccgggggtaanaaaaccggggttccccgtacggggtaacgggtttaggaaaacggggttccgggggttaaaanacccgttaataccgttttaaccgtaacccggttgggtaaaccgttacccgtaccgtaggttacccggtcggaccggtaaataaccggtaaccctaaccgttccccgggtttacccttaaccggaaaccggggtcccgtaaggtttacccgaaacccgtttattttaaacccgaccggttaaaccccgaacgtaaacgtaccctaaacgtacccggaaccgtcccaaacccggttaccttaaccggccggttagaacgggttaaccggaaccgtacgcccggtacgggtacccgggccgtacggaccgtaacggccgtacgtacttacgttacgtaggtccggtaggaactacgtagttaaacgaacgggttggggtacgtacgggtacggtaggggttttcggtttacgtacgtttacccggggg

SEQ ID NO: 7611 - DNA, 931 bp, Homo sapiens
  misc_feature: GYAE6OF02HLY3T.19.5.A05.1.454.CMB.1.raw
  modified_base (179)..(179): a, c, t, g, unknown or other
  misc_feature (179)..(179): n is a, c, g, or t
  modified_base (328)..(328): a, c, t, g, unknown or other
  misc_feature (328)..(328): n is a, c, g, or t
tcagtactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctgggtncagtctggagcaggaggtcggaagggaaccgggcccggggatcctgtggaggatcgtcggtagtaacgtcttacgtggtactttcgtacggttttaacactattagttggacttcgggacgtgggtgcgaccgagcgacggcccggaanaacgggcgttgggaagttcggagtagggaatcgaacttcgtacgtccgtagggatactcgtagtagtcgaccgtaagtaccgtaaccttacccgttacccgtttcccgttaaaccgggaaaccggtccgggttaaccttaaccgtaacccgtttaaccgttttacccggaaccggtaccccggtaaaccgtaaaaccgttacccgtaaaccgtacccgtaacccggtaaccccggtaaccccgttaccccgtttacccggtaacccggtaccggttaaacccgggtaaccgggtaaacccgtacccgggttacccgggttaaccgggtacccccggggtaaccccggttaaccggggtaacccgggttaccgggtacccggggttaacccggtttaaccgttttaccggttttaacccggtttccggggtttaaccgggtacccggggtaaaccggttaacccgtttaaaccgggtttaaaccggttaaaaacccggggtttcggggggttaccggggttaaccgggggttaaccgggggtttaacgggggtttttacggggtttttttaaccgggttaccgggttttttaaccccggggggg

SEQ ID NO: 7612 - DNA, 292 bp, Homo sapiens
  misc_feature: GYAE6OF01BSKE4.37.71.G05.1.454.CMB.1.raw
  modified_base (290)..(292): a, c, t, g, unknown or other
  misc_feature (290)..(292): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttgggtttattactgcatgcaaggtctacaaactcctcggatcaccttcggccaagggacacgactggagattaaacgaactgtggctgcaccatctgtcttcatcttccgccatctgaatctacactactgagcgggctggcaaggcgcatagnnn

SEQ ID NO: 7613 - DNA, 268 bp, Homo sapiens
  misc_feature: GYAE6OF01DBBO8.37.71.G05.1.454.CMB.1.raw
  modified_base (263)..(268): a, c, t, g, unknown or other
  misc_feature (263)..(268): n is a, c, g, or t
tcagtagtgtagatcacgaccggtgctcgatttagtgtcgtcgcaagagagagggatcaggcacagatttcacactgaagatcagcagagtggagactgaggatgttgggtttattactgcatgcaaggtctacaaactcctcggatcaccttcggccaaagggacacgactggagattaaacgaactgtggctgcaccatctgtcttcatcttcccgccatctgaaatctacactactgagcgggctggcaaggcgcatagnnnnnn

SEQ ID NO: 7614 - DNA, 296 bp, Homo sapiens
  misc_feature: GYAE6OF01AIOQC.37.71.G05.1.454.CMB.1.raw
  modified_base (291)..(296): a, c, t, g, unknown or other
  misc_feature (291)..(296): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttgggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnnnnn

SEQ ID NO: 7615 - DNA, 264 bp, Homo sapiens
  misc_feature: GYAE6OF01ASRH6.37.71.G05.1.454.CMB.1.raw
  modified_base (262)..(264): a, c, t, g, unknown or other
  misc_feature (262)..(264): n is a, c, g, or t
tcagtagtgtagatcacgaccggtgctcgatttagtgtcgtcgcaagagagagggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnn

SEQ ID NO: 7616 - DNA, 261 bp, Homo sapiens
  misc_feature: GYAE6OF01CC3IV.37.71.G05.1.454.CMB.1.raw
  modified_base (257)..(261): a, c, t, g, unknown or other
  misc_feature (257)..(261): n is a, c, g, or t
tcagtagtgtagatcacgaccggtgctcgatttagtgtcgtcgcaagagagagggatcaggcacagatttcacactgaagatcagcagagtggaggctgaggatgttgggttatactgcatgcaaggtctacaaactcctcggatcaccttcggccaagggacacgactggagattaaacgaactgtggctgcaccatctgtcttcatcttcccgcatctgaatctacactactgagcggctggcaaggcgcatagnnnnn

SEQ ID NO: 7617 - DNA, 492 bp, Homo sapiens
  misc_feature: GYAE6OF01DMX9D.37.71.G05.1.454.CMB.1.raw
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
tcagtagtgtagatcacgaccggtgctcgatttagtgtcgtcgcaagagagaggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcacccctggagagccggcctccatctcctgcaggtctagtcagagcctcctgcatggaaatggacacaacttatggattggtatctgcagaagccagggcagtctccacaactcctgatctattcgggttctaagtcgggccttccggggtccctgacaggttcaggtggcaggtggatcgaggcacagatttcacactgaagatnagcagagtggaggcngaggngtggtttagggg

SEQ ID NO: 7618 - DNA, 264 bp, Homo sapiens
  misc_feature: GYAE6OF01D86F9.37.71.G05.1.454.CMB.1.raw
  modified_base (262)..(264): a, c, t, g, unknown or other
  misc_feature (262)..(264): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgcatctgaatctacactactgagcgggctggcaaggcgcatagnnn

SEQ ID NO: 7619 - DNA, 268 bp, Homo sapiens
  misc_feature: GYAE6OF01B441Z.37.71.G05.1.454.CMB.1.raw
  modified_base (263)..(268): a, c, t, g, unknown or other
  misc_feature (263)..(268): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnnnnn

SEQ ID NO: 7620 - DNA, 265 bp, Homo sapiens
  misc_feature: GYAE6OF01CSYKS.37.71.G05.1.454.CMB.1.raw
  modified_base (262)..(265): a, c, t, g, unknown or other
  misc_feature (262)..(265): n is a, c, g, or t
tcagtagtgtagatcacgaccggtgctcgatttagtgtcgtcgcaagagagaggggatcaggcacagatttcacactgaagatcagcagagtggaggctgaggatgttgggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnnn

SEQ ID NO: 7621 - DNA, 500 bp, Homo sapiens
  misc_feature: GYAE6OF01AH1X7.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctcctggggctgctaatgctctgggtctctggatgcagtggggatattgtgatgcatcagtccccactctccctgcccgtcacccctggagagccggcctccatctcctgcaggtctagtcagagcctctgcatggaaatggacacaacttatggattggtatctgcagagccagggcagtctccacaactcctgatctattcggttctaagtccgggcctccgggtcctgactaggttcagtgctagtggatcgaggcacgagtatttcactactagaaagatcagcagagtggaggctaggaggtattgggtttgggtttaac

SEQ ID NO: 7622 - DNA, 266 bp, Homo sapiens
  misc_feature: GYAE6OF01DOB7Q.37.71.G05.1.454.CMB.1.raw
  modified_base (262)..(266): a, c, t, g, unknown or other
  misc_feature (262)..(266): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgcatctgaatctacactactgagcgggctggcaaggcgcatagnnnnn

SEQ ID NO: 7623 - DNA, 536 bp, Homo sapiens
  misc_feature: GYAE6OF01DXCFY.37.71.G05.1.454.CMB.1.raw
  modified_base (379)..(379): a, c, t, g, unknown or other
  misc_feature (379)..(379): n is a, c, g, or t
  modified_base (530)..(530): a, c, t, g, unknown or other
  misc_feature (530)..(530): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctggagggtccctgagactctcctgtgcatcgtctggattcaccttccgagtcttttgacatgagctgggtccgccgggctccgaggggaagggtctggagtgggtctcatccatcagttacaatggtacaaaccatatactacgcagtatttgagacgggcncttcaccatctcagagaacaacgaccaaaactcaactagtatctagacaaatggacggctgagatccgagacacggctgtgtattattgtgcgagaggaaggacgtgggtcggtttcgacgtacgtcggggccaacgggaccctgggtccnccgtcc

SEQ ID NO: 7624 - DNA, 293 bp, Homo sapiens
  misc_feature: GYAE6OF01EKHKZ.37.71.G05.1.454.CMB.1.raw
  modified_base (290)..(293): a, c, t, g, unknown or other
  misc_feature (290)..(293): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttgggtttatactgcatgcaaggtctacaaactcctcggatcaccttcggccaagggacacgactggagattaaacgaactgtggctgcaccatctgtcttcatccttcccgccatctgaatctacactactgagcggctggcaaggcgcatagnnnn

SEQ ID NO: 7625 - DNA, 525 bp, Homo sapiens
  misc_feature: GYAE6OF01BY0G3.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctcctggggctgctaatgctctgggtctctggatgcagtggggatattgtgatgcatcagtccccactctccctgcccgtcacccctggagacgccggcctccatctcctgcaggtctagtcagacgcctcctgcatggaaatggacacaacttatggattggtatctgcagaacgccagggcagtctccacaactcctgatctagttcggttctaagtccgggtcctcccggggtccctgactaggttcaggtggcaggtggatcgaggccacaggtactttcgaactactagaaagtagtcgagcaggaggtgggaggtctggaaggtgttgggtttggggttttaac

SEQ ID NO: 7626 - DNA, 523 bp, Homo sapiens
  misc_feature: GYAE6OF01D3DZ8.37.71.G05.1.454.CMB.1.raw
  modified_base (299)..(299): a, c, t, g, unknown or other
  misc_feature (299)..(299): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcacccctggagagccggcctccatctcctgcaggtctagtcagngcctctgcatggaaatggacacaacttattggattggtatctgcagaagccagggcagtctccacactcctgatcttagttcgggttctaacgtccgggccgttcccggggtccctgactaggttcaggtggcaggtggatcgaggccacgagtatttccacacgtagaagactcagcgaaggaggttagggaggactagggagggtagttgggttttacgggg

SEQ ID NO: 7627 - DNA, 263 bp, Homo sapiens
  misc_feature: GYAE6OF01C8WQY.37.71.G05.1.454.CMB.1.raw
  modified_base (261)..(263): a, c, t, g, unknown or other
  misc_feature (261)..(263): n is a, c, g, or t
tcagtagtgtagatcacgaccggtgctcgatttagtgtcgtcgcaagagagagggatcaggcacagatttcacactgaagatcagcagagtggaggctgaggatgttgggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnn

SEQ ID NO: 7628 - DNA, 504 bp, Homo sapiens
  misc_feature: GYAE6OF01D7BF9.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcacccctggagacgccggcctccatctcctgcaggtctagtcagacgcctctgcatggaaatggacacaacttatggattggtatctgcagagcaggcagtctccacaactcctgatctagttcggttctaagtccgggtcctccggggtccctgactaggttcagtgcagtggatcgaggcacgagtactttcactacgtagaagtatcaggcaaggagtggaggctaggaggtagttggtttaaggg

SEQ ID NO: 7629 - DNA, 542 bp, Homo sapiens
  misc_feature: GYAE6OF01AO2ZV.37.71.G05.1.454.CMB.1.raw
tcagtagtgtagatcacgaccggtgctcgatttagtgtcgtcgcaagagagagggggtcaggctggaactgaggagcaaggtgggggcacttctccctctaacactctcccctgttgaagctctttgtgatcaggactcctcagttcaccttctcacaatgaggctccctactcagctcctggggctgctaatgctctgggtctctggatgcagtggggatattgtgatgcatcagtccccactctccctgcccgtcacccctggagacgccggcctccatcctcctgcaggtctagtcagagcctctgcatggaaatggacacaacttattggattggtatcgtgcagaacgccgagggcagtcctaccacaactcctgactcttagttcgggttactaacgtccgggccgtcccgggtccctgacgtggttcagtcggctaggtggatcgaggcacgtagtactttacactactagaacgtagtcagcgagggtacggtgggacggtcgtaggaaggtaggttgggtttaggggttttac

SEQ ID NO: 7630 - DNA, 508 bp, Homo sapiens
  misc_feature: GYAE6OF01AS782.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcaccccctggagacgccggcctccatctcctgcaggtctagtcagagcctcctgcatggaaatggacacaacttagttggattggtatctgcagaagcgagggcagtctccacaactcctgattctattcgggttctaagtcgggcctccggggtccctgactggttcaggtggcaggtggatccgaggcacgagtactttcactactgaagtatcagtcaggagtggaggctaggaggtgttgggtttaggg

SEQ ID NO: 7631 - DNA, 266 bp, Homo sapiens
  misc_feature: GYAE6OF01BSINV.37.71.G05.1.454.CMB.1.raw
  modified_base (263)..(266): a, c, t, g, unknown or other
  misc_feature (263)..(266): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnnn

SEQ ID NO: 7632 - DNA, 296 bp, Homo sapiens
  misc_feature: GYAE6OF01B373B.37.71.G05.1.454.CMB.1.raw
  modified_base (286)..(286): a, c, t, g, unknown or other
  misc_feature (286)..(286): n is a, c, g, or t
  modified_base (292)..(296): a, c, t, g, unknown or other
  misc_feature (292)..(296): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcncatagnnnnn

SEQ ID NO: 7633 - DNA, 538 bp, Homo sapiens
  misc_feature: GYAE6OF01CIWTT.37.71.G05.1.454.CMB.1.raw
  modified_base (395)..(395): a, c, t, g, unknown or other
  misc_feature (395)..(395): n is a, c, g, or t
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaattgaggctccctgtctcagctccgtggggctgctaatgctctgggtctcgtgggatgcaggtggggatagttgtgatgcatcagtccccactcctccctgcccgtccacccctggacgcgccggcctccatcctcctgcgacggtctagtcagagcctctgcagtaggaaatggaactactaactttagttggattggtatctgcagaacgccgagggcagtcctaccacactcctnactactacgttcggttactaacgtccgggaccctccggggtccctgtacctaggttcagtgacagtgactcgagcaganacttcacacgtgaacgtactacgaagnaagaggtggaggcgtaggaaggtgttggtttaacggg

SEQ ID NO: 7634 - DNA, 273 bp, Homo sapiens
  misc_feature: GYAE6OF01BQVBC.37.71.G05.1.454.CMB.1.raw
  modified_base (262)..(273): a, c, t, g, unknown or other
  misc_feature (262)..(273): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgactgtggctgcaccatctgtcttcatcttcccgccatctgaatctacactactgagcgggctggcaaggcgcatagnnnnnnnnnnnn

SEQ ID NO: 7635 - DNA, 627 bp, Homo sapiens
  misc_feature: GYAE6OF01DIPJP.37.71.G05.1.454.CMB.1.raw
  modified_base (320)..(320): a, c, t, g, unknown or other
  misc_feature (320)..(320): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggctccctgctcagctccgtggggctgctaatgctcgtgggtctctggatgcaggtggggattattgtgatgcatcacgtccccactcctccctcgcccgtcaccccgtggacgacgccggcctccatcctccgtgcgtaggtctagcagcgcctccngcagtaggaaatggaacctaactaaactttgttaggtattagggtacttcgtacgacgaaacgaacgcccggaagggtcctacggtacctacccaacgtaaccttccctagtacttcgttaacgttcgggttacttaacggtccgggtacccgttccgggtcctgacgtagtttcgaggtcggcgaggtcgacgtacgaggctacgtaagtactttaccgaacgtacgttagaaacggtactacgaaggtaccgaggtacggagggtacggcgttaagggagggtttagtggggtttttaaacgggg

SEQ ID NO: 7636 - DNA, 577 bp, Homo sapiens
  misc_feature: GYAE6OF01BDBQ3.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcacgtccccactcctccctgccccgtcaccccgtggagacgccggcctccatctcctgcaggtctagtcagacgcctcctgcagtggaaatggacaactaacttattggattggtatctgcagacgcgagggcagtcctaccactaactcctgacttctagtttcgggttactaacggtccgggtcccgtcccggggtccctaggacgtacggtttccgaggtcggacgtagggtaggacgtaccgaggaccaacgtacgttatttaccgactacgtaggaaacgtactacgaggcgaaggtaggtacgggaggtcgtaggaggtaggttggggttttaacgggg

SEQ ID NO: 7637 - DNA, 266 bp, Homo sapiens; identical to SEQ ID NO: 7631
  misc_feature: GYAE6OF01CAUZC.37.71.G05.1.454.CMB.1.raw
  modified_base (263)..(266): a, c, t, g, unknown or other
  misc_feature (263)..(266): n is a, c, g, or t

SEQ ID NO: 7638 - DNA, 506 bp, Homo sapiens
  misc_feature: GYAE6OF01ETSN9.37.71.G05.1.454.CMB.1.raw
  modified_base (466)..(466): a, c, t, g, unknown or other
  misc_feature (466)..(466): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgccccgtcacccctggagacgccggcctccatcctcctgcaggtctagtcagacgcctcctgcagtggaaatggacacaacttattggattggtatctgcagaagcgagggcagtctccacaactctgatctattcgggttctaagtccgggcctccgggtcctgactaggttcagtcggctaggtggatcgaggcacgagtatttcactcagaagntacagcagagtaggaggctaggacggtgttggtttagggg

SEQ ID NO: 7639 - DNA, 541 bp, Homo sapiens
  misc_feature: GYAE6OF01CH1V2.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaatctctttgtgatcaggactcctcagttcaccttctcacaatgaggctccctactcagctcctggggctgctaatgctctgggtctctggatgcagtggggatattgtgatgcatcagtccccactctccctgcccgtcacccctggagacgccggcctccatctcctgcaggtctagtcagacgcctcctgcatggaaatggaacactaacttattggattggtatctgcaagacgcagggcagtcctcacaactcctgtatcttattcgggttataacgtcgggtccgtccgggtccctgactaggttcagtggcaggtggacgtcgacggcactagtatttacactacgtagaacgtatcgaagacgaaggaggtagggacggtcgaggtagggtacgtttgggtttagggggttttaacg

SEQ ID NO: 7640 - DNA, 270 bp, Homo sapiens
  misc_feature: GYAE6OF01AJ4CH.37.71.G05.1.454.CMB.1.raw
  modified_base (257)..(257): a, c, t, g, unknown or other
  misc_feature (257)..(257): n is a, c, g, or t
  modified_base (262)..(263): a, c, t, g, unknown or other
  misc_feature (262)..(263): n is a, c, g, or t
  modified_base (265)..(270): a, c, t, g, unknown or other
  misc_feature (265)..(270): n is a, c, g, or t
tcagtagtgtagatcacgaccggtgctcgatttagtgtcgtcgcaagagagagggatcgaggcacagatttcacactgaagatcagcagagtggaggctgaggatgttgggttattactgcatgcaaggtctacaaactcctcggatccaccttcggccaagggacacgactggagattaaacgatgtggctgcacatctgtcttcatcttcccgcatctgaatctacacgttactgagcggctggacaaggcgacntagcnntnnnnnn

SEQ ID NO: 7641 - DNA, 528 bp, Homo sapiens
  misc_feature: GYAE6OF01DX1SQ.37.71.G05.1.454.CMB.1.raw
  modified_base (368)..(368): a, c, t, g, unknown or other
  misc_feature (368)..(368): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctggagggtccctgagactctcctgtgcatcgtctggattcaccttccgagcttttgacatgagctgggtccgccggctccgagggaaggtctggagtgggtctcatccatcagttacaatggtacaaaccatatactacgcagtattttgngaaggccgcttcaccatctccagacgacaacgccaagacgctctctgtttctgcatatggacagcctgaacgacgccgacgcgcgtctctatacttacgtgtgacgagagtgggacggtcggcggtcgtggtcgaccgtcggtacgtccgttcgtaaccg

SEQ ID NO: 7642 - DNA, 590 bp, Homo sapiens
  misc_feature: GYAE6OF01BU9IW.37.71.G05.1.454.CMB.1.raw
  modified_base (310)..(310): a, c, t, g, unknown or other
  misc_feature (310)..(310): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtgggctgctaatgctctgggtctctggatgcgaggtgggatattgtgatgcatcacgtcccactctccctgcccgtcaccccgtggacgcgccggcctcatctcctgctaggtctagtcagcgccttccngcagtaggaaatggacactaacgttagtggattggtatcgtgcagagccagggcagtcctaccacactctgatcgttacgttcgggttactaagtccgggcccgttaccggggttccctaggaccgtagggttcgacggttcgggctagggttcggaacgttccgaacgggacctaacgtaggtacttttaccgaaccgtacgttaagaaacgtcgtacgaaggccgtaaggacgggttaggacggtacgtacgggaaggttcgtttgggttttaacggg

SEQ ID NO: 7643 - DNA, 672 bp, Homo sapiens
  misc_feature: GYAE6OF01C9GZX.37.71.G05.1.454.CMB.1.raw
  modified_base (371)..(371): a, c, t, g, unknown or other
  misc_feature (371)..(371): n is a, c, g, or t
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctgctcagctccgtggggctgctaatgctcgtgggtctctggatgcaggtggggatattgtgatgcatcacgtccccactcctccctcgccccgtccaccccgtggacgacgccccggcctccacttcctcctcgcaggtctagtcagacgcctcctgacagtaggaatcggaacactaactttagttaggtagtttggtatcgngacgagacgcgagggcacgtcctaccgaacacctcctagtacttcgttacgttacgggttactaaccggtcccggggtacccgtttacccgggggtccctacggtaccggttacgggttaccgagggtcggacgtacgggttcggtaactccgggacggtaaccgtaacgtaggttaacctttccgaaacgttacgtaacggtaaagtaccgttacggaacggtacggaaacgggttagggtacggggtaacggttacggtaggggtaaacgggttaggtttttgggggttttaaacgggg

SEQ ID NO: 7644 - DNA, 370 bp, Homo sapiens
  misc_feature: GYAE6OF01BDW8G.37.71.G05.1.454.CMB.1.raw
  modified_base (288)..(288): a, c, t, g, unknown or other
  misc_feature (288)..(288): n is a, c, g, or t
  modified_base (290)..(291): a, c, t, g, unknown or other
  misc_feature (290)..(291): n is a, c, g, or t
  modified_base (293)..(293): a, c, t, g, unknown or other
  misc_feature (293)..(293): n is a, c, g, or t
  modified_base (295)..(370): a, c, t, g, unknown or other
  misc_feature (295)..(370): n is a, c, g, or t
tcagtagtgtagatcacgaccggtgctcgattttagtgtcgtcgcaagagagagggggatcaggcactagatttccacactgaagagtcagcgagaggtcggaggctgacggatgttgggttatactgcatgcaaggtctacaaactcctcggatcaccttcggacctaagggacacgactggaagattaaacgaactgtggctgtcacattctgtcttcatcctaccgccactctagaactcctaacacttaacttgagcgggctggacaaaggcgccagtaggctncnntngnnnnnnnnnnnnnnnnnnnnnnnnnnnnnnnnnnnnnnnnnnnnnnnnnnnnnnnnnnnnnnnnnnnnnnnnnnnn

SEQ ID NO: 7645 - DNA, 696 bp, Homo sapiens
  misc_feature: GYAE6OF01CYGFH.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctctgggtctcgtggatgcaggtggggatattgtgatgcatcacgtccccactcctccctcgcccgtccaccccgtggacgacgcccggtcctacctactcctcctgcgacggtctagtcaagcgtccctccgtgctagtaggaaactggaacctaactaacgtttagttaggactttggtaacttcgtagaccgaaggaaacggtccggaaggggtacctaacggttcctaacccgtaacctaaccttccgtaggtaacttaccgtttacgttttaccgggtttaaccgtaacggttcccggggtccccggtttcccgggggttacccctacgggtaaccgttacgggtttaccgaagggtttcgggaccgtaagggttacggtaacgtccggaacggtacgaacgttacggtacttttacgaaccgtacgtagaaacggtctacgagtacgaggtaaggtgggtacggtcgtagggaaggttgtttcgggttttaagggg

SEQ ID NO: 7646 - DNA, 549 bp, Homo sapiens
  misc_feature: GYAE6OF01C6UNI.37.71.G05.1.454.CMB.1.raw
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
  modified_base (425)..(425): a, c, t, g, unknown or other
  misc_feature (425)..(425): n is a, c, g, or t
  modified_base (480)..(480): a, c, t, g, unknown or other
  misc_feature (480)..(480): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttgggctgttctggattttccttgttgcttgttttagaaggagtccactgtgaggtacagctggtggaatcgtgggggagcttggtacagcctggagggtccctgagactctcctgtgcatcgtctggattcaccttcgagtcttttgacatgagctgggtccgccgggctccgaggggaggtctggagtggtctcatccatcagttacaatggtacaaacataatactacgctaagtatttgngaagggccctcttcaccntctaccagacgaacaacgccaaagcgctctctgtttcngcatatcggacagtcctgagaacgcccgaacggaccgcggctactatacgttacngttgacgaagtagtgggacggtcgggtaggccgttgggtcgacgttcgggtcgaaccgttcgttaaccg

SEQ ID NO: 7647 - DNA, 648 bp, Homo sapiens
  misc_feature: GYAE6OF01ERUSI.37.71.G05.1.454.CMB.1.raw
tcagtagtgtagatcacgaccggtgctcgatttagtgtcgtcgcaagagagaggggggtcaggctggaactgaggagcaggtggggggcacttctccctctaacactctcccctgttgaagctctttgtgatcaggactcctcagttcaccttctcacaatgaggctccctactcagctccgtggggctgctaatgctctgggtctctggatgcaggtggggatattgtgatgcatcacgtccccactctcccctcgccccgtccacccctggacgacgcccggcctccactcctccgtgcgtaggtctagtcacgacgccctcctgctagtaggaaatcggaacactaacgttagttaggtattggtatctgactagacgcgaggcacgtcctaccactaaccttcctagtacttcgttacgtttcgggttacttaacggtcccgggtcccgttcccggggtccctaggaccgttacggttcgtaggtcgggcgtaagggtcggtacgtacgacggactaacgtagttactttacccaacgtacgtacggaaagtacgtacgaaggaccggtaaggacggggttacgggacggtaccggttaagggtaacgggttaggttttgggggttttacgggggttttaaacg

SEQ ID NO: 7648 - DNA, 534 bp, Homo sapiens
  misc_feature: GYAE6OF01A2O9T.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcacccctggagacgccggcctccatcctcctgcaggtctagtcagagccctctgcatggaaatggacacaacttatggattggtatctgcagaagccagggcagtctaccactaactctagacttctagttcgggttactaagtccgggcccgtccggggtccctgacgtggttcaggtcggcagtggatcgagggcacgtacgtatttcactacgtagaacgtactcgaaggcaaggtaggttggacggtcgtaggacgggtagttgggtttacgggg

SEQ ID NO: 7649 - DNA, 550 bp, Homo sapiens
  misc_feature: GYAE6OF01BM81T.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcacccctggagacgccggcctccatcctcctgcaggtctaggtcagacgcctcctgcagtggaaatggacaactaacttattggattggtatctgcagaagccgagggcagtctaccacaactctgatctagttcgggttctaacgtccgggccgttcccggggtcctgactggttcagtggcaggtggatcgagcacgagtactttcactacgtagaacgtactacgaggccgaagggtaggttacggggacgggtacgttagggaacgggttaggttgggtttttaacggggg

SEQ ID NO: 7650 - DNA, 266 bp, Homo sapiens
  misc_feature: GYAE6OF01B3IDO.37.71.G05.1.454.CMB.1.raw
  modified_base (254)..(254): a, c, t, g, unknown or other
  misc_feature (254)..(254): n is a, c, g, or t
  modified_base (260)..(266): a, c, t, g, unknown or other
  misc_feature (260)..(266): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggcacgactggagattaaacgactgtgctgcaccatctgtcttcatcttcccgcatctgaactctacactactgagcgggctggcaaggcncatagnnnnnnn

SEQ ID NO: 7651 - DNA, 262 bp, Homo sapiens
  misc_feature: GYAE6OF01DEMTT.37.71.G05.1.454.CMB.1.raw
  modified_base (258)..(262): a, c, t, g, unknown or other
  misc_feature (258)..(262): n is a, c, g, or t
tcagtagtgtagatcacgaccggtgctcgatttagtgtcgtcgcaagagagaggggatcaggcacagatttcacactgaagatcagcagagtggaggctgaggatgttgggtttatactgcatgcaaggtctacaaactcctcggatcaccttcggccaagggacacgactggagattaaacgactgtggctgcaccatctgtcttcatcttcccgcatctgaatctacactactgagcggctggcaaggcgcatagnnnnn

SEQ ID NO: 7652 - DNA, 508 bp, Homo sapiens
  misc_feature: GYAE6OF01BWZ1K.37.71.G05.1.454.CMB.1.raw
  modified_base (359)..(359): a, c, t, g, unknown or other
  misc_feature (359)..(359): n is a, c, g, or t
  modified_base (437)..(437): a, c, t, g, unknown or other
  misc_feature (437)..(437): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcacccctggagacgccggcctccatctcctgcaggtctagtcagagcctctgcatggaaatggacacaacttattggattggtatctgcagagcagggcagtcncacactctgatctattcggttctaagtccgggcctccgggtcctgactaggttcaggtggcaggtggatcgaggcaanagtactttcactactagaagctacgagcaggaggtagggacggacgttaggagggtgtttgggtttagggg

SEQ ID NO: 7653 - DNA, 262 bp, Homo sapiens
  misc_feature: GYAE6OF01CWSPP.37.71.G05.1.454.CMB.1.raw
  modified_base (259)..(262): a, c, t, g, unknown or other
  misc_feature (259)..(262): n is a, c, g, or t
tcagtagtgtagatcacgaccggtgctcgatttagtgtcgtcgcaagagagaggggatcaggcacagatttcacactgaagatcagcagagtggaggctgaggatgttgggttattactgcatgcaaggtctacaaactcctcggatcaccttcggccaagggacacgactggagattaaacgactgtggctgcaccatctgtcttcatcttcccgcatctgaatctacactactgagcgggctggcaaggcgcatagnnnn

SEQ ID NO: 7654 - DNA, 625 bp, Homo sapiens
  misc_feature: GYAE6OF01COUBS.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactcctccctcgccccgtccacccccgtggacgacgcccggcctccatcctcctgcaggtctagtcagacgccctcctgctagtaggaaaatggaaccactaactttagttggatttggtatcgtgacagaacgccgagggacagtcctaccaactaacttcctagtacttcttaagtttccgggttactaacggtcccggggtacccgttcccggggtccctaggtaccgtacgggttacagggtcggacgaggttcggattccgacgggtaccaacgtagttactttaccgaacgtaccgtagaaacgtctaccgaaggtcgaagggtagggtcgggaacgggtcgtagggtaagggtacgtttgggggtttttaacgggg

SEQ ID NO: 7655 - DNA, 279 bp, Homo sapiens
  misc_feature: GYAE6OF01A9FZQ.37.71.G05.1.454.CMB.1.raw
  modified_base (253)..(253): a, c, t, g, unknown or other
  misc_feature (253)..(253): n is a, c, g, or t
  modified_base (259)..(279): a, c, t, g, unknown or other
  misc_feature (259)..(279): n is a, c, g, or t
tcagtagtgtagatcacgaccggtgctcgatttagtgtcgtcgcaagagagaggggatcaggcacagattttcacactgaagatcagcagagtggaggctgaggatgttgggtttatactgcatgcaaggtctacaaactcctcggatcaccttcggccaagggacacgactggagattaaacgactgtggctgcaccatctgtcttcatctcccgcatctgaatctacactactgagcgggctggcaaggcncatagnnnnnnnnnnnnnnnnnnnnn

SEQ ID NO: 7656 - DNA, 541 bp, Homo sapiens
  misc_feature: GYAE6OF01CWR96.37.71.G05.1.454.CMB.1.raw
  modified_base (415)..(415): a, c, t, g, unknown or other
  misc_feature (415)..(415): n is a, c, g, or t
  modified_base (432)..(432): a, c, t, g, unknown or other
  misc_feature (432)..(432): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggaggcttggtacagcctggagggtccctgagactctcctgtgcatcgtctggattcaccttccgagctttttgactatgagcgtgggtcccgcgggctccgagggaagggctggagtgggtctcgaggtatttacgtggtagtggtaactcgctatactacgcagctccgtgacgggccgttcacgtctcagagacattccaagactacggtntatcgtagaaatgaacngcctgagacgcgaggacaccggcctctacttacgtgtgcgagagatcgaagacggagtagtagcgagcacgctcgtacgactacggtcggggcccgacgggtaaccccg

SEQ ID NO: 7657 - DNA, 528 bp, Homo sapiens
  misc_feature: GYAE6OF01DJJ4R.37.71.G05.1.454.CMB.1.raw
  modified_base (325)..(325): a, c, t, g, unknown or other
  misc_feature (325)..(325): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccatgtgaggtacagctgggtggaatcgtgggggaggcttggtacagcctggaggggtccctgagactctcctgtgcatcgtctggattcaccttccgagcttttgactatgagctgggtccgccgggctccgagggaaggtctggagtgggtctnatccgatcagttacaatggtaccaaactatatacacgcagtatttgtgaagggccgcttcacctatctaccaagagaacaacgacaagcgctctcttgtttctgctatagtggacagcctgagacgccgacgcgcgctctatacttactgtgcgagagtcgggacgggcgggtggcgtggtacgagttcggtcgtcgttaccg

SEQ ID NO: 7658 - DNA, 671 bp, Homo sapiens
  misc_feature: GYAE6OF01CNPMZ.37.71.G05.1.454.CMB.1.raw
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
tcagtagtgtagatcacgaccggtgctcgatttagtgtcgtcgcaagagagagggggtcaggctggaactgaggagcaggtgggggcacttctccctctaacactcctcccctgttgaagctctttgtgatcaggactcctcagttcaccttctcacaatgaggctccctgctcagctccgtgggctgctaatgctcgtgggtctcgtggatgcgtaggtggggattagttgtgatgcatcacgtcccactcctccctcgcccgtccacccgtggacgcgccggcctccactcctccgngacngtctagcagacgtcctacgtgactagtaggaaactcggaaccaacgttaacttagttggtactttaggtacttcgagtacaaacggacgaccgagggcctagtcctacccaacaacttcgtagtactacgtttacggttacggttactacggcccggggtcccgtacccgggtctacggtacgttaggtcgtaggtcggacgttaggtccgtaagtaccggacggactaacgtaaggttacctttacgaacccgtaggtaaggaaacgttaacgtacccgtacgggaaccgttaaggggtaagggacggggtacgggtcggttaaaggggttacgggttaagggtttttagggggtttttaaacgggg

SEQ ID NO: 7659 - DNA, 709 bp, Homo sapiens
  misc_feature: GYAE6OF01EAWIP.37.71.G05.1.454.CMB.1.raw
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttgggtacagcctggagggtccctgagactctcctgtgcatcgtctggattccaccttccgagtcttttgacatgagcgtgggtccgccgggctccgaggggacggtctgggagtggtctcactccatcagttacaagtcggtacaaaccatactactacgactagttattttggtaggaacgggtccgtcgttaccaaccctattaccctaccaagtaacgaacccaaaccaccgaaagacgtccttacttccgtttgtttcctcggtacctaagttacgtcggtaacacggtacccgtaggaacggacggtaccccggaacggtaccgggtacccggtaccttaccgttaacgtttacgttaaccgttcgggtacggtaaccggtaagggtacggttacgggggtaaccggggtccggggttacgggtccgggtttacggggttaccggttacccggttacccggggtttaccgttaacccgtttccggttaaaacccggg

SEQ ID NO: 7660 - DNA, 703 bp, Homo sapiens
  misc_feature: GYAE6OF01CQY33.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctctgggtctcgtggatgcgaggtggggattagttgtgatgcatcacgtcccactcctccctcgcccgtccacccgtggacgcgcccggcctccacttcctcctcgccgtacgggtcctacgtcgacgacgcccttccgtcgcaagtacgggaaaagttcggaacctaactaaacgtttagtttaggtagtttacgggttacttcgtacgacgtaaaggaacggacccggaggggtacctaaggttcccttaacccaaaccgtaaccttccgttagtaacctttacgtttaacggtttcccggggttaccttaaccgggttcccgggtccccggttcccggggttccctaggacgttacggtttcgacgggtcggaccagggttcggaacttcgagggtaccaacgtaggttaaccttcgaaacgtcgtaagaacgtacgtacgtaggcgtaaggagggttacgggacggtacggtggggtaaagggtggttttgggtttttaacgggg

SEQ ID NO: 7661 - DNA, 565 bp, Homo sapiens
  misc_feature: GYAE6OF01EJP9D.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatccacgtccccactcctccctcgccccgtccacccctggacgacgcccggcctccatcctcctgcgtaggtctagtcagacgcctcctgacagtaggaaatggaacaactaacgttagtggtagttggtatcgtgacagaacgcgaggcacgtctaccactactctgtatcttagttcggttactacgtccgggaccgttcccggggtaccctgacgtgttacgaggtggacgaggtagactcgacggacaacgagttacttcaactacgagaaagactacgaggtaccgaggtaggagggtacggtacgtaggaggtagttgggttttacggg

SEQ ID NO: 7662 - DNA, 866 bp, Homo sapiens
  misc_feature: GYAE6OF01AG7Q5.37.71.G05.1.454.CMB.1.raw
tcagtagtgtagatcacgaccggtgctcgatttagtgtcgtcgcaagagagagggggtcaggctggaactgaggagcaggtggggcacttctccctctaacactcctcccctgttgaagctctttgtgatcaggactcctcagttcaccttcctacaactaagtcggacgtccctccgtcgtcctacgcgtccgtcgggtcgggtctcgtactagtcgtccgttcggtcggtcgtggtagtgtggtacggtagggtaggtattgttcgagtacgtcgtacctaccgtaccgtcccctacccctcccgttccccgtcccggtaccccgtaccccggtacccggtacgggtaccggacccggtccccggtcccctaccccttaccgtccgttcccggtacggtaccggtacggttaccgttaccgtacgtaccggtacccgtacccgtaccgtacgtaacggtaaacggttaacggtaaacggtaaccgtaacccgttaaccgttaaacgtttacggtttaagggttacggttacggttaacgtaccgtacggtaaccggtaaccggaaccggtacccggtacggtaccgtaaccctacccgtaaccctaacccttaaccgtaccgttacgttaccgttaccggtttaaccgggttaccgggttaccggtaacccggttcccgggtccccgggttcccgggtaccgtacgtacggttaccggtacgtcggtacggtacgtacggtacgaccgtacgtaacgactaacgttaacgtactacctacgaacgtagaacgtacgtagaaggacgtagggtacggtacggtacggtacggttagggttaggttacggtttgggttacgttacg

SEQ ID NO: 7663 - DNA, 530 bp, Homo sapiens
  misc_feature: GYAE6OF01B0OUQ.37.71.G05.1.454.CMB.1.raw
  modified_base (376)..(376): a, c, t, g, unknown or other
  misc_feature (376)..(376): n is a, c, g, or t
  modified_base (437)..(437): a, c, t, g, unknown or other
  misc_feature (437)..(437): n is a, c, g, or t
  modified_base (470)..(470): a, c, t, g, unknown or other
  misc_feature (470)..(470): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgcttgttttagaaggagtccactgtgaggtacagctggtggaatcgtgggggagcttggtacagcctggagggtccctgagactctcctgtgcatcgtctggacttcaccttccgagtcttttgacatgagctgggtcccgccgggctccgaggggaagggtctggaggtgggtctcatccatcagttacaatggtacaaaccatatactacgcagtattttgngaacgggccgtcttcaccatctccagacgacaacgaccaagagctctcttgttctgctatntgacagcctgagcgccgacgacgcggctctatnttactgtgcgagagtacgggcggcgggtggcgtggtcgtacgtcggtcgtaccgttaccg

SEQ ID NO: 7664 - DNA, 593 bp, Homo sapiens
  misc_feature: GYAE6OF01CTNL9.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctgctcagctccgtggggctgctaatgctctgggtctctggatgcagtgggatattgtgatgcatcacgtcccactcctccctcgcccgtcaccccgtggacgacgccggcctccatcctcctgcaggtctagtcagacgcctcctgacagtaggaaatggaaccactaactttagttggatttggtatcgtgacagaacgccgagggctagtcctaccaactaacctcctagacttcgttagttcggttactaacgtccgggcccgttccggggtcctggacgtcggttcaggtcggcgtaggtgactcgaggcaacgtacgtactttacacgtacgtagaaacgtacgtacgaacggcgtaaggtacggtacggggtaacggtcgttaggggtaacggttaggttttcggggtttttaaacgggg

SEQ ID NO: 7665 - DNA, 736 bp, Homo sapiens
  misc_feature: GYAE6OF01ECJ0K.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgagctccctgctcagctccgtgggctgactaatcgctcgtggtctcgtggatgctaggtggggattagttggtagactgctatccgtaccgttaccccctacttccctccccgtccggtaccccgtcccaccccgtgggaacgaccggccccggtccctcctacttccctccgtcggtaccgtaacggttcctacggtaccgaacggtacccgtcccttccgtggaccgtaaggtaacgggaaacgttaccggaaacctaacttaaacgtttagttacggtagtttggtaacttcgtacgacgaaacgacggtaccggacgggtactacgttcctaaccgaacccttaccgttcgtacgtactttaccgttaacggtttccggttactaacgggttccccgggtcccggttccccgggttacctaggtaccgttagggttacgacgggtcggacgtagggtcggtactacggacggactacgtacgttacttaccgactacggtaaagacgtactacggacgaggacggtagggtacggacggtactagggtaggttaggtttgggttttaaacggg

SEQ ID NO: 7666 - DNA, 734 bp, Homo sapiens
  misc_feature: GYAE6OF01E4TKF.37.71.G05.1.454.CMB.1.raw
  modified_base (229)..(229): a, c, t, g, unknown or other
  misc_feature (229)..(229): n is a, c, g, or t
  modified_base (258)..(258): a, c, t, g, unknown or other
  misc_feature (258)..(258): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctctgggtctcgtggatgcaggtgggattagttgngatgcagtcacgtccccactccttccccncgccccgtccaccccgtgggacgaccgcccggccctccactcctccgtgcgaggttcctaggtcaaggtccgcccttccgtgacgtaagtagggaaagttcggaacctaacgtaacgtttagttaggatttggtactcgtagactagaacgccgagggacacgtacctaccaaccgttaactccgtagtacgtttacgttaccggttttcgggttaacttaaccggtccccgggggtaccccgttaccccggggggttcccttacgggtaacccggtttaggggttacccgtaggggttcgggaccgttaagggtcgggtaacttccggaaaggtccctaaccgttaggttaaccttttacgaaagtttaccggaaggtaaacggtccttaggaacggtccgaaggtaaggggttccgggtaaacgggttccggttaagggaacggggttttaggtttggggttttttaaacgggg

SEQ ID NO: 7667 - DNA, 574 bp, Homo sapiens
  misc_feature: GYAE6OF01BS65M.37.71.G05.1.454.CMB.1.raw
  modified_base (318)..(318): a, c, t, g, unknown or other
  misc_feature (318)..(318): n is a, c, g, or t
  modified_base (533)..(533): a, c, t, g, unknown or other
  misc_feature (533)..(533): n is a, c, g, or t
tcagtagtgtagatcacgaccggtgctcgatttagtgtcgtcgcaagagagaggggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactcctccctcgccccgtccaccccgtggacgacgccggcctccatcctcctgcgaggtctagtcagacgcctcngcagtagaaatcggaacactaacttagttggtatttggtactcgtggactaaggaacgccggagggctacgtcctaccaacctaacctctagtacttcgttacgtttccgggttactaacggtccgggtcccgtccgggtccctagacgttaggtcagtcggcgtaggtcggatcggacgtcacgtagtcttacactacgtagaagtctacgagngaaggtggtgggacgctagggaggtggttgggtttaacggg

SEQ ID NO: 7668 - DNA, 523 bp, Homo sapiens
  misc_feature: GYAE6OF01ECF07.37.71.G05.1.454.CMB.1.raw
  modified_base (490)..(490): a, c, t, g, unknown or other
  misc_feature (490)..(490): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatctgggggagcttggtacagcctggagggtccctgagactctcctgtgcatcgtctggattcaccttccgagtcttttgacatgagctgggtccgccgggctccgaggggaagggtctgggagtgggtctcatccatcagttacaatggtacaaaccatatactacgcagtattttgagaagggccgcttcaccatctccaagacgacaacgccaaagacgctctctgtttctgcatatggacagcctgagacgccgacgacgcgactctatattactgtgcgagagtgggacggngggtggcgttgggtagaagtcggtcgcgttacg

SEQ ID NO: 7669 - DNA, 265 bp, Homo sapiens
  misc_feature: GYAE6OF01EXQNB.37.71.G05.1.454.CMB.1.raw
  modified_base (263)..(265): a, c, t, g, unknown or other
  misc_feature (263)..(265): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnn

SEQ ID NO: 7670 - DNA, 670 bp, Homo sapiens
  misc_feature: GYAE6OF01CTOMO.37.71.G05.1.454.CMB.1.raw
  modified_base (216)..(216): a, c, t, g, unknown or other
  misc_feature (216)..(216): n is a, c, g, or t
  modified_base (289)..(289): a, c, t, g, unknown or other
  misc_feature (289)..(289): n is a, c, g, or t
  modified_base (373)..(373): a, c, t, g, unknown or other
  misc_feature (373)..(373): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgcttgttttagaaggagtccactgtgaggtacagctggtgaatcgtgggggagtcgttggtacnggcctgggacgggtccctaggacgactctcctggtgctatcgtctggacttccaccttccgagtctttgactntgagcgtcgggtccgccgggctccgaaggggaacggtctggagtcgggtctacgactccatcaagttacaagtcgtacaaactntaactactacgactagtattttggagtaacggggtccctaccgtttcaaccgtattcccgtacaaggaacgaacgaaccgaccgaaacgacgtcctcgttcgttgtttactcgtacgtaattacgtacggactacggcccttaggaacgtaccgacccggaaccggtaacgccggtacttacgtaacgttacttacgtggacggtacgaaggtacggtagggtaccgggcgggttacggtcgggttacgggtacggtaaccgttccggggtacccgtaaccgttcggttaaacccgg

SEQ ID NO: 7671 - DNA, 530 bp, Homo sapiens
  misc_feature: GYAE6OF01CUZB3.37.71.G05.1.454.CMB.1.raw
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (426)..(426): a, c, t, g, unknown or other
  misc_feature (426)..(426): n is a, c, g, or t
  modified_base (479)..(479): a, c, t, g, unknown or other
  misc_feature (479)..(479): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctggagggtccctgagactctcctgtgcatcgtctggacttcaccttccgagcttttgacatgagctgggtccgccgggctccgaggggaaggtctggagtggtctcatccatcagtacaatggtacaaaccntatactacgcagtattttgngaacgggccgctttcacctatcctccagacgacaacgccaagacgctctctgtttcngcatagtcgacagcctgagagccgacgcgcgctactatattactgtcgcgagngtgggacggcggtggacgttgggtcgacgtcggtcgtacgttcgttaaccg

SEQ ID NO: 7672 - DNA, 523 bp, Homo sapiens
  misc_feature: GYAE6OF01DNB5X.37.71.G05.1.454.CMB.1.raw
  modified_base (474)..(474): a, c, t, g, unknown or other
  misc_feature (474)..(474): n is a, c, g, or t
  modified_base (506)..(506): a, c, t, g, unknown or other
  misc_feature (506)..(506): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttgggggctgttctggattttccttgttgctgttttagaaggagtccactgtgaggtacagctggtggaatctgggggaggcttggtacagcctggagggtccctgagactctcctgtgcatcgtctggattcaccttccgagcttttgacatgagctgggtccgccgggctccgagggagggtctggagtgggtctcatccatcagttacatgtacaacatatactacgcagtatttgtagaagggcctcttcacctatctacaagacgaaccaacgaccaagacgctctacttgtttctgctatatggacagtctgagacgccgacgacgcgtctctatacttacgngtgcgagagtcgggacggcggtggcgtggtanacgttcggtcgtctacg

SEQ ID NO: 7673 - DNA, 589 bp, Homo sapiens
  misc_feature: GYAE6OF01CIA29.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatccacgtccccactcctccctcgccccgtcacccccgtggagacgcccggcctccatctcctgcgaggtctagtcagacgcctcctgacagtaggaaatggaaccactaaacttagttggtattggtatcgtgacagaacgcgtagggcagtcctaccaactactcctgtactcttagttcggttactaacgtccgggcccgttccgggtccctgactacggttcaggtggctaggtcggatcgaggtaccaacgtactaactttaccaacgtacgtagtaagtactacgaaggtccaagggtacggttaggaacgggtacgttagggaacgggttaggttttgggttttaacgggg

SEQ ID NO: 7674 - DNA, 538 bp, Homo sapiens
  misc_feature: GYAE6OF01CFVLD.37.71.G05.1.454.CMB.1.raw
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (428)..(428): a, c, t, g, unknown or other
  misc_feature (428)..(428): n is a, c, g, or t
tcagtagtgtagatcacgaccggtgctcgatttagtgtcgtcgcaagagagaggggccttagccctggattccaaggcatttccacttggttatcagcactgaacacaaaggactcaccatggagttggggctgttctggattttccttgttgctgtttttagaaggagtccactgtgaggtacagctggtggaatcgtggggggagcttggtacagccgtggagggtccctgagactctcctgtgcatcgtctggattcaccttccgagcttttgacatgagctgggtccgccgggctccgagggaagggtctggagtgggtctcatccatcagttacaatggtacaaaccatactactacgcagtattttgngaaggtccnctttcacctatctccagagacaacgccaagacgctctctgtttcngcatatggacagcctagacgacgccgacggacgcggctactatattacgtgtgcgagagtcgggacggcggtggcgtggtacgacgttcgggtacaccttgttacgtacc

SEQ ID NO: 7675 - DNA, 622 bp, Homo sapiens
  misc_feature: GYAE6OF01EHQD6.37.71.G05.1.454.CMB.1.raw
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatcgtgggggagctttggtacagcctgggacgggtccctagacgactctccgtgtgcatcgtctggcttccaccttccgatcttttgactatgagcgtgggtccgcgggtctccggagggaacggtctggagtcgggtctcgatcctatcgaagttaacaagtacggaaccaaacatactaacacgactagtagttttggagaacggtccgtacttccactacttccacgagtacgaaccaacgaccaagcgtactacgttctcgtttacncgactagtagtcgacncgccgtaggacgacgtacccggaacgcgccgtactacttacgtacttacgtgtaccgacgtaggtacggtggggaaccgggttcgggtacgggtcgttcgggtacgaccggtttccggaccgtacgttaaccggttaacccg

SEQ ID NO: 7676 - DNA, 589 bp, Homo sapiens
  misc_feature: GYAE6OF01ATTVJ.37.71.G05.1.454.CMB.1.raw
  modified_base (533)..(533): a, c, t, g, unknown or other
  misc_feature (533)..(533): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactctccctgccccgtccaccccctggacgagcccggcctccatcctcctgcaggtctagtcagacgcctctgcagtggaaatggacacaacttatggtattggtatctgacagaacgcgagggcacgtcctccgaactacctccgtagacttcgttagtttccgggttacttaacgtcccggggtacccgttcccggggtccctacggtaccgtacggttcgacggttcggacgtaggtggacttcggacggccacgagtactttcaaccgtacgtaaggaagtacgtanaacggtgaggtagggtaggacgggtgtaagggaggtaggtttggggttttacgggg

SEQ ID NO: 7677 - DNA, 543 bp, Homo sapiens
  misc_feature: GYAE6OF01BRDWF.37.71.G05.1.454.CMB.1.raw
  modified_base (376)..(376): a, c, t, g, unknown or other
  misc_feature (376)..(376): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggaggcttggtacagcctggagggtccctgagactctcctgtgcatcgtctggattcaccttccgagtcttttgacatgagctgggtcccgccgggctccgaggggaagggtctggaggtgggtctcatccatcagttacaatcggtacaaaccatatactacgcagtattttgngaagggccgcttcaccatctccagacgacaacgaccaagacgctctctgtttctgctatagtcggacacgcgtgagacgcccggacggacgccggtctactatattcgtgtggacgtagagtgggcgggcgggtggcgtggtacgtaccgtcggtcgtacttaccgg

SEQ ID NO: 7678 - DNA, 579 bp, Homo sapiens
  misc_feature: GYAE6OF01C97N0.37.71.G05.1.454.CMB.1.raw
tcagtagtgtagatcacgaccggtgctcgatttagtgtcgtcgcaagagagagggggtcaggctggaactgaggagcagggtgggggcacttctccctctaacactctcccctgttgaagctctttgtgatcaggactcctcagttcaccttctcacaatgaggctccctgctcagctccgtggggctgctaatgctcgtgggtctcgtggatggcgtaggtggggtatagttgtgatgcatcacgtcccactcctccctcgccctccacccgtggacgcgccgcctcatcctcctgcgacggtctagtcgagacgtcctctgctagtacggaaatgaacaactaacgttagttaggtatttggtatcgtgacgtaagacgacggagggacctagtcctaccaacctactcctagtactcgttacgttcggttacgtacggtccgggtccgtcccgggtcctgtacgtcgtcgtgtcggactggtacgagtcgagcaacgtacgtacttacactagtacgaagtacagacgtacgaggtaggtacggacggtacgtaggtaggttggttgggtttaggg

SEQ ID NO: 7679 - DNA, 543 bp, Homo sapiens
  misc_feature: GYAE6OF01EP0ZF.37.71.G05.1.454.CMB.1.raw
  modified_base (268)..(268): a, c, t, g, unknown or other
  misc_feature (268)..(268): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctggttctggattttccttgttgctgttttagaaggagtccatgtgaggtacagctggtggaatcgtgggggagcttggtacagcctggagggtccctgagactctcctgtgcatcgtctggattcaccttccgggnttttgacatgagctgggtccgccgggctccgaggggaaggtctgggagtgggtctcatccatcagttacaatggtacaaacatatactacgcagtatttgagaagggccgcttcaccatctccagacgaccaacnccaagngtctctgttgtttctncatagnggacagctgacgacgccggacgacgcgcttctattattcngtcgngaggtacgtgggacggtcggtcggtccgtgggtacgaccgttccgggtacgtaccgtgttaacccgg

SEQ ID NO: 7680 - DNA, 294 bp, Homo sapiens
  misc_feature: GYAE6OF01BKX75.37.71.G05.1.454.CMB.1.raw
  modified_base (290)..(294): a, c, t, g, unknown or other
  misc_feature (290)..(294): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgcatctgaatctacactactgagcggctggcaaggcgcatagnnnnn

SEQ ID NO: 7681 - DNA, 629 bp, Homo sapiens
  misc_feature: GYAE6OF01CEYUU.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactcctccctcgccccgtcacccccgtggggacgcccggcctccatcctcctgcaggtctagtcagcgcctcctgcagtaggaaatcggacaactaactttagttaggtattaggtatcgtagcgaagacgcgaagggcacgttcctaccaactaacttcctagtacttacttacgtttcgggttacttaaacgtcccggggtacccgttcccgggggtccctaggtaccgttacgggtttctaagggtcgggtacgaggttaggacgttacgaacgggtaccaacgtacggtactttaccgaacgtacgtacggaaagtactacggaagtacgaggtaggtagggaacggtcgtaaggaggttacgttgggtttaggggtttaacg

SEQ ID NO: 7682 - DNA, 510 bp, Homo sapiens
  misc_feature: GYAE6OF01E2YBY.37.71.G05.1.454.CMB.1.raw
  modified_base (375)..(375): a, c, t, g, unknown or other
  misc_feature (375)..(375): n is a, c, g, or t
  modified_base (468)..(468): a, c, t, g, unknown or other
  misc_feature (468)..(468): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatattgtgatgcatcagtccccactctccctgccccgtcaccccctggacgagccggcctccatccgtcctgcaggtctagtcagacgcctcctgcatggaaatggacacaacttatggattggtatctgcagaagccagggcagtctccacactccngatctagttcggtctaagtccgggctcccgggtcctgactggttcaggtggcaggtggactacgaggcagtagtactttcactactagaacgntacgagcagaggtcggaggctaggaggtgttgggtttagggg

SEQ ID NO: 7683 - DNA, 794 bp, Homo sapiens
  misc_feature: GYAE6OF01AGWRN.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggctccctgctcagctccgtggggctgctatgctcgtgggtctcgtggatgcgaggtgggtattagttgtgatgactactccgaccgtccccctacctccctccccgtccggcccccgtacctaccccggtagggaacgccggccccggtcccctcctacttcctccgtgccgtaggtcttacggcacgtaccgtccctcgtcgactaaggtaacggaacgtacggaacctaaacgttaacgttagttggtaagtttggtaacttcgtaggtacgaaggaacggccggtaacgggcgtacgtacctacccaaccgtaaccgttccgtagttaccgttacgttaccggtttaccgggttaaccgtaccgggttccccggggtaccccggttcccggggtacctacgggtacccggttagggttccgtacgggttcgggtaccggtaacggttacgggacgtaccgtaacgggtcctaacggttaacgtttaccgttaaccgaaccgttaaaggtaaccggtaaacgtaccgttaacggaacggaccgggttaaaggtacgggggtacgggttaaaggggtccgttaaagggggttacgggttttaaggggtttttaggggtttttaaccgggg

SEQ ID NO: 7684 - DNA, 576 bp, Homo sapiens
  misc_feature: GYAE6OF01DX0HM.37.71.G05.1.454.CMB.1.raw
  modified_base (372)..(372): a, c, t, g, unknown or other
  misc_feature (372)..(372): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcacccctggacgacgccggcctccatcctcctgcaggtctagtcagacgccctctgcagtaggaaatggaacactaactttattggattggtatctgacagaacgcgagggcagtcnccacaactcctgacttcttagttcgggttctaacggtccgggtcccgtccgggtccctagacgtacggttcaggtggcgtaggtggactcgacggctacgagtactttccgactacgtagaaacgtcttaccgaagtccgaagggtagggttcggggaacggttacggtaagggaaggttagggttggggttttttaacggggg

SEQ ID NO: 7685 - DNA, 648 bp, Homo sapiens
  misc_feature: GYAE6OF01C1ZDT.37.71.G05.1.454.CMB.1.raw
  modified_base (296)..(296): a, c, t, g, unknown or other
  misc_feature (296)..(296): n is a, c, g, or t
  modified_base (360)..(360): a, c, t, g, unknown or other
  misc_feature (360)..(360): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactcctccctcgcccgtccaccccttggagacgcccggcctccatcctcctgcnggtctagtcagacgccctctgacagtaggaaatggaactactaacttagttggtattggtatcngacagaagccgagggctagtcctaccaacctactcctagtacttactttaggtttccgggttacttaacggtcccggggtacccgttcccggggttcccctaggtaccgttacgggttccgtaagggttcgggtacgtagggttacggtaacgttccggacgggtacctaaccgtaggttacctttaaccgaaccgtaccgtaaggaaacgtacgtacgacggacgaagggtagggtagggtacggtacggtaggggtaaacggtggttttggggtttttaaacgggg

SEQ ID NO: 7686 - DNA, 600 bp, Homo sapiens
  misc_feature: GYAE6OF01CKSPI.37.71.G05.1.454.CMB.1.raw
  modified_base (297)..(297): a, c, t, g, unknown or other
  misc_feature (297)..(297): n is a, c, g, or t
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctgctcagctccgtggggctgctaatgctctgggtctctggatgcaggtggggatattgtgatgcatcacgtccccactcctccctcgcccgtccaccccgtggacgacgccggcctccactcctcctgcnggtctagtcagacgcctcctgcagtaggaaatcggaacactaactttagttggtagtttaggtatcgtgacgagaacgccgagggctacgtcctacccaactaaccttccgtagtacttacgttacggtttaccgggttacctaacggttcccggggtcccgtttcccggggttaccctggaccgttagggttcgaggttcggacgtagggtcgacgtacgaggccaagtagtactttcaactacgtagaagtactcgagcgaggaggtcggacggtcgtaggtaggtgtttgggtttacggg

SEQ ID NO: 7687 - DNA, 297 bp, Homo sapiens
  misc_feature: GYAE6OF01A6H01.37.71.G05.1.454.CMB.1.raw
  modified_base (293)..(297): a, c, t, g, unknown or other
  misc_feature (293)..(297): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttggggtttattactgcatgcaaggtctacaaactcctcggatcaccttcggccaaagggacacgactggagattaaacgaactgtggctgcaccatctgtcttcatcttcccgccatctgaatctacactactgagcgggctggcaaggcgcatagnnnnn

SEQ ID NO: 7688 - DNA, 566 bp, Homo sapiens
  misc_feature: GYAE6OF01AML5F.37.71.G05.1.454.CMB.1.raw
  modified_base (355)..(355): a, c, t, g, unknown or other
  misc_feature (355)..(355): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctggacgggtccctgacgactctcctgtgcatcgtctggacttcaccttccgagtcttttgacatgagctgggtccgcggctccgagggaggtcgtggagtgggtctcagtccatcagttacaagtcggtacaaacctntactactacgactagtagttttgaggtaacggccgtcttaccacctatcctaccgagacgaccaacgacaagagctctacttgtttctgctagtntggacncgtctagacgacggcccgacgacgccgtctactatacttacgtgacgcggtagaggtacgggacggtcgggtggcgtcgggtacgaccggttcggtcgtcgtttacccgg

SEQ ID NO: 7689 - DNA, 524 bp, Homo sapiens
  misc_feature: GYAE6OF01AHPW5.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgccccgtcaccccctggagacgccggcctccatctcctgcaggtctagtcagacgcctcctgcatggaaatggacactaacttattggattggtatctgcagaagccgagggcagtctccacaactcctgatctattcggtctaagtccgggcctccgggcctgactggttcagtggcaggtggatcgaggcacgagtactttcactacgtagaagtactcgaaggcgaggaaggtgggacggacgttagggagggtagttgggttttaacgggg

SEQ ID NO: 7690 - DNA, 749 bp, Homo sapiens
  misc_feature: GYAE6OF01CLSBL.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcaacaatgacggcctccctgctcagcctccgtggggctcgctaatcgctcgtgggtctcgtggatggacgaggtgggtattagttgtgattgactactccgtaaccgttccccacttcccgtcccgtccggtaccccgtccaaccccggtgggaaccggccggtccccggtccctacctacttcccgtccgtcggtaccgtacggttcttaacgtaccgaacggtacccgtcccctttccgaaggtaccgtaaaggtaagggtaaaacgtacggtaaaccctaaaacgtttaaacgtttagttaacgggttaaggtttacgggtacttcggtaacgacggtaaaacgggtaacggacccgggtaagggaccttacggtaccctaccgtaacctaacgtccgttagtaactttcggtttacggtttaccgggaccttacgggcccggggtaccccgttcggtacctgaccgttaggttcgaaggtcgacgtaggtcggaactcggacgtactagtagttactcgaaagttccgtaagacgtacacgaagcggaggtaagtgggtacgtacgtagggaggtttcggtttgggtttacg

SEQ ID NO: 7691 - DNA, 600 bp, Homo sapiens
  misc_feature: GYAE6OF01CDKQB.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatgcaggtggggattattgtgatgcatcacgtccccactcctccctgccccgtccaccccgtggacgacgcccggcctccatcctcctgctaggtctagtcagacgccctctgcagtaggaaatcggacaactaacttagttgatttggtatcgtgacagaacgccgagggctacgtcctaccaactacctcctagtacttacgttacgtttcgggttactacggtccgggtcccgttcccggggtcctggaaccgtacgggtttacaggtcggctaggtaggactcgaggtccacgtagtactttacgaactacgtagaagtactgaacggcgaaggtagggtacgggacggtacggtagggaacgggttagtttcggggttttaagggg

SEQ ID NO: 7692 - DNA, 580 bp, Homo sapiens
  misc_feature: GYAE6OF01BDNUB.37.71.G05.1.454.CMB.1.raw
  modified_base (315)..(315): a, c, t, g, unknown or other
  misc_feature (315)..(315): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactcctccctcgccccgtcaccccgtggacgcgccggcctccatcctcctgcaggtcctagtcagacgcctcngacagtggaaatggacactaacttagttcggattggtatcgtgcagaagcgagggcagtctaccacactctgacttctagttcgggttataacggtccggcccgttccggggtcctggacgtacggtctagtcggacgtaggtcggactcggagccgatacgttactttcgaacctacgtaggaaacgtctacgaacggcgtaagggaagggtaggggtaacggtcggtaagggtacgggttaggtttcggggtttttaacgggg

SEQ ID NO: 7693 - DNA, 708 bp, Homo sapiens
  misc_feature: GYAE6OF01EF8T4.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctactcagctccgtgggctgctaatgctcgtggtctcgtggatgcgaggtgggtattagttgtagatgctactcgtaccgtcccctacgtcctcccgtcgcccgtaccacccgtggacgaccgcccgcctccactcctcgtcgacgtacgttctacgcgacgaccgtcctcgtacgactaagtaaggtaacgtcgaactaacgttaacgtttagtacggtagttggttactcgtagacgaacggtaaacgccggacggtacaaccgttcctaaccgtaacgtaccgttccgagttacttttacgttaacggtttaccggttaacgtacgggttcccccgggtcccgtttacccgggtaccttaggtaaccgttcgttcggacggttgaccgtaggtcgaactcggaacgactaacgttacgttccttaacaacgtacgttaaagaacgttacgtacccggaggtacggaacgggttacgggtagggttaccggtaggtagggtttaaagggtttacggttttggggtttaacccgggtttaa

SEQ ID NO: 7694 - DNA, 623 bp, Homo sapiens
  misc_feature: GYAE6OF01BB65L.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctcctggggctgctaatgctcgtgggtctctggatgcaggtggggatattgtgatgcatcacgtccccactcctccctcgcccgtccaccccgtggacgacggcccggcctccacttcctcctcgcgtacggttcgtagtcgagtacgtccctcctcgactaagtaggaaagtcggaactaactaactttagttggtagttggtactcgtgacgaagacgcgaggacacgtcctaccaactacctcctagtacttcgttacgttcgggttactaacggtccgggtcccgtccgggtccctagacgtggttcaggtcggacgtggtacgagtccgaacggcacgtagttacttacgacgtacgtagaagtaccgtacgagtacggaagggtaggtacgggaaggttcggaagggttaaggggtcgttttagggggttttagggttaacg

SEQ ID NO: 7695 - DNA, 579 bp, Homo sapiens
  misc_feature: GYAE6OF01DT2ZO.37.71.G05.1.454.CMB.1.raw
  modified_base (446)..(446): a, c, t, g, unknown or other
  misc_feature (446)..(446): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggctccctgctcagctccgtgggctgctaatgctctgggtctcgtggatgcaggtggggattagttgtgatgcatcacgtccccactcctccctcgcccgtccaccccgtggacgacgcccgcctccactctcctgcaggtctagtcagacgtcctctgcagtacggaaatcggaactaactaacttagttaggtagtttggtaattcgtgacaggaacgcgaggcagtccaccacactctagatcttagttcggtactacggtcccgggccgtcccgggtccngtactggttcaggtggactagggtgtactcgaggccaagtacgtacttacaacgtacgtagaaaggactacgacgacggaaggacggttagggacgggtgttaggggaaggttggtttggggttttaacgggg

SEQ ID NO: 7696 - DNA, 810 bp, Homo sapiens
  misc_feature: GYAE6OF01DU7RS.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtcctgtgtgcgaggtaggggtaggtattgttggtagtagtcgactactaccgtacccctaccctacccttccccgttcccgtcccgtacccgtaccccgtaccggtacggacggtcccggcccgtccctacctaccttccgtcgtcgtacggtacgttacgtacgtacgacggtcctccgtcgtacgacgtaggaaacggtaacgtaacgaaaccttaacgtttaacgtttaggttaaggttacggtttagttacgttcggtacgtaacggaacggacccggtacgggaccgtacgttacccgtaccctaaccctaaaccgttcccgttagtacgttaccgtttacggttttaccgggtttaccggttaaacgtccccggggtccccgggtttcccgggtaccccggttacgaaccggtacgggtttaccgtaagggtcggtcggtaacggtggtacgtaccggtacggacgtaacgtacgttacgtttaccaaccgtaggaagtaacggtagttaccgaaaggcgggtaaaggtaacggggtgggtaaccgggtcggtaaacgggttaggggttaacgggttttggggtttaacgggtttttaacgg

SEQ ID NO: 7697 - DNA, 674 bp, Homo sapiens
  misc_feature: GYAE6OF01ENTQN.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctgctcagctcctggggctgctaatgctctgggtctctggatgcaggtggggattattgtgatgctatcacgtccccactcctcccgtcgcccgtcaccccgtggacgacgcccggcctccactcctcctggactaggttcctagtccaaggaccgtcccttcgtgacctagtagggaaactggaacctaactaactttagttggtatttacggtatcgtacggactaacggaaacgccggaacgggtcctaacgttccctaacccgtaaacctaccgttaccgttagtaacttaccgtttacggtttaccgggtttaacctaacggttcccggggtccccgtttaccggggtcccctaagggtaccgttaacgggtttcgaaggttcgggcgttagggtacggtacttacggacgtctacgtaagttactttacacgttactaggaaagtcgtacaggactagggagtacgggaacggtctagggtaggttgttagggttttacggg

SEQ ID NO: 7698 - DNA, 673 bp, Homo sapiens
  misc_feature: GYAE6OF01CADA6.37.71.G05.1.454.CMB.1.raw
  modified_base (274)..(274): a, c, t, g, unknown or other
  misc_feature (274)..(274): n is a, c, g, or t
  modified_base (391)..(391): a, c, t, g, unknown or other
  misc_feature (391)..(391): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgcttgtttagaaggagtccactgtgaggtacagctggtggaatcgtgggggagcttgggtacagccgtggagggtccctgagactctcctgtgcatcgtctggtacttccaccttcgagttnttttacgacatgagtccgtcgggtcccgccgggtctccggaaggggtaagggtctagggagtcgggtctacgtatccaatccgtaagttaacaagttcgtaaccaaaccgtattaanaacctacgctaagtattttggaggaacgggtcctcttacaacctacttcctaccaagacgacgaaccgaccgaaagtacgtccttctctttggtttacctgtacctaattacgtacggaactacgtcccgtagggaaccgaacggccccgggaaacggtacccggtaccgggccttaaccttagttaacttaccggtggtacgacggaggtacggtcggggacggtccgggtagggtccgtgggtacgtacggtacgggttacctagttccgttaaacccgg

SEQ ID NO: 7699 - DNA, 679 bp, Homo sapiens
  misc_feature: GYAE6OF01COVF1.37.71.G05.1.454.CMB.1.raw
  modified_base (270)..(270): a, c, t, g, unknown or other
  misc_feature (270)..(270): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtgggctgctaatgctcgtgggtctctggatgcgaggtggggtattagttgtgtatgcagtcacgtcccactcctcccgtcgcccgtaccnccccgtggacgacgccggtccctccactccgtaccgtcgacgtacggtctacgtcgaacggcgtccctaccgtgacgtagtaggtaaaacgtcggaacctaacttaaacgttagttaggtacgtttaggtatcgtagacgtaagtaactccggaggcctacgtcctaccaactaaccgttccgtagtacttacgttcggtttaccggttaactacggttcccgggtacccgtttcccggggtccctaggtaaccggttacgttacggtacggtcggtaaccgtagggttacggacctacggacggaacctacgtacgttactttaccacgtaacgtaggaacgtacgtacgaagtcggaaaggtcggtaagcgggtactagggtaacgttggttttaggggtttaacgg

SEQ ID NO: 7700 - DNA, 595 bp, Homo sapiens
  misc_feature: GYAE6OF01EB2EU.37.71.G05.1.454.CMB.1.raw
  modified_base (226)..(226): a, c, t, g, unknown or other
  misc_feature (226)..(226): n is a, c, g, or t
  modified_base (544)..(544): a, c, t, g, unknown or other
  misc_feature (544)..(544): n is a, c, g, or t
tcagtagtgtagatcacgaccggtgctcgatttagtgtcgtcgcaagagagaggggatcaggctggaactgaggagcaggtgggggcacttctccctctaacactctcccctgttgaagctctttgtgatcaggactcctcagttcaccttctcacaatgaggctccctgctcagctcctggggctgctaatgctcgtgggtctctggatgcgagtgggatattgngatgcatcacgtccccactcctccctcgcccgtccacccgtggacgacgcccggcctccactcctcgtgcgtacggtctagtcagacgtccctctgacagtaggaaactggaacactaacgttagtggtatttggtaactcgtagacgaagaacggcgagggactacgtccaccgaactaacttctgtaacttcgttagtttccggttactaacgggtccgggtcccgttcccggggtcctaggtaccgtaggttcgaggtcggagtggtacgtactcggaacggctaacgtagttacttacgacgtataggaacgtntacggagacgaggtaggtagggtacgaggttaggaggttaggtttacgggg

SEQ ID NO: 7701 - DNA, 659 bp, Homo sapiens
  misc_feature: GYAE6OF01BW4NQ.37.71.G05.1.454.CMB.1.raw
  modified_base (305)..(305): a, c, t, g, unknown or other
  misc_feature (305)..(305): n is a, c, g, or t
tcagtagtgtagatcacgaccggtgctcgatttagtgtcgtcgcaagagagagggggtcaggctggaactgaggagcagggtgggggcacttctccctctaacactctcccctgttgaagctctttgtgatcaggactcctcagttcaccttctcacaatgaggctccctgctcagctccgtgggctgctaatgctcgtgggtctcgtggatgcgaggtggggattagttgtgatgctatcgacgtcccctactcctccctcggccctccacccgtggacgacgcccgtcctccgtactcctccngctacggtactagtcgacgacctccctcgtgactagtaaggtaaacgtcggaacctaacgttaacgtttagttagggtatttggtactcgtagacgagacgcgaggctacgtcctacctacacttcctagtacttacgttacggttcggttaacctaacgggtcccggtccggttacccgggtccctaggtacgttcggttacgaggtcggacgtaaggttggaccgtcggaacggtctaacggtacgttacgtacctaaacgacgtaaggaacgtacgacgtaggaacgtaacgggtaagggcgggaacggttacggttagggtagggtttaacggttttggggtttaaacgg

SEQ ID NO: 7702 - DNA, 643 bp, Homo sapiens
  misc_feature: GYAE6OF01DUXLC.37.71.G05.1.454.CMB.1.raw
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgcttgttttagaaggagtccactgtgaggtacagctggtggaatcgtgggggagcttggtacagcctgggagggtccctgagactctcctgtgcatcgtctggacttcaccttccgagtcttttgacatgagcgtcgggtcccgccgggctccgaggggtagggtctgggagtgggtctcatccatcagttacaagtgtacaaaccatactactacgctagtatttgaggaacgggtcctcttacacctactcctaccagacaaccaaccaaccaagacgtcctcttcgtttgtttcctagtactaagttagtcggaactacgtcccgtaggaacggaccggacccggaaccggaccggtccggtaccttacttaattaacgtttacgtggtacggacggaaggtacggtacggggaccgggtcgggttcgggtaccggttagggtaccggttaccggttccgggttacccgtaccgtttaccgttaaccg

SEQ ID NO: 7703 - DNA, 748 bp, Homo sapiens
  misc_feature: GYAE6OF01CZKJ6.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggcctcctgctcagctccgtgggctgctaagtgctcgtgggtctcgtggatgcgtaggtggggtaattagttggtgtatgctatcgtaccgtcccctactccttcccgtccggtccccgtaccgacccgtgggacgccggcccggccctcctactcctccgtcgacgtacggtctacgtacgacgaccgtccctcgtagactacgtaaggtaactacggaacctaaacgttaacgttaggttacgggtaagttcggttaacttcgtacgtaacgaaagaccggaccggaagggtacctaacggttaccctaaccgtaaccgtaacttccgaagttacttacgtttaaacgggtttccgggttaactaacgggtcccgggttaacccggttccgggtcccgaggtaccgttagggttcgacggttaggaccgtaagggttcggaaacttcccgggaagtacccaacggttaacgttaccctttaagaaccgtaaacggttagaaaccgtacggtaaccgacggtaacgtaagggacgggttaggaccggttagaacgggttagggtttagttcgggggtttttaagg

SEQ ID NO: 7704 - DNA, 777 bp, Homo sapiens
  misc_feature: GYAE6OF01EIIBR.37.71.G05.1.454.CMB.1.raw
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgngatgcatccagtccccactctccctgccccgtnacccctggacgagccggcctccactcgtcctgctaggtctaagtcacgacgcctacctgtcgaaagtaaggtaaacgtaacggtaaccgtaaacctaaacgtttaacgtttaggttaagtttacggttacgttacgtacggtaccgtaaacggtaaacggtaacccggtaacgggtaccggtaccgttacccgttaaccccgtaacccgtaacccgttacccgttacggttaacgtttaaccggtttaaccggtttaccggggtttaacccgggtttaacccgggttaccccgggggttacccccgggttacccccggggtttacccccgggttaccggtaaccggttaacgggtttaccggtacgggttacgggtacggtacggttacgggtacgtaccgtaacggtacgtaacgtaacgttaacgttaccgtaaccgtaacgtaacgtaacgtaacgtacgacgacggtaggtacgggtacgggtacgggtacggtacggtaagggttagggttagg

SEQ ID NO: 7705 - DNA, 911 bp, Homo sapiens
  misc_feature: GYAE6OF01CEORH.37.71.G05.1.454.CMB.1.raw
  modified_base (262)..(262): a, c, t, g, unknown or other
  misc_feature (262)..(262): n is a, c, g, or t
tcagtagtgtagatcacgaccggtgctcgatttagtgtcgtcgcaagagagagggggtcaggctggaactgaggagcaggtgggggcacttctccctctaacactcctcccctgttgaagctctttgtgatcaggactcctcagttcaccttctcacaatgaggcctccctactcagctccgtggggctgctaatgctcgtgggtcctcgtggatgacgagggtgggtattagttgtagatgctacttcgaccgttaccccnctccctcccgtccgtccccgtaccgacccggtaggaccggaccggtccccggtccctacctacctccgttccgtcgtcggtacggttcctacgtacgacggtaccgtccctccgtacgtaccgaaggttacggtaaacgttacggaacctaaaccgtttaacgtttaaggttacggttagttacggttacctacgttacgaacgaacggtaaccggaccggtacggtactaccggttaccctaacccgtaaccgtttacccgtacgttacgggttaaccttttaccgggtttaaccgggttttaaccgggtttaaccggttaaacccggggtttccccgggggtaccccccgggttttaccccggggtttacccgttacgggtaaacccggtttacggggtttaaccgaacgggggttcgttaacggggtaccggttaacggtacgtaccgggtaaaccgaccgtttaaacgtacggtttactttaacccggaacccgttacggtaaaacggtaacgttaaacccgcgggtttaaaacccgggaaagttacggggtaaccgggggttaagggaacccggggttgggtttaaaccggggagggttttttaaaccggggtttacggggttttttaaggggtttaaaacccg

SEQ ID NO: 7706 - DNA, 588 bp, Homo sapiens
  misc_feature: GYAE6OF01ATTUP.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggaggtcttggtacagccgtgggacgggtccctgagtactctcctgtgcatcgtctggacttcaccttccgagtcttttgacatgagctcggggtcccgccgggctccgaggggtaagggtcgtgggtaggtgggtctcgactccatcgtagttacaagtcggtacaaaccataactactacgacagttattttggtaggaacgggtcccgtcttaccacctactcctaccagacgaccaaccgccaaagcgctaccttctgtttcctgtactatagtcggactacgtctagacgacgccgacgaccgcgtctactattattcgtgtacgcgtagagtcgggacggtcgggtgggcgttgggactaccggtcggtccgtcgttaccg

SEQ ID NO: 7707 - DNA, 603 bp, Homo sapiens
  misc_feature: GYAE6OF01EXQQG.37.71.G05.1.454.CMB.1.raw
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctccgtggggctgctaatgctcgtgggtctcgtggatgcgaggtggggattagttgtgatgcatcacgtccccactcctccctcgcccgtccacccgtggacgcgcccggcctccatcctcgtgcgacggttctagtcacgcncccttcngcagtagaatcgactactaattgtagtattgtatctgacaagacgcgaggctacgtacctaccaactaccttctagtactttaccgttacggtttacggttactaacggttcccgggtccccggttcccggggtcccttaggacgttacggttacgagggttcggacgtaggtggaactcggagtccagtattacttccaagttagtacggaaatcgtacgagtaggaaggtgggtaggacgtcgtagggtaaggttcggtttgggtttaggtttaac

SEQ ID NO: 7708 - DNA, 784 bp, Homo sapiens
  misc_feature: GYAE6OF01CP6OK.37.71.G05.1.454.CMB.1.raw
  modified_base (538)..(538): a, c, t, g, unknown or other
  misc_feature (538)..(538): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgcttgttttagaaggagtccactgtgaggtacagcgtggtaggaatcggtgggggagtcgttaggtacgacgccgtgggacggtcccgtagacgtaccttctccgtggtcgctacgttccggtacgttggtacctttcctaacccgtttccggtaagtttccgtttttagaacctagttcgacggtccggttcggggtccccggccgggtcgttacccgggaagggggtaacggttcgtaggggtacggttcgggtcctacgtactacccaagttacgtaacgtttaaccgaagttaccggtaacaaaacccttaattaaccttaaccgtaccggagtaacgtttaacgttttggacggtaacgggtccctacttacccacgtacnccgtaccgaagaccgaacgaaccgaccgaagacgtaccttcttacgtttcgtttctaggtacctaagtacgtacggtaactacggtacctagggaacgaccggaccggaaccgtccggaccgttactaccgtttaagtaacgtttcgtacggtacggacggtaggtacggtacgggtacgggtcgggttaacggtcggtacgggtacgtaaccggttccgggtaacgtcccgttacgttaaacccg

SEQ ID NO: 7709 - DNA, 613 bp, Homo sapiens
  misc_feature: GYAE6OF01D79CW.37.71.G05.1.454.CMB.1.raw
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttcctgttgcttgttttagaaggagtccactgtgaggtacagctggtggaatcgtgggggagcttggtacagcctggaggtccctgagactctcctgtgcatcgtctggattccaccttcgatcttttgacatgagtcgtgggtcccgccgggctccgaggggtaacggtcgtggaggtgggtctcactcccgatcgtagttacaagtcggtacaaaccattaactactacgactagtattttggagaacgggcctcttacacctatcctacgagacgaacgaacgtaccaagacgtcttcctcgttgtttctnacgtaatgtacggacngtccgtagagaccggcccgaacggaccgccggtctaccgttattacttaccgtggacgcggtaggtacggtacggggaccgggtcgggtcgggtcgttacgggtacggacccgtttcgggtaccgtacccgtttaaccgg

SEQ ID NO: 7710 - DNA, 269 bp, Homo sapiens
  misc_feature: GYAE6OF01E0GNN.37.71.G05.1.454.CMB.1.raw
  modified_base (265)..(269): a, c, t, g, unknown or other
  misc_feature (265)..(269): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaaacgaactgtggctgcaccatctgtcttcatccttcccgccatctgaatctacactactgagcgggctggcaaggcgcatagnnnnn

SEQ ID NO: 7711 - DNA, 589 bp, Homo sapiens
  misc_feature: GYAE6OF01BAUKW.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctcgtgggtctcgtggatgcgaggtggggattagttgtgatgcatccacgtccccactcctccctcgccccgtccaccccgtggacgcgcccggcctccactcctcctgcctaggtctagtcagcgccctctgcagtaggaaatcggaactactaacgttagtggtattggtatctgacagaacgcgaggctacgtcctaccaactaactccgtagtacttcgttacgtttccgggttactaaccggtcccgggtcccgttcccggggtaccctaggtaccgtacggttcgaggtcggacgtaggtgactcgacgcaagtagtacttcacgtacgtagaacgctcgaggacagggtaggagggacgtcgtagggacggttggtttgggtttaaggg

SEQ ID NO: 7712 - DNA, 632 bp, Homo sapiens
  misc_feature: GYAE6OF01EA0RT.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgagctcctgctcagctccgtgggctgctaatgctcgtgggtctcgtggatgcgaggtggggtattagttgtgatgcatccaccgtccccacttccctccccgtcgtccccgtccaccccgtggacgccggcccgcctccacttcctccgtgcgtacggttctagtacgagaccgtccctctgactagtaggaaacgtcgaactaacgtaactttagtggtagttagtatcgtagacgaagacgcggaggtctacgtcctaccaactaacctcgtagtacttcttacggttcggtactaccggtcccgggtccgttcccgggtcctagtacgtaggttcacggtgcgtaggtacgtacgtcggacgtacaagtacgttacgttacaacgtacgtagaacgtcgtacgaaggtagaaggtagggacgggtacggtacggtagggtacgggtttaggtttggggtttttaacggg

SEQ ID NO: 7713 - DNA, 575 bp, Homo sapiens
  misc_feature: GYAE6OF01BWNSE.37.71.G05.1.454.CMB.1.raw
  modified_base (522)..(522): a, c, t, g, unknown or other
  misc_feature (522)..(522): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactcctccctgccccgtccaccccgtggacgacgcccggcctccatcctcctgcaggtctagtcagacgcctcctgcagtggaaatggacaactaactttagtggattggtatcgtgcagaagccgagggcacgtcctccaactaaccttcctagtacttcgttagtttcgggttactaacgtcccggggtacccgttcccggggtccctaggaccgtagggtttcagggttcggacgtaggtggactcgaggctacgagttacttcgacctagtagaagtntacgagcgaaggtaggtgggacgtcgtaggaggttagttggggttttaacggg

SEQ ID NO: 7714 - DNA, 639 bp, Homo sapiens
  misc_feature: GYAE6OF01DN7GQ.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggctccctgctcagctccgtgggctgctaatgctcgtgggtctctggatgcaggtgggatattgtgatgcatcacgtccccactcctccctcgcccgtccaccccgtggacgacgccccggcctccacttcctccgtgcgacggtctagtacagcgccctcctgacagtaggaaatggaacactaacgttagttaggtatttaggtattcgtagaccaggaacgtccgagggctacgtcctaccaacctaactccgtagtattcgttagttcggtttacgtaacggttcccgggtccgttcccgggtcctacgtacggttacggttcgaggtcgacggtaggtacggtactacgaggaactacgtacgttacttaccggtaaactacgacggtaaagtacgtaacgacggtaacggaagggtagggtagggtacgggacgtttagggaagggtttcggtttggggtttttaacgggg

SEQ ID NO: 7715 - DNA, 643 bp, Homo sapiens
  misc_feature: GYAE6OF01AQIHD.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgccccgtcacccccgtggacgacgccggcctccgactcctcctgctacggtctagtcacgcgtccctcctgccatagggaaatggaaccactaactttagttggagtttggtatcgtgacgagaacgtccgagggaccaggtccctaccactaactcctagacttcttacgttcgggttactaacggtccgggacccgttcccggggtccctacggtacgtacgggttcgacgggtcggacgtacgggttcggaacgttcgacgggtactaaccgtaacggttactttacgaaccgtaccgtaaggaaacggtacttaccgaggtaccaagggtacgggtacggggtaacggtccggttagggaaaccgggttggtttaggggttttaacgggg

SEQ ID NO: 7716 - DNA, 623 bp, Homo sapiens
  misc_feature: GYAE6OF01BEQIS.37.71.G05.1.454.CMB.1.raw
  modified_base (306)..(306): a, c, t, g, unknown or other
  misc_feature (306)..(306): n is a, c, g, or t
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctgctcagctccgtggggctgctaatgctctgggtctctggatgcaggtgggatattgtgatgcatcacgtccccactctccctgccccgtcaccccgtggagacgccggcctccactctcctgctaggtctagtcagcncctcctgcagtaggaatggaacaactaattagtggtagttggtatctagcgtaaggaacgccggagggctacgtccttaccaactaactcctagtacttacttagtttaccgggttactaaggttcccggggtacccgtttcccggggttcccttacggaccttacggggttacctagggttacgggcgtaacgggttggaaccgttcgaacgggtcaacgtaggttactttacgaaccgtacgtaggaaacgtactacgacgacgaaggtaggtcgggtaaggcgtagggaagggttgttggggtttttaacgggg

SEQ ID NO: 7717 - DNA, 676 bp, Homo sapiens
  misc_feature: GYAE6OF01B68UP.37.71.G05.1.454.CMB.1.raw
  modified_base (231)..(231): a, c, t, g, unknown or other
  misc_feature (231)..(231): n is a, c, g, or t
tcagtagtgtagatcacgaccggtgctcgatttagtgtcgtcgcaagagagagggggtcaggctggaactgaggagcagggtgggggcacttctccctctaacactctccctgttgaagctctttgtgatcaggactcctcagttcaccttctcacaatgaggctccctgctcagctccgtggggctgctaatgctcgtggtctcgtggatgcagggtgggtattagttgngagtgcatcaccgtcccactcctccctcgccccgtccacccgtggacgcgcccgctccatctcctgcgaggtctagcagcgcctcgtgcgtacgtagaacgtcggaactacttaattcgttaggtattggtactcgagacgtaaggacgtacggaggtctacgtacctaccgaactaccgtaccgtagtacttcttaacggtttcggttacgttaacggtcccgggtaccgttccgggtcctacggtacgtcggttcgaggtacggtacgaggtcggtacgtacgacgggtaccacggttacgttaacgttacccgtaactaccggtaaagtacgtaacggtacggaacggtaggtaaaccggggttaacgggtacgggggtaaccggtagggttaaagggggttacgggtttaacggggttttagggggttttttaaccggggg

SEQ ID NO: 7718 - DNA, 811 bp, Homo sapiens
  misc_feature: GYAE6OF01D1KPE.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttgggggctgttctggtattttccttgttgcttgttttagaaggagtccactgtgaggtacagctgggtgaatcggtgggggagcgttggtacaggccgtgggacgggtccctgagtcttctctgtgctagtcgtctggacttccaccgttccgagttctttgactgtgacgtcgtcgggtcccgacgggtcctaccggaggggtacggttcgtggacggttcgggtctcgacttcccgataccgtaagttacaagttcggtaacctaaaacctataactaccgtacgactaagttatttagacgggtaaccgggtccctacttaccaacccttagtaccgtaccgaacgtaaccggaaccaacccggaccgtaaagggtacctcctttaccgttacgtttacggtttccgtacggtaccttaaacgttcggtaacggaaccgtaccggtacccgttagggaaaccggttacccgggaaccccggtaaccgggacccggggtacgttacctttaaccgttaaacgtttaccggtttaccgggttaggtacccgggtaacggttaaaaccggggtcggttaaccgggggggtaacccggggttccgggggttacgggttccggggtttacgggtaccgggttaaccccggtttcggggttaaacccgtacccgtttttaaacccggg

SEQ ID NO: 7719 - DNA, 812 bp, Homo sapiens
  misc_feature: GYAE6OF01BN4KR.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatgcgaggtggggattagttgtgatgcatcacgtccccacttccctcccgtcgccccgtccacccccgtgggacgaccggcccggtccctccgtacttcctccgtcggaccgtacgggttcctacggttcaacggtaccgccccttccgtacgactaagtaagggtaaacgtacggaacctaaaccttaaacgtttaggttagggttaacgtttaggtacttcgtacggtacgaacgggtaaaccggccggaaggggtcctaaccggtttaccctaacccaaccgttaaacccttccgttacgttaaccgtttacgtttaaccgggtttttacccggggtttaacccgtttaaccgggttccccggggggttacccccggtttccccggggggttcccccttacgggtaaccggtttacgggtttaccgtaacggggttcgggaacgttacggggttacggaccgttaccggacggttaacctacggtaacgttactttaccgaacgtacgtaacggaagtactacggaacggtcgaaagggtgggtacgggtaacgggtacgttaaggggaggttttaggggtttggggtttttaaacgggg

SEQ ID NO: 7720 - DNA, 661 bp, Homo sapiens
  misc_feature: GYAE6OF01EYTWN.37.71.G05.1.454.CMB.1.raw
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggattattgtgatgctatcacgtcccccactcctcccctcgccccgtccaccccgtggacgcgcccggccctccatcctccngccaggtctagtcagacgccctcngacagtaggaaagtcggaccaactaaactttagtggatttggtaatccgtagctaaacgaacgccgacgggctacgtcctacccgaactaaccttcccgtagtaccttcgtttaacggtttccgggttactaaccgggttccccggggtacccggtttccccgggggtcccctaggtaccgtacggtttccgtacgggtcggaactagggtacggacttacggaacggacaaccggtaagttatttaccacgttaacgtagaaacgtcgtacgaaggcgaagggtaagggtcgggtaacgggtcgtaaagggtagggttagttgggggttttaacggg

SEQ ID NO: 7721 - DNA, 597 bp, Homo sapiens
  misc_feature: GYAE6OF01BSUW8.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatgcaggtggggattattgtgatgcatcacgtccccacttcctccctcgccccgtccaccccgtggacgacgcccggcctccactcctcctgccgaggtctagtcgacgcgtccctcgtgacagtaggaaagtcggaacaactaacttagttggattggtatctgacagaacgcgaggcacgtcaccaatacctctatactcgttacgtttcggttactacggtccgggtcccgttcccgggtctgacgttggttacgaggtcggactggtacggactacgacgtactacgtacgttacttaccgactacgtagaacggacttacggacggtcgaagggtaggacggggagtacgtaggggtaggtttaggtttcgggttttaagggg

SEQ ID NO: 7722 - DNA, 711 bp, Homo sapiens
  misc_feature: GYAE6OF01C5RBY.37.71.G05.1.454.CMB.1.raw
  modified_base (298)..(298): a, c, t, g, unknown or other
  misc_feature (298)..(298): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcactttctcacaatgaggctccctgctcagctccgtggggctgctaatgctctgggtctctggatgcaggtgggatattgtgatgcagtcacgtcccactcctccctcgcccgtccaccccgtggagacgcccggcctccactcctcctgcgnggtctagtcgacgacgcctcgtcgactacgtaggaacgtggaacctactaacgtttagttaggtattggttatcgtagacgaggaacgccgagggcctacggtcctaccctaaccgtaaccttccgtacgtacgtttacgttacggtttaccgggttactaaccgggtcccggggtccccggttaccccgggggttccctagggtaccggtttacgggttaccgaagggttcggggtacctaggggttacggtaacttccgggaacgggtacctaaccgtagtttaaaccgtttacccgtaaactaacgggtaaggtaacgtaacgtaacggaacggtaggaacgggtagggtacggggtagggtaaccgttaggggtaaaggggttaggtttttgggggtttttaaacgggg

SEQ ID NO: 7723 - DNA, 697 bp, Homo sapiens
  misc_feature: GYAE6OF01CQDHF.37.71.G05.1.454.CMB.1.raw
  modified_base (339)..(339): a, c, t, g, unknown or other
  misc_feature (339)..(339): n is a, c, g, or t
tcagtagtgtagatcacgaccggtgctcgatttagtgtcgtcgcaagagagagggggtcaggctggaactgaggagcaggtgggggcacttctccctctaacactcctcccctgttgaagcttctttgtgatcaggactcctcagttcaccttctcacaatgaggctccctactcagcctccgtggggctgctaatgctcgtgggtctcgtggatgcgtaggtgggattagttgtgatgactatcgaccgtccccactcctcccctcgccccgtacacccgtggacgccgcccgcctccatccgtctcgcgtacggtctacgtcgacgtacctccgtcngtacagtaggtaaacgtcgaactaaccttagtttagtaggtacgttaggtactcgagacgaacgtacgcggaggtactacgtacctaccaacctacctcgtattacttacggttacggtttacggttaaccgtaccggtccccgggttccccgggttacccgggtcccttaggaaccgtttacggtacggtcgttccgggattacgggacgtacgcggtaaccgtacaacgtacgttacctaacctaacgtaggttacgaactacggtaaccgaggtaaccggtaagggtacgggtggaaacgggttcggtaacggggtagggtttttaaggttacgggggtttttaagttttaacgg

SEQ ID NO: 7724 - DNA, 931 bp, Homo sapiens
  misc_feature: GYAE6OF01ARVXG.37.71.G05.1.454.CMB.1.raw
tcagtagtgtagatcacgaccggtgctcgatttagtgtcgtcgcaagagagagggggtcaggctggaactgaggagcagggtgggggcacttctccctctaacactctcccctgttgaagctctttgtgatcaggactcctcagttcaccttctcacaatgaggctccctgctcagctccgtggggctgctaatgctcgtgggtctcgtggatgcgagggtggggtattagttgtgagtgctactccgaccgttcccccacttcccttccccgtccggtcccccgtacccgacccccggtgggaccggaccggccccggtccctccctactcccgttccgtacggccgttacggtcctacggtccgaacggtccgtccccgtacgtcggaccgtaagtagggtaaaacgtccggtaacctaaaccttaaacgtttaggttagggttaattttacgggtactttacgtacggaacgtaaaccgggaaccggtaccggtaacggggtacttaaccgttacccccgtaaccctaacccgtaaccccgttacccgttaagttaaccgttttacccggtttttaaaccggggtttttacccggggtttaaacccgtttaacccggggttccccgggggtttacccccggttttacccccggggtttccccggttaacgggttaccccggtttaacggggtttacggtaccggggttacggtaacggttacgggttacggtaacgttaccggggtaaccgtacccgttaacggttaacgtttaaccgtttaaccggtaaccgttaaccggtaaggtaaaccggttacgttaacccggaacgggtaaacgggtagggttacggggttaacggggtaacgggtttacggaagggggtttaacgggttttgggggtttttaaggggtttttaacccgggg

SEQ ID NO: 7725 - DNA, 880 bp, Homo sapiens
  misc_feature: GYAE6OF01ELGE0.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctgctcagctcctgggctgctaatgctctgggtctctggatgcaggtggggattagttgtgatgcatcacgtccccacttcctccctcgcccgtccaccccgtggacgacggccccggtccctcccacttccctcccgtggccgtacgggttccttacggtaccgtaacggacccgtcccttcccgtggacctaaggttacgggaaaacgtttacgggaaacctaaaccgttaaaaccgttttaggtttaggggtaacgttttacggggttaacttcgttacggactaaaacggggaaaccggtaccccggaagggggtacctaacgggtttacccttaccccgaaacccgtaaacccgtttccccgttaggttaaccttttacccggttttaaacggggttttaccccggggttttaaccgtttaaacccggggtttccccggggggttaccccccgggttttacccccgggggggttaccccctttacggggtaacccggtttaacggggttttaccggaacggggtttcggggaaccgtaggggttaacgggaccgttaccggaacgggtacccaacggttacggttaccttttaaccgaaccgttaaccgtaaggaaacggttacgaacggtaaggacggtaaacgggtagggttacgggggaacgggtacgtaaggggaagggtttgggtttaggggtttttacggggg

SEQ ID NO: 7726 - DNA, 655 bp, Homo sapiens
  misc_feature: GYAE6OF01C97EL.37.71.G05.1.454.CMB.1.raw
  modified_base (231)..(231): a, c, t, g, unknown or other
  misc_feature (231)..(231): n is a, c, g, or t
  modified_base (341)..(341): a, c, t, g, unknown or other
  misc_feature (341)..(341): n is a, c, g, or t
  modified_base (417)..(417): a, c, t, g, unknown or other
  misc_feature (417)..(417): n is a, c, g, or t
  modified_base (566)..(566): a, c, t, g, unknown or other
  misc_feature (566)..(566): n is a, c, g, or t
  modified_base (609)..(609): a, c, t, g, unknown or other
  misc_feature (609)..(609): n is a, c, g, or t
  modified_base (618)..(618): a, c, t, g, unknown or other
  misc_feature (618)..(618): n is a, c, g, or t
tcagtagtgtagatcacgaccggtgctcgatttagtgtcgtcgcaagagagagggggtcaggctggaactgaggagcagggtgggggcacgttctccctctaacactcctcccctgttgaagcttctttgtgatcaggactcctcagttccaccttctcaactaatggacggcctccctgcctcgagcctccgtggggctgactaatgcctcggtgggtctcgtggatcgngtagggtggggtattagttggtggtatcgctacgtcctacccgtccccctacttcccgtcccctcgccccgtccaccccgtgggacgccgcccgtacctccattccctcngacgtaggtctagtcaagcctccctctgcagtaaggaactcgactaactaagtttgtacggtattaggtacttcgngacgtaaggaacgcggacggactacgtccaacccgtaactacccgttcgtagttacttacgttacggttaccgggttaccttacggcccgggtccgggttcccgggacctaggtacgtacggttcgagttgggactagggtaggtaccncggtacgacacggttatacttcccgaatcgtaggaatcgacgnggtcagggngacgggtacgtaggtaggagtttgggttgggtttaac

SEQ ID NO: 7727 - DNA, 558 bp, Homo sapiens
  misc_feature: GYAE6OF01C6886.37.71.G05.1.454.CMB.1.raw
  modified_base (323)..(323): a, c, t, g, unknown or other
  misc_feature (323)..(323): n is a, c, g, or t
  modified_base (390)..(390): a, c, t, g, unknown or other
  misc_feature (390)..(390): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (512)..(512): a, c, t, g, unknown or other
  misc_feature (512)..(512): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgcttgttttagaaggagtccactgtgaggtacagctggtggaatcgtgggggagcttggtacagcctgggagggtccctgagactctcctgtgcatcgtctgattcaccttcgagtctttgacatgagctgggtccggccggctccgaggggaaggtcgtggagtgggtcncatccatcaagttcaatgtacaaaccatatactacgctagtattttggagaacggccgtcttcactntctcagacacaacgcaagnactctctgtttcngctatagtcgtacncgcctgaacgacggacccgacgaccgcggccttacttagtactttacgtggtcggtacgagtacgtagggccgggngggtcgcggttggtcggacgttcggtaccgcgtttccgttaaaccg

SEQ ID NO: 7728 - DNA, 779 bp, Homo sapiens
  misc_feature: GYAE6OF01B4BER.37.71.G05.1.454.CMB.1.raw
  modified_base (233)..(233): a, c, t, g, unknown or other
  misc_feature (233)..(233): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgcttgtttagaaggagtccactgtgaggtacagctggtggaatcggtgggggagtcgttggacagcctgggacgggtcccnggaacgtctcctcctggtcgctacgtcggtctggtacttccaccttcgagtctttagactatgagcggtcgggcccgcggtccaccggaaggggtaggtccgtaggtacggtcggtcctacactacacgtacgtaacgttaacaagtcgtaaaccaaacgtataacgtaaccgtacgactaagttagttttacggaacggtaaccgggtcccttacgtaccgtaaccctaacgttcccgtaaccgaacggtaaaccggtaaaccgaaacccggaccgtaaacggtaccggttaccttacccgttacgtttacggtttttacccgacggtaaccgttaaacgttacgttaacgggaacctaaccggttaccggtacggaaacgggtaccccggaaacccggggtaccgaacccggtccggtaacctttacgttaaacgttacgttaacgtggtacggtaaccggtaggtacggcggggtaaccgggttcgggtacggtcggttacgggttaccgtaccggttccgggttaccgtacgtttaaacccg

SEQ ID NO: 7729 - DNA, 900 bp, Homo sapiens
  misc_feature: GYAE6OF01B209B.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggtctccctgctcagctccgtgggctgctaagtgctcgtgggtctcgtggatggcgaggtgggattattgtgatgctagtcacgtccccactcctccctcgcccgtcacccgtgacgacgccgcctccacgtcctccgtcgaccgtggtcgtacggtcaggacgtccctcgtacgctaacgtaggaaacgtcggaacctaacgttaaacgttagtttacggtaagtttacgggttaattaccgtaggaacccgtaaaggtaaccggtaacccggtaacggggtacccttaaccggttaccccttaaccccgaaacccgtttaaaaccccttccggttaacggtaaccgtttacccggttttaacggttttacccggggtttaaaccgttaaaccccggggtttccccgggggttacccccgggtttaccccgggggtttacccccgtttaagggtaaccccggttttacggggtttacccgtaacgggggttttcggggaaccttaaccgggggtttacggtaacccggttacccgggaaacgggtaacccctaaggttaaaccggtttaacccgttttaaccgaaaccgtttaaaccggttacggaaaaacggttaccgtaaccgggacggttccgggaaaaggggttcccgggggtaaggggtaaaacccgggttacgggtttaaggggggtaaacgggtttttaacgggttttcggggggtttttaaaaccggggg

SEQ ID NO: 7730 - DNA, 649 bp, Homo sapiens
  misc_feature: GYAE6OF01A6HF3.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcagtccccactctccctgcccgtcacccctggacgagcccggcctccactcctcctgcaggtctagtcagagcctcctgccagtaggaaatggaccaactaacttagttgggatttgggtacttctggcagaaacgccgaagggccacggttcctacccgaacctaaaccgttcccttaggtacttacgtttaacgtttccggggtttacttaaacggtcccggggtacccgttcccgggggttcccctagggtacccgtaagggtttccgaacgggttgggaccgtaacgggttcgggtaacttccggaacgggacctaacgtacggtactttaccgaacgtacgtagtaacgtacgtacaaggtcgaaggtaggtagggacggtcgtagggaggtagggttgggttttacgggg

SEQ ID NO: 7731 - DNA, 596 bp, Homo sapiens
  misc_feature: GYAE6OF01BEDCM.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctcgtggatgcgaggtggggattattgtgatgcatcacgtccccactcctcccgtcgccccgtccaccccgtggacgacgcccggcctccactcctcctgcaggtctagtcagacgcctcctgacagtaggaaatcggaacaactaacttagttggtattggtatcgtgacaagaacgccgaggcacgtccaccaactaacctcgtagtacttcgttacgttcgggtactacggtcccgggtccgtcccgggtcctagacgtaggttcaggtcggacgtaggtggactcgacgtacacgtagttacttacgaactagtaggaagtacgtagaacgtcgaagggtaggttcggggaagtacgtaagggtaggttagtttggggttttaacgggg

SEQ ID NO: 7732 - DNA, 812 bp, Homo sapiens
  misc_feature: GYAE6OF01DJCD8.37.71.G05.1.454.CMB.1.raw
  modified_base (707)..(707): a, c, t, g, unknown or other
  misc_feature (707)..(707): n is a, c, g, or t
  modified_base (731)..(731): a, c, t, g, unknown or other
  misc_feature (731)..(731): n is a, c, g, or t
  modified_base (750)..(750): a, c, t, g, unknown or other
  misc_feature (750)..(750): n is a, c, g, or t
tcagtagtgtagatcacgaccggtgctcgatttagtgtcgtcgcaagagagagggggtcaggctggaactgaggagcaggtgggggcacttctcctctaacactcctccctgttgaagtcttctttgtgatcgaggtactcctcagttcctaccttctacaacaagtggacggtcctccctgcctcgacgtccttccggtggggctgtactaatcgtccttcggtcgggtctcgtaggtatcggacgtagggtgggtattagttgtgtactcgacgtactccgtaccgtacccctaccttcccgttcccgtccgtccccgtacccgtacccggtagggaccgacccggtccccgtacctacctaccgttcccgttccgacggtaccgtacggttaccgtaacgtaccgtaacggtccgttcccgttacgtacggtaacgtaacggtaaacggtaaacgtaacggtaacctaaacgtttaaagtttaggttaggttaacgttacggttactacggtacgtaacgaacggtacgtaccggtacgggtacctaaccgttaccctaaccgtaactaccgttcgtatacgtttaccggtttacggtttaccggtacgtaaccgggtccccggggtacccgttccgggtacccgtaggttaccggttacggtacggtacgggtcgaaccgtaggtacgtacgtacgtaaccgntaaacgttctaaccgtcgtaacgngtaataacggtataccggngtaacggtaagggtcggtaacggacgttaaggtaggttaaggtttcgggttggggttttaac

SEQ ID NO: 7733 - DNA, 720 bp, Homo sapiens
  misc_feature: GYAE6OF01BZ7DQ.37.71.G05.1.454.CMB.1.raw
  modified_base (237)..(237): a, c, t, g, unknown or other
  misc_feature (237)..(237): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatgctaggtggggtattagttgtgatgnatcacgtcccactcctccctcgccccgtcaccccgtaggacgaccggcccggtccctaccacgtcctccgtcgaccgtaggttcctagtcgaacgccgtccctccgtgacgtagtacggaagtcggaactaactaacgtttacgttggtaagttggttaactcggtagacgaaggacgtccggtagggactacgtcccgttaaccaaccgtaacctcgttagacttacgttacggttccgggtacttaaccgggtccgggtaccccggttcccggggtccttacggtaccggtaggtttacgacgggttacggacgtaaggttacggaacgttccggaacggaccgttaacggtacgtttaaccgttaccgtaaaacgtacgtaaacggtaaaccgtacgttaacggaacggtacggaagggtaaggttcgggtaaggtaccggtaaggggttaacggttgggtttagggtttttaaccgggg

SEQ ID NO: 7734 - DNA, 698 bp, Homo sapiens
  misc_feature: GYAE6OF01BZN5K.37.71.G05.1.454.CMB.1.raw
  modified_base (323)..(323): a, c, t, g, unknown or other
  misc_feature (323)..(323): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctcgtgggtctcgtggatgcagtggggatattgtgatgcatcacgtccccactcctccctgccccgtccaacccctggagacgcccggccttccatcctcctgcgtaggtctagtcaagcgccctccgtnacctagtaggaaatggaaccaactaaactttagttagggtaatttggtaatcgttgacgtaaagaacgccgaagggctaagtcccgtacccaacctaacctaccgtagtaacttcgttaaaaaagtttccgggtttaaccgtaaacgtcccgggtcccgtcccggggttcccgtacggtacgtaacggttcgtaaggttcgggaacgtaggtacggtacgtaccgaacgggaccgaacgtacggtaactttaccgaaccgttaacccgtaagggtaaacgtaacgtaacgaacggtacgtaacgggtaagggtacggggtaacgggtacggttacgggtaaacgggttaagggtttaggggtttttaaacggggg

SEQ ID NO: 7735 - DNA, 278 bp, Homo sapiens
  misc_feature: GYAE6OF01CUWMM.37.71.G05.1.454.CMB.1.raw
  modified_base (178)..(178): a, c, t, g, unknown or other
  misc_feature (178)..(178): n is a, c, g, or t
  modified_base (271)..(278): a, c, t, g, unknown or other
  misc_feature (271)..(278): n is a, c, g, or t
tcagtagtgtagatcacgaccggtgctcgatttagtgtcgtcgcaagagagaggggatcaggcacagatttcacactgaagatcagcagagtggaggctgaggatgttgggttatactgcatgcaaggtctaacaaactcctcggatccaccttcggaccaagggacacgactggaanaattaaacgaactgtggctgcaccatctgtcttcagtccttcccgcatctgaaatctaacactactgagcgggctggcaaggcgtcaatagcnnnnnnnn

SEQ ID NO: 7736 - DNA, 652 bp, Homo sapiens
  misc_feature: GYAE6OF01AWS7H.37.71.G05.1.454.CMB.1.raw
tcagtagtgtagatcacgaccggtgctcgatttagtgtcgtcgcaagagagagggggtcaggctggaactgaggagcagggtgggggcacttctccctctaacactcctcccctgttgaagcttctttgtgatcaggactcctcagttcaccttctcacaatgaggcctccctgctcagcctccgtggggctgctaatgctcgtgggtctctggatgcgagggtggggattagttggtgatgcatccacgttcccccactcctcccctcgccccgtccaccccgtggacgacgcccgcctcatcctcctgcgtaggtctagtcgagcgcctctgactagtaggaaactcggaacctaacttaatttagttaggtagtttaggtacttcgtgacgtaagaacggccgagggctacggtcctacccaactacctccgtagtacttccgtttaagttccgggttacttaacggtcccggggtcccgttcccggggtacctggaaccgtgggttaccagggttcgcctagggtcgacgttcgacggtaccacgtacgttacttaccaacttacgtacggaaagtcaaccgaggtaccggaaggtacgggacgggtaaggtcggttaaggagggttaggtttggggttttaacgggg

SEQ ID NO: 7737 - DNA, 297 bp, Homo sapiens
  misc_feature: GYAE6OF01CRMO7.37.71.G05.1.454.CMB.1.raw
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (292)..(297): a, c, t, g, unknown or other
  misc_feature (292)..(297): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttggggtttattactgcatgcaaggtctaacaaactcctcggatcaccttcggccaagggacacgactggagaattaaaacgaactgtggctgcaccatctgtcttcatccttccgcatctgaatctacactactgagcggntggcaaggcnanagnnnnnn

SEQ ID NO: 7738 - DNA, 797 bp, Homo sapiens
  misc_feature: GYAE6OF01CTE4Q.37.71.G05.1.454.CMB.1.raw
tcagtagtgtagatcacgaccggtgctcgatttagtgtcgtcgcaagagagaggggccttagccctggattccaaggcatttccacttggtgatcagcactgaacacaaaggactcacatggagttgggctgttctggtattttccttgttgcttgttttagaaggtagtccactgtgaggtacagctggtgaatcgtgggggagtcttggtacaggccgtagggacggtccctggagtacctcgtcctagtcgactacgttcgtctggtaacttcctaccgttacgacgttcttttagaactagtgacggtccgtcggggtacccgtccgggcttaccggaagggggtaacggttcgtgggtacggttcggtacctacgtaactccgtaataccgtaagttaacctaagtacggtaacctaaaaccgtataactaacgtacgacgttaacgtagttttacggacggtaaccgggtcccgttacttaccaaccgttactacccgtaacgaacggaccgtaaaccgaacccgaaccgaaacggtacgtaccctttacgttaccgttttagtttaccgtacgtacgtaacgttacggtaacgtaacgtaccgtaccggtacggaaccgggtaaccggacccggaaacccgggtcggacccgttacttacgttaacgttaacgttacgtaggtaccgaggtaacggttcggtacggggaccggttgggggttacggtaccggttagggtaccggttaccgggttaccggtaccccgttaccggttacgttaaaccccggg

SEQ ID NO: 7739 - DNA, 672 bp, Homo sapiens
  misc_feature: GYAE6OF01AV0D5.37.71.G05.1.454.CMB.1.raw
  modified_base (627)..(627): a, c, t, g, unknown or other
  misc_feature (627)..(627): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctcgtggatgcgaggtggggattagttgtgatgcatccacgtccccactcctccctcgccccgtccaccccgtgggacgaccggcccggcctccatcccttccgtgcgtacggtcctagtccgagacctcctccgtgctagtaaggaagtacgaacaactaacgtttagttaggtattaggtacttcgtgacgaaggaacgaccggaggaccacgttacctacccgaacctaaccgttccgtagtaacttacgtttacgtttcgggtttaccgtaacggttccccggggtccccggttcccggggtacccttagggtaacggttacggttcggaaggttcggacgtacgggttcggacgtacgacgggacctaacgaacgttactttaccgaacgttacgaagtaacgtacgacgaggaaccgnggtaagtcgggaacgtgtagggtagttagggtttgggtttacggg

SEQ ID NO: 7740 - DNA, 746 bp, Homo sapiens
  misc_feature: GYAE6OF01CV8Q0.37.71.G05.1.454.CMB.1.raw
tcagtagtgtagatcacgaccggtgctcgatttagtgtcgtcgcaagagagagggggtcaggctggaactgagggagcagggtgggggcacttctccctctaacactcctcccctgttgaagcttctttgtgatcaggactcctcagttcaccttctcacaatgaggctccctgctcagctccgtgggctgctaatgtctgtgggtctcgtggatgcgtaggtggggtaattagttgtgtatgcatcacgtccccactcctccctcgcccgtccacccgtggacgtacgcccgtcctaccactcctccgtacgcgtacggtctacgtacgacgacgtccctcctgacagtaacggaactcggaacctagttaattacggttaggtagtttcggtaactcgtacgaagtacggaacgtccgggtaacggtaccgtaccgtacctaacccaacgttaacccgttcttacggtaacttccgttttaaaccggtttacgggttaaccgttaaccggttccccggggggttcccgttaccccggggggttccctaacgggaccggttaacgggtttaaccggacgggttaacgggtaaccgtagggttaccggacggttaacgaccgggtacaacggttagttacccttaacgaaacctgggtaactaacggacttacggaagggtacgaacggtaagggacgggtcggtacggttaggtaaaggttgggtttaaggggtttttaaccggg

SEQ ID NO: 7741 - DNA, 597 bp, Homo sapiens
  misc_feature: GYAE6OF01EHU3E.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctctgggtctctggatgcaggtggggatagttgtgatgcatcacgtccccactcctccctcgccccgtccacccgtggacgacgcccggcctcactcctccgtgcgtaggtctagtcgagactcctcgtgacagtaggtaactcggaactaacgtaacgttagtggtattggtattcgtagacaaggacgcgagggctagtccaccactaacctcgtatacttcgttacgttcggttactaacggtccgggtacccgttcccgggtcctcggacgtggtcgagtggacgtggtacgcgtagacggactagattacttacgaacgtacgtaagaacgtacgtaacgaacgtacggaggtggacggtcgtagggaacggtttaggtttgggtttagggtttaacg

SEQ ID NO: 7742 - DNA, 586 bp, Homo sapiens
  misc_feature: GYAE6OF01AP2R6.37.71.G05.1.454.CMB.1.raw
  modified_base (485)..(485): a, c, t, g, unknown or other
  misc_feature (485)..(485): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctcgtgggtctctggatgcaggtggggatattgtgatgcatcacgtccccactcctccctcgccccgtccaccccgtggacgacgcccggccctccatcctcctgcctaggtctagtcagacgccctcctgctagtaggaaatcggaacaacgtaaactttagttggtattggtactcgtgacgaagaacgccggaggctacgtacctaccgactaaccgtcccgtattccgttacgtttcgggttactacgtccgggtcccgttccgggtcctacgacgtggtcaggtcgngtaggtgactcgaggtcagtagtacttccgagtactagaacgtagtccgaggcgtaggacgtgggagtcgtagggtaggtggtttcgggtttggggtttac

SEQ ID NO: 7743 - DNA, 906 bp, Homo sapiens
  misc_feature: GYAE6OF01DM6FE.37.71.G05.1.454.CMB.1.raw
tcagtagtgtagatcacgaccggtgctcgatttagtgtcgtcgcaagagagaggggccttagccctggattccaaggcatttccacttgttgatcagcactgaacacaaaggactcaccatggaggttggggctgttctggtattttccttggttgcttaggtttttaaggaagggtagtacccacgttggtggtaagggtacaggcgtgggtaggtaagtcggtggggggagtcgttagggtacaggtccgtgggacggtcctaggacgtacctctccgttggatctacgtccggtcgtaggtaccttccgtaccgttccggtacgttcgttttacggactagttacggtacgtccgggtcggggtcccgggcccggggtaccgtaccggggaacggggggtaacggggttccggttagggggtaacggttccggggttacctaccgtacgtacccgtactaccggttaaagttaaccgtaaggttaccggtaaacctaaaacctattaacgtaaaccttaccggaagttaggtttacgttttaggggtaccgggtaaccggggtaccctacgttaaccgtaaaccctacgttacccctaaccggtaacggaaacccgtaaaacgtaaccccggaaccgaaacggtaacgttcccggttaacgtttccgttttcgtttaccggtactaccgtaagtttaacggacgtaaccggtacgtccggaacggacgggaacccggtacggaacccggtacgggtaacccgtcgttaaccgtacgttaccgttacggaggttacccgggtaatacggggtacgggtacgggtcggggttaccggggtacgggtcggtacggggttccgttaccgggttaccccgggcgttaaccggttccgttaaacccggg

SEQ ID NO: 7744 - DNA, 921 bp, Homo sapiens
  misc_feature: GYAE6OF01ATDB0.37.71.G05.1.454.CMB.1.raw
  modified_base (226)..(226): a, c, t, g, unknown or other
  misc_feature (226)..(226): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggacctcctcagttcaccttctcacaatggacggcctccctgctcacgtccgtccggtggggctgtactaagtcgtctcggtcggtctcgtggntggcggtagggtagggtattagttggtagtagtcgtacctactaccgtacccgtacccctccttccccgtccccgttcccgcccccgtaacccgtacccgggtagggaacccggaccccgggtcccccgttacccttacccgttacgtcccgttccggtaccggtaccggttaccgtaccgttacgtccgaaccggtccgtcccgttaccgtagaacgtaacggtaaacgtaaacgtaccggtaaaccttaaaccgtttaagtttagggtacggtttaacgtttacggtaacccgttagtaaccggaacgtaaacggtaacccgggaaccggtaccgggtaccctaaccgttacccgtaaaccccgtaaccttaccggtttcccgtaaacggtttacccgtttaccgggtttaacccggggtttaccgttaaaaccccgggttacccggggttccccccggggtttacccgggttaccccggggttacccgttaacgggtacggttttacccggtagggccgggttaacggacgggtttaaccgtcggtaaccggtaccggtactaacgtaaccttacggtaaccttacgaacggacggttaaacgtggtacccctaaggtcggaacgggttaccggtagggacccgggttagtacgggttaagggttaccgtttttggggtttaaccggttaag

SEQ ID NO: 7745 - DNA, 713 bp, Homo sapiens
  misc_feature: GYAE6OF01BSMZK.37.71.G05.1.454.CMB.1.raw
  modified_base (604)..(604): a, c, t, g, unknown or other
  misc_feature (604)..(604): n is a, c, g, or t
tcagtagtgtagatcacgaccggtgctcgatttagtgtcgtcgcaagagagagggggtcaggctggaactgaggagcaggtgggggcacttctccctctaacactctccctgttgaagcttctttgtgatcaggactcctcagttcaccttctcaacaatgacggcctcctgctcagctcgtgggctgctaatcgctcgtggtctcgtggatgcgaggtggggtattagttggtagtagtgactacgtcctaccgtaccccctacttccctcccgtccgtccccgtacctacccgtagggacgaccggtcccggtccctcctaccgttccttccgtcggaccgttaacggttcctacggtacgaacggccgtcccttacgtcgaaccgtaaggtaacggtaaaactcggaaacctaacgtaaacgtttagtacggtagttaggtactcgtacgacgaacggtaccgcggtaacggacgtactaccgtaccaacctacgtctagttacttcgttaacggttacggttacgtaaccggtccgtcccgggttcccggtcctaggtacgttacggtcgaaggtcgacgtaaggtgaacgtcgtaacgngaaccgttagtaaccgtacaacgtacgtaacggtaacgacgtagacggtaacgtaggaggttagggacggttacgttaaggggaggtttaggttttcggggttttaaag

SEQ ID NO: 7746 - DNA, 319 bp, Homo sapiens
  misc_feature: GYAE6OF01C6IC1.37.71.G05.1.454.CMB.1.raw
  modified_base (207)..(207): a, c, t, g, unknown or other
  misc_feature (207)..(207): n is a, c, g, or t
  modified_base (230)..(230): a, c, t, g, unknown or other
  misc_feature (230)..(230): n is a, c, g, or t
  modified_base (274)..(274): a, c, t, g, unknown or other
  misc_feature (274)..(274): n is a, c, g, or t
  modified_base (304)..(304): a, c, t, g, unknown or other
  misc_feature (304)..(304): n is a, c, g, or t
  modified_base (308)..(319): a, c, t, g, unknown or other
  misc_feature (308)..(319): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggagctgaggatgttgggtttattactgcatgacaaggtctaacaaactcctggatcaccgttcggaccaagggacacgactgganaattaaacgactgtggctgcacntctgtcttcatccttccgactatctgaacttctaacacttacgnggacggccgggactggacgaaggcgactanacgnnnnnnnnnnnn

SEQ ID NO: 7747 - DNA, 544 bp, Homo sapiens
  misc_feature: GYAE6OF01C9STU.37.71.G05.1.454.CMB.1.raw
  modified_base (228)..(228): a, c, t, g, unknown or other
  misc_feature (228)..(228): n is a, c, g, or t
  modified_base (290)..(290): a, c, t, g, unknown or other
  misc_feature (290)..(290): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
  modified_base (499)..(499): a, c, t, g, unknown or other
  misc_feature (499)..(499): n is a, c, g, or t
  modified_base (513)..(513): a, c, t, g, unknown or other
  misc_feature (513)..(513): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgagctccctgctcagctcgtgggctgctaatgctcgtgggtctcgtggatgcgaggtgggatagttgngatgcatcacgtcccactcctccctcgcccgtccacccgtggacgcgccgcctccatcctcngcgtagtctagtcgagcgtcctctgacgagtaggaatcggaactaactaactttagtaggtattggtatcgtagacaggacgccgaggacacgtcctacaactaccttcgtagacttcgttacgttcggttactacggtccgggtccgtccgggtcctgacgtgtcgngtgctgtgntcgcgcagtnttactacacacgtagagtctanacgtacgagtaggnggacgtagtaggtaggtgtttggggtttagg

SEQ ID NO: 7748 - DNA, 585 bp, Homo sapiens
  misc_feature: GYAE6OF01CI4ER.37.71.G05.1.454.CMB.1.raw
  modified_base (445)..(445): a, c, t, g, unknown or other
  misc_feature (445)..(445): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctgggagggtccctgagactctcctgtgcatcgtctggacttcaccttccgagtcttttgacatgagcgtgggtccgccgggctccgaggggaagggtcgtggaggtgggtctcatccatcagttacaagtcggtacaaacctatactactacgacagtattttgaggaagggcctcttcacctatcctccaagtacaacgaaccgaccaagacgcttctcttgtttcngtcatagtgacacgctaggacgacgccggacgccgccggtctacttattacttacgtagtcgacgagtcggtgggaccgggtcgggtaggtccggttgggtacggtaccggttcgggtaccgtcgtttcccgttaaccgg

SEQ ID NO: 7749 - DNA, 634 bp, Homo sapiens
  misc_feature: GYAE6OF01C7R9R.37.71.G05.1.454.CMB.1.raw
  modified_base (232)..(232): a, c, t, g, unknown or other
  misc_feature (232)..(232): n is a, c, g, or t
  modified_base (336)..(336): a, c, t, g, unknown or other
  misc_feature (336)..(336): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctcctggggctgctaatgctcgtgggtctctggatgcgaggtggggtattagttggngatgctatacaccgtccccacttccctccctcgccccgtccaccccgtggacgacgcccggcctccacttcctcctcgcaggtcctagtccagccgtcctccgngcaagtggaaactggacactaactttagtcggtaattggtactcgtcgacgtaagacgtacgaggactacggtcctacccaacaccttcgtactactcttacggtttacggttactaacgggccccggttcccgggtcccgggttcccgtacgtacgttacggtacgtggtcggtcgtaaggtcggtacgtacggtacgtacgactagttcttacgacctagtagtaaagtcgtacggagacggtaggtacgggtggacggtcggttagggtaggttaggtttgggtttggtttaacg

SEQ ID NO: 7750 - DNA, 779 bp, Homo sapiens
  misc_feature: GYAE6OF01C8GXM.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactcctccctgttgaagcttctttgtgatcaggacctcctcagttcctaccttctacacaatggacggtcctccctgctcagcctccgtgggctagtactaatgtctcgtggtctcgtggatgcgtagggtgggtattagttggtagtatgctactacgtacctacccctaccttcccttcccgtccggcccctaccgaccccgtaggacgaccgccccgtacctccacttccctccgtcgtacgtacggtacgtacgacgacggacctcccgtctgacgtaaggtaaggtaactacggtaacctaacgttaacgtttaggttacggttagtttcgttaactcgtacgacgtaacggacggtaccggacggtacctaccgtacctaacccgaccgttaaccgttccgtagttaccgttacggtttaccggtttaccgggttaccgtacccgggttccccgggttaccccggttcccgggtacgtaacgtacggttacggtacggtaacgggtcggtaacgttacgggtacgtacgtcgaacggtcttaacgtacgtttaacgtacccgaagaaccgttaagggactaaaccgtaggaacggttaagtaagggttaggggaccggttacggtaagggtagggtttaacgggttacggggttttggggtttttaaaccg

SEQ ID NO: 7751 - DNA, 689 bp, Homo sapiens
  misc_feature: GYAE6OF01AUJLF.37.71.G05.1.454.CMB.1.raw
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcacctttctcacaatgaggctccctactcagctcctggggctgctaatgctctgggtctctggatgcagtggggatnttgngatgcatcacgtcccactcctccctgccccgtcaccccgtggacgacgcccggccctccacttcctcctgcctacggtctacgtcaggtacgcccttccgtgacctagtacgggtaaaatggaacctacgtaaacgtttataggtagttggttaatccgtagacgaagtaacgccgaggggactacggttacctacccgtaacaaccctttccgtagtaacgtttccgttaacgttttccgggggttaacctaaggggtttccccgggccccgtttccccggggttaccctcgtaccggtagggttttccggaacggttcgggtcgtaacgggttacggaccgttcggacggtaccaacgtacgttacgtttaccgaacgttaacacggtaaagtctacgaggaccgaggtaggttcggaagggtctagggtaaggtttcggttggggttttcgggtttaacg

SEQ ID NO: 7752 - DNA, 620 bp, Homo sapiens
  misc_feature: GYAE6OF01CEAQQ.37.71.G05.1.454.CMB.1.raw
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatgcaggtgggattagttgtgatgcatcacgtcccactcctccctcgccccgtccaccccgtggacgacggcccggcctccactcctcgtcgcngtctacgcacgcgtcctctgcagtagaatgacactagttactgtagttgtatcgngtacagaacgcgacgggctacgtacctccgaactaaccttccgtatacttacgtttacgttcgggtttacctacgttcccggggtcccgttcccgggttccctaggtacgtacgggtttacacgggttcggcgtaggtgacgtgaaccggtcaagttcgtacttagacgtactaggtaaccgattccggagtaccgggtaagtacgggggttacgtacggtaccggttaaggacgggttaggtttttggggttttaacgggg

SEQ ID NO: 7753 - DNA, 355 bp, Homo sapiens
  misc_feature: GYAE6OF01D720D.37.71.G05.1.454.CMB.1.raw
  modified_base (217)..(217): a, c, t, g, unknown or other
  misc_feature (217)..(217): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (340)..(355): a, c, t, g, unknown or other
  misc_feature (340)..(355): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatggtttgggtttattacgtgcatggcaaaggtctaactaaacgtccgttcggatcgtaccttcggaccgaaagggcacgtacgnggatattaaacgactgtggactgacaccattcgtagtcttacactccgttccccactacttcgttagaaacttcctaactaccgtactggtacggcgggtctacggcaagggcctnagtancnnnnnnnnnnnnnnnn

SEQ ID NO: 7754 - DNA, 774 bp, Homo sapiens
  misc_feature: GYAE6OF01CBCVP.37.71.G05.1.454.CMB.1.raw
  modified_base (457)..(457): a, c, t, g, unknown or other
  misc_feature (457)..(457): n is a, c, g, or t
tcagtagtgtagatcacgaccggtgctcgatttagtgtcgtcgcaagagagagggggtcaggctggaactgaggagcaggtgggggcacttctccctctaacactcctccctgttgaagctctttgtgatcaggacctcctctacgttcctaccttctcaactaatggacggtcctcccgtgcctacgacgtccgttccgtggggtctgtactaagtcggtccttcggtcgggttccttcgtggtactcggacgagggttaggggtatttagttggtagtagtcgactacgtccgtaccgtccctaccgtccctcccgtccgtcccgtaccgacccgtggacgtaccggcccgtccctcctactcctccgtgaccgtagtacgtacggtacgacgtcctcccgtcgagtacgtaagtaaggtaacgtacggaacttaacttaacgttaggttaggtnttaggtacttagagtaacggaaggtaccgacggtacggacctacgtcctaaccgtaactaaccgttcgtaacgtactttaacggttacgtttaccgggttaacctaccgggttcccccgggtaccgggtttaccccggggtaacctcgggtaccggttaccggtaacgtaccgggttacggtcggtaacggtacgggtacgtaaccgtacgggtaatacggttactacgttaaccaggttaaccaggaactacgtaccgaaggtgaacgggttaggaggtaacgtgttaaagggtacggtttgttaggggttaaacg

SEQ ID NO: 7755 - DNA, 705 bp, Homo sapiens
  misc_feature: GYAE6OF01AQ1FV.37.71.G05.1.454.CMB.1.raw
  modified_base (207)..(207): a, c, t, g, unknown or other
  misc_feature (207)..(207): n is a, c, g, or t
  modified_base (343)..(343): a, c, t, g, unknown or other
  misc_feature (343)..(343): n is a, c, g, or t
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgagcctccctgctcagctccgtggggctgctaatgtctcgtggtctcgnggatgcaggtggggtattagttgtgtatcgctactctaccgtcccctaccttccctcccgtccgtccccgtcccacccgtggacgcgccgcctccactcctccgtgcgtacgtccgtagcgaacgcgtccctccgngctagtaggtaagtcggaacctaactaacgttagttaggtattagttactcgtcgacgtaaacggacggaccgacgggactacgtaccctacccgaaactacccgttacgtacgtacgttacgtttacgggtttacccggtactttacgggtccccggggttacccccgttccggggttcccaggttaccggtcggttacgagggtcggtacgtacgggttagaccgtacggacgtaacgtacgtaacgttccttaaccgacgtaaccggttagaacgttacgtacgaagggtaccgtaaagggtcgggtagggtaaaccgggcggttaggtaacgggttttaggtttaggggtttaaccgg

SEQ ID NO: 7756 - DNA, 810 bp, Homo sapiens
  misc_feature: GYAE6OF01C4KX4.37.71.G05.1.454.CMB.1.raw
  modified_base (239)..(239): a, c, t, g, unknown or other
  misc_feature (239)..(239): n is a, c, g, or t
tcagtagtgtagatcacgaccggtgctcgatttagtgtcgtcgcaagagagaggggtcaggctggaactgaggagcgaggtggggcacttctccctctaacactcctccctgttgaagcttctttgtgatcgaggaccttcctcgtacgttcctaccttcactaacaagtgacgtcctcctgtctcacgcttccggtgggtcctgtactaagtcgtcgtcggtcggtctgtggatcggngtagggtagggtattagttggagtacgttcgaactcgaccgtacccgtacccctaccgttcccgttcccgtcccgtacccgtaccccgtaaccggtcggtaaccggtaccccgccgttaccccgtacctaccgttccgtaaccgtcgtaacgtacgtacgttacgacgtaccgtccgtacctacgtacgtagtaaacggtaacgtaacgtactaaccgttaaattagtttaggtacgttacgtttacgtacgtacgtacggaacggaacgtaaccggaagggtaccggtactacgtacccgtaacctaaccgtaccgttactacgttaacgtttaccgtttacggtttaccgttacggttccggtacccggtccggtacccggtacgtacgtacggttacgtcgtacggtacggtagtacggttacgaccgtacgtaaccgtacgtaacgtaccgttaacgtacgtaacggtacgtaaacgtacgtaacgtaggtaccggtaaggaaccgggtaggtaccggtacggttaagggtaccggttttaaggtacgggttttaggttttaaccgg

SEQ ID NO: 7757 - DNA, 758 bp, Homo sapiens
  misc_feature: GYAE6OF01BUQ90.37.71.G05.1.454.CMB.1.raw
  modified_base (180)..(180): a, c, t, g, unknown or other
  misc_feature (180)..(180): n is a, c, g, or t
  modified_base (446)..(446): a, c, t, g, unknown or other
  misc_feature (446)..(446): n is a, c, g, or t
  modified_base (556)..(556): a, c, t, g, unknown or other
  misc_feature (556)..(556): n is a, c, g, or t
tcagtagtgtagatcacgaccggtgctcgatttagtgtcgtcgcaagagagaggtgccttagccctggattccaaggcatttccacttggtgatcagcactgaacacaaaggctcacatggagttgggctgttctggtattttccttgttgcttgttttagagagtccatgtagagtacngtcgtggtagatcggtggggagtcttaggtacgagtccgtgggacggtccctaggacgtacgttccgtcctggtgacctcgttcggtcgtaggtactttaccgtacccttccgagttccgttttagacctagttgacgtcggttccgggtcccggccggtacgtccggaagggggtaggttcgtgggtacgtcgggtctactactcccgaattacgttaagttacgtacgtacggtaaaccaaaacgtattaacgtaacgtacgtnttacgttaagttttacggaaggtacccggggtctaccgttacgacctacgtccgacctaaggaacgtaccgaaaccgtacgaacgcgttacttcgttcgtttgttccganaacttattcggaacggctacggaccgtaggaaccggtaccggaccgacggtaccgacgtacctttacgaacgtttcttaaccgtcggggttacgaccggtttaaacggccggggtttaaggggcccgggttacggggtgttaaccgggttccgggtacgggttacccgggtaccggttacccgtaaacccggtttaaccccg

SEQ ID NO: 7758 - DNA, 678 bp, Homo sapiens
  misc_feature: GYAE6OF01EQ8R3.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactcctcccctgttgaagcttctttgtgatcaggactcctcagttccaccttctcacaatgaggctccctgctcagctccgtggggctgctaatgctcgtgggtctcgtggatgcgaggtggggattagttggtagatgactataccgacgtcccccacctcctcccctcggccctaccaccccgtgacggacgccggccctcgactcctccgtgcgtacggtctacgtacagtcgcctcgtgactagtaaggaaatcggaacaacgtaaactttagtgtacgttaggtaactcgtagacgaaggaacaccgaaggtaccagttacccacctaaaccgtaacctacgtacgtacttacgttacgtttaacggttaccgtaaacggtccccggggtacccggttcccggggtacccgtagaacggtacggttcgtaaggtcggaagttacggtagaccgtacgacggactaacgtacgttacttacgaaccgtaagtagaaacgtcgtaagaagtacgaacgggtaagtaggggtacgtaacgttagggaaggtttaaggttcggggttttaagggg

SEQ ID NO: 7759 - DNA, 610 bp, Homo sapiens
  misc_feature: GYAE6OF01CH2H0.37.71.G05.1.454.CMB.1.raw
  modified_base (346)..(346): a, c, t, g, unknown or other
  misc_feature (346)..(346): n is a, c, g, or t
  modified_base (557)..(557): a, c, t, g, unknown or other
  misc_feature (557)..(557): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgcttgttttagaaggatccactgtgaggtacagctggtggaatcgtgggggagcttggtaccaggccctgggacggttccctgagacctctcctggtgactattcgtctggtacttccaccttccgagtcttttgacatgagcgtcgggtcccgcgggcctccggaggggtaacggtccgtggacggtgggtcncgtactcatacgtaagttacaagttggtaccaaacctatactactacgcaacgttatttgaggtaacgggtccacttaccgaccctatcctaccgagaacgaaccgaaccgacaagacgtcctcgtcttcgttctgactagtatacggaactacgcctagacgtacgaccgacgacgccgtactctatattaccgtgtcgagacggtcggnggtaccgggtcggtcggcgtggtacgtacgtggtaaccgtcgttacgtaaccg

SEQ ID NO: 7760 - DNA, 811 bp, Homo sapiens
  misc_feature: GYAE6OF01EPCJR.37.71.G05.1.454.CMB.1.raw
  modified_base (368)..(368): a, c, t, g, unknown or other
  misc_feature (368)..(368): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaagtgctcgtgggtctcgtggatgacgtaggtgggtattagttggtttagatgctactccgaccgtccccacgttccctccccgtccgccccgtccacccgtgggacgaccgccggtccctaccgattccgtccgtggccgtagggtttcctaggtccgaacggtaccgcccttccgngtacgtaagtaaggaaacgtcggaactaacgttaacgtttaggtaggtagtttaggtacttcgtgacgaacgaacggtaccggaggtacctacggttacctacccgaaaccttaccgttcgttaacggttacgtttacccggttttaaccgggttaccgggttttaaccgtacccggggttccccgggggtaccccgggttttaccccggtacccgttaagggttaacccggtttacgggtttcccgggagggttaccggtagggttaacgggttacgtaccctaaaggggccgtaaacgtagtttaacgtttacccggttaaaccaacgggttagtaaaacggaacggttaacctacgggaagtcgggtaaaggtacggggcggttacgggtagtaagggggtttaaccggtttggggttttaagggggtttttaaacccgg

SEQ ID NO: 7761 - DNA, 592 bp, Homo sapiens
  misc_feature: GYAE6OF01CKY3I.37.71.G05.1.454.CMB.1.raw
  modified_base (231)..(231): a, c, t, g, unknown or other
  misc_feature (231)..(231): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatgcgaggtggggattagttgngatgcatcacgtcccacttcctccctcgccccgtcaccccgttggacgacggcccggcctccactcctctcgctggtctagcagctcctctgctagtaggaatggaactactaacgtttagttaggtagttggtatcgtgcgaagacgcgagggcagtcctaccactacctctgtacttcgttagtttcggtactacggtcccgggtccgttccgggtcccgtgaccgttaggttcgaggttcgcgtaggtaggactcgacgctaacgtacgttacttcaactacgtagaaagtccgaagacggtacggaggtaggtgggtaacggtcggtagggtaaggttggtttaggggttttacggg

SEQ ID NO: 7762 - DNA, 1005 bp, Homo sapiens
  misc_feature: GYAE6OF01BI232.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggacctcctcagttcaccttctcacaatgaggcctccctgctcagccttccgtgggctgctaatcgctcgtggtctcgtaggatgcgtaaggtgggattagttggtacgagttcgctaacgttccgaacccgttccccctaaccttcccttccccgttccggtaccccccgttacccgacccccggttaggggaaccggacccggccccggtccccttacctacttcccctaccgttcggacgttacggtaccgttaacggtaccgaacggccgtcccccgttcgtcggaaccgtagggtaacggtaaaacgtcggaaacctaaccttaaccgtttaggttaggtaccggtttagtttacgtcgtacggacgtaaagaacccgggtaccggtaacgggtaccgtacgttccccgtaacccgtaaacgttaaccccttacgtttaacggtaacccgttttcgtttaaaccggggttttcccgggttaacgtttaaccccggggttacccccgggggttccccccgggttttccccggggtacccccgtttacgggttaaacccgggttaccggggttttttaaacccggccggggttaacgggtttaaccgtaaccggggggggttttaacccgtcggttaacccggggtaaacgggttacccgttaaaccggtttaacgggttttaaaccccttaacccgggaaacgttttaaaccggtaaacgggtttaaaccgtaccgttaaacccgggacgggttaaaccggtaaagggggtttaacccggttaggggggtaacccccggggttaaggttttaaccgggggtagggttttttaacggggtttttaaccggggttttttttaaaacggggg

SEQ ID NO: 7763 - DNA, 619 bp, Homo sapiens
  misc_feature: GYAE6OF01A3JIJ.37.71.G05.1.454.CMB.1.raw
  modified_base (557)..(557): a, c, t, g, unknown or other
  misc_feature (557)..(557): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctcgtggatgcgaggtggggattagttgtgatgcatccacgtccccatcctccctgccccgtcaccccgtggacgcgcccggcctccatcctctgctaggtctagcagacgtcctctgacagtaggaatcggaaccaactaatttacgttggattggtatctgacaagacgccgaggctacgtcctaccactaacttcctagtacttcgttacgtttcgggttacttaacgggtccgggtacccgttcccgggggttaccctaggtaccgtacggttccgtaagggtcggacgtacgggttcggacgttaccggaggacctacggtagttacttaccgacgtacgtagggtaaacncgtacgaacgcgaaggacgggtagggacggtacgtaggagggttggttagggttttaacggg

SEQ ID NO: 7764 - DNA, 625 bp, Homo sapiens
  misc_feature: GYAE6OF01CWBHX.37.71.G05.1.454.CMB.1.raw
  modified_base (451)..(451): a, c, t, g, unknown or other
  misc_feature (451)..(451): n is a, c, g, or t
tcagtagtgtagatcacgaccggtgctcgatttagtgtcgtcgcaagagagagggggtcaggctggaactgaggagcagggtgggggcacttctccctctaacactctcccctgttgaagctctttgtgatcaggactcctctagttccaccttctcaacaatcgaggtcctccctgctcagctccgtgggctgctatcgctcgtggtctcgtgatcgcaggtgggtaatgttgtgactgcactctaccgtacccacttccgtcctccgcccgtaccgaccgtaggacgaccggtccgccctcctactcccgttccgcgtacgtacggtacttacgtaccacgaccgtcctacgtgacgtagtaaggaaacgtcggaacaacgttaacttaggtagtattggatcggtacagaagcgacgtaggtactaacgtcctacgtaactatccgtntatcgttacgttacggtacctaacggtccggacccgttccgggcgtacgtacgtagtcgaggtcgagtacgtggtaactagacgtactaagtacttagtaactacgagtagtaaacgtacgtacgagcgtaagcgtaagggacgtcgaaggtacggttggtaagggttttacgg

SEQ ID NO: 7765 - DNA, 667 bp, Homo sapiens
  misc_feature: GYAE6OF01EHRSS.37.71.G05.1.454.CMB.1.raw
  modified_base (186)..(186): a, c, t, g, unknown or other
  misc_feature (186)..(186): n is a, c, g, or t
tcagtagtgtagatcacgaccggtgctcgatttagtgtcgtcgcaagagagaggtgccttagccctggattccaaggcatttccacctggtgatcagcactgaacacaaaggactcaccatggagttggggctgttctggtatttttccttgttgtctgttttagaaggagtccatgtgaggtacngctggtggaatcgtgggggagtcgttggacacgccgtggacggtccctgagaccttctcctgtcgctatcgtcgtggtacttcctacccgttccgagttcttttagactatggacgcgttcggggtccggccgggtcgtaccggaagggggtaacgggttcgtagggtacggtgggttaccttcacttacctatcgtaacgttaacaagttacggtaacctaaaacctattaactaccgtacgacgtagttagttttggaacggtaacgggtcccgtccttacacctactcctacgaagacgaaccaacgaccgaaagtacgtcttctacgtttcgttctacgtctaattagcgactacgtcctagacgacgccggtacgccggtcgtctacttagttacttacgtcggtagacggtaagtagtcgggcgggtccgggtggtacggttgggtacgtacggttccggtacgtccgtttaacg

SEQ ID NO: 7766 - DNA, 568 bp, Homo sapiens
  misc_feature: GYAE6OF01E179R.37.71.G05.1.454.CMB.1.raw
  modified_base (370)..(370): a, c, t, g, unknown or other
  misc_feature (370)..(370): n is a, c, g, or t
tcagtagtgtagatcacgaccggtgctcgatttagtgtcgtcgcaagagagaggtgccttagccctggattccaaggcatttccacttggtgatcagcactgaacacaaaaggactcaccatggagttggggctgttctggattttccttgttgctgttttagaaggagtccactgtgaggtacagctggtgaatcgtgggggagcttggtacagcctggagggtccctgagactctcctgtgcatcgtctggacttcaccttccgagtcttttgactatgagcgtgggtccggccgggtctccgaggggaagggtcgtgggagtgggtctcatccatcagttacaatggtacaaacctatatactacgnagtatttggagaacgggccgtacttcacctactcctaccagacgacaacgccaaagtcactctacgttcgtttctgactaactagtaggacacgtctgaagacgccgaacgacggccgctactatacttagtcgtagcggtagagtcgggacgggcggtggcgttcgggtcgtaccggtccggtccgtaccgttaccg

SEQ ID NO: 7767 - DNA, 663 bp, Homo sapiens
  misc_feature: GYAE6OF01DAWHT.37.71.G05.1.454.CMB.1.raw
  modified_base (271)..(271): a, c, t, g, unknown or other
  misc_feature (271)..(271): n is a, c, g, or t
  modified_base (504)..(504): a, c, t, g, unknown or other
  misc_feature (504)..(504): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatgggagttggggctgttctggtattttccttgttgcttgttttaagaaggtacgtccatgtgaggtacagcgtggtggaatcggtggggggagtcgttgggtacaggtccgtaggggacgggtccctaggaacgtctctccgtgtcgactntcgtcgtggtacttccaccgtttcgagtcgttttagaactatggacgtccggtcggggtcccggccggggtccgtaccgggaagggggtaacgggtccggtgggtacggttcgggtctcactcctatcgtacgtaacagtacgtaacaaactataactacgtacgctagttagtttggagacgggtcctactcactactctacgagacaacgtacacgaacgtcgtctcgttnttcttcgtagactaagtagtcgacgacgtcgtagaacgtccgaccgacggacgtcgtaccttacgtaagttactacggtgtaggcggtagtacgggtacgggtcgggtcgggtcgggtcgttcgggtacgtaccggttcggttccgtacggtttaaccg

SEQ ID NO: 7768 - DNA, 660 bp, Homo sapiens
  misc_feature: GYAE6OF01DLRAE.37.71.G05.1.454.CMB.1.raw
  modified_base (501)..(501): a, c, t, g, unknown or other
  misc_feature (501)..(501): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggctccctgctcagctccgtggggctgctaatgctcgtgggtctctggatgcgaggtggggattattgtgatgcatcacgtccccactcctccctcgcccgtccaccccgtggacgacgccccggcctccacttcctccgtcgcgtacggtctagtcgacgacgccctctgacagtaggaaagtcggaactacttaacttagttacggtatttcggtatcgtgacgaggaacgcgagggctacgtcctaccaactaccgtctcgaattcgttaacgttcggttaactacgggtccgggtcccggttcccgggtcctggtacgtacggttcagggtcggngtaggtacgtagtaccgagacgaacgttacgtactttaaccgaactacgtaaggtaaagtaccgtacggaacggtaaccgaaaggggtagggttaacggggaacgggttacggtaaggggttaaggggttaacggtttttgggggtttttaaaacgggg

SEQ ID NO: 7769 - DNA, 569 bp, Homo sapiens
  misc_feature: GYAE6OF01DN3NG.37.71.G05.1.454.CMB.1.raw
  modified_base (372)..(372): a, c, t, g, unknown or other
  misc_feature (372)..(372): n is a, c, g, or t
  modified_base (444)..(444): a, c, t, g, unknown or other
  misc_feature (444)..(444): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctggagggtccctgagactctcctgtgcatcgtctggattcaccttccgagtcttttgacatgagctgggtccgccgggctccgagggaaggtcgtgggagtgggtctcgatccatctagtacaagtggtacaaacgtataatactacgctaagtnttttgagaacgggcccgtacttcgacctatctccgaagacgaacaacgccaaagcgactctcttacgtttcngtacattagtaggacctagcctagacggacgaccgacgacgtcgtactctaattactacgtgtggacgtaggagtggggacggtggtcggtacgttgggtacgaccgttcgggtcgtcgttaccg

SEQ ID NO: 7770 - DNA, 913 bp, Homo sapiens
  misc_feature: GYAE6OF01BNCLZ.37.71.G05.1.454.CMB.1.raw
tcagtagtgtagatcacgaccggtgctcgatttagtgtcgtcgcaagagagaggggccttagccctggattccaaggcatttccacttggtgatcagcactgaacacaaaggactcaccatggagttggggctgttctggtattttccttgttgcttgttttagaaggtagtccactggtgaggtacagtcgtgggtggaatcggtgggggagtcgttggtacaggtccgtgggacgggttccctgacgtacttctccgtgtcgctacgttcgttcgtggtaccttcgtacccttccggaagttcttttgactagtcgagtcgtcggggtcccggccgggtccgtaccggaggggtaacgggttccgtagggtacggttggggtcctacgtacgttacctacgtacgttaacgttaaccgtaacgttacggtaaaccctaaaaccgtaatttaacttaaccggtaacgtaaccgttaacggtttaagtttttacgggtacgggtaaccgggttaccccggttacctttacccgaaacccttaaccgtttaccccgtaaccgtaacgggaaaccgtaaacccgtaaaaccccgtaaacccgaaaagttcccggtaacctttccgttttccgttttaccgtttccgtacgtacttaaacgttacggtaccggtaaacgacccggtacgttaacgggaacgaccccggggaaccccgggaacccgggtacgggcccggtttacttaacccgttaagtttaacccgtttaccgggttacggtaccggtaacggtaaacggtaccgggttggggaaaccccggggtttcccggggtacggggttaccggttaccggggttacgttaacccgggttccggttaacccgtttaaacccgtttacccggtttaaaaccggg

SEQ ID NO: 7771 - DNA, 672 bp, Homo sapiens
  misc_feature: GYAE6OF01AF8BG.37.71.G05.1.454.CMB.1.raw
  modified_base (605)..(605): a, c, t, g, unknown or other
  misc_feature (605)..(605): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcgaggactcctcagttcaccttctcacaatgaggctccctgctcagctccgtggggctgtctaatgctcgtgggtctcgtggatggcgagggtggggtattagttgtgagtgctatccaccgtcccctacttccctcccgtcgccccgtaccaccccgtggacgacgcccggcctccactcctccgtgcacggttctacggcagcctaccctcgtcgataagtaggtaactcggtaacctaattaacgttagttaggtagtttaggtacttcgagacgaggaacgtaccggaggtctacgtaccctacaacctaccgttcgtacgtacttacgttacggtttccgttaccgttacggtccccggggtcccggtttccgggtcccgtagtcggtaacggtttcgagggtcggcgtagggtacgtacgtacgaggtaccaacgttactaccgttacaacgttacgtaaggaaccgtntacggacggtcggagggtaggtacgggacgttaggtaagggaggtttacggtttgggggttttaacg

SEQ ID NO: 7772 - DNA, 750 bp, Homo sapiens
  misc_feature: GYAE6OF01CT4WH.37.71.G05.1.454.CMB.1.raw
tcagtagtgtagatcacgaccggtgctcgatttagtgtcgtcgcaagagagagggggtcaggctggaactgaggagcagggtgggggcacttctccctctaacactctccctgttgaagctctttgtgatcaggtactcctcgtagttcctaccttctacactaatgacggtcctccctgctcagtcctccgtggggctgtactaatcgtcttcgtgggtctcgtggatcgcgaggtgggaattagttggtagatgacatacctaccgtacccctacttcctcccgtccgccccgtaccacccggtaggacgaccggccgtccctcgactcccgtcgtcgtacgtacgttcgtacgtacgacgtactcctactgacgtagtaaggaaagtcgtaaaccacgttaagttaggttacggtattacgggtaactcggttagaacgtacgggaaacgtcccgggtaaggccctaccgtccgtaaaccgtaacctaccgtacggtacttaaccgtcggtttacgttaaccgggttaccgtaacgggtcccggtccccgggttccggtaccgtcgtaacggttggtacgtccgtaacggtcggaacgttcggtacgtaccgaacgtactaaccggtacgtttaacaccgtaaacgtcggtaaacgtaacgtacgtaacggacggtacggtaaaaggcgggtaaggggtcccgtaagggttaagggttacggaaaggtttttccgggttaaaggggg

SEQ ID NO: 7773 - DNA, 269 bp, Homo sapiens
  misc_feature: GYAE6OF01ANH11.37.71.G05.1.454.CMB.1.raw
  modified_base (260)..(260): a, c, t, g, unknown or other
  misc_feature (260)..(260): n is a, c, g, or t
  modified_base (266)..(269): a, c, t, g, unknown or other
  misc_feature (266)..(269): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatccttcccgccatctgaatctacactacgtgacgcgggctggcaaggcncatagnnnn

SEQ ID NO: 7774 - DNA, 714 bp, Homo sapiens
  misc_feature: GYAE6OF01BG7EX.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctcctgctcagctccgtggggctgctaatgctcgtgggtctcgtggatgcaggtgggatagttgtgatgctatccgacgtccccacttcctacccgtcgcccgtcaccccgtggacgacgccgtcctccactcctccgtgcgtacggttctacgtcacgcgtccctctgactagtacggaactcggaacctaactaacgtttacggttaggtacgtttacgggtactcgtacgaacgtaacggaaccgaccggtagggtcctacggtaccctaccgtaaccttaccgttccgttaggttaccttaccgtttacgggtttaccgggtttaactaacccggggtttccccggggtaccccggtttaccccgggggtccttacgggtaaccggtttacgggttaccagggttccgggacgtaggggtaccgtacgtaccgggacggtacctaacggtacttaccttacgaacgtaccggtagaaacgtctaaccgaggtcgaaggtacgggttggacgttacggaagggtttaggttggtttcgggtttaacgg

SEQ ID NO: 7775 - DNA, 783 bp, Homo sapiens
  misc_feature: GYAE6OF01EKSY7.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactcctcccctgttgaagcttctttgtgatcagggacctcctcagtttccacctttctcaacaatgaggcctccctgctcagctccgtggggctgctaatgcttcgtgggtctcgtggatgcgagggtgggtattagttgtgagtcgacatccgtaaccgtccccctaccttccgtccccttcggaccccgttaccacccccgtagggacggaccgccccggtacccctacacttcccgttccgtcgaccgttacggttaccgtacgttaccgacggaccgtccccttaccgtcggtaacgtaacggttaacgggaaaacgtacggtaaacctaaacgttaaacgttttagttggggttaactttacgggtttactcgttacgaacgaaagaacggtacccgaacgggtcctaacggttacctacccaaccgttaacctaccgttagttaactttaccgttaggtttaccggttactaaccgggttcccggggtaccccggtttccggggtcccttaggtaccgttagggttcccgtaaggtcggtacgttagggacgtacgtaccgtaacggtactaacggtacttccttaaacgaccgtaaacgttaggaaaacgttcgaacttcggaacggtaggtaggacgggtcgtacgtagggaggtttgttcgggttttaaggg

SEQ ID NO: 7776 - DNA, 686 bp, Homo sapiens
  misc_feature: GYAE6OF01B8ZN5.37.71.G05.1.454.CMB.1.raw
  modified_base (654)..(654): a, c, t, g, unknown or other
  misc_feature (654)..(654): n is a, c, g, or t
tcagtagtgtagatcacgaccggtgctcgatttagtgtcgtcgcaagagagagggggtcaggctggaactgaggagcaggtgggggcacttctccctctaacactcctcccctgttgaagctctttgtgatcaggactcctcagttcaccttctcacaatgaggctcctgctcagctccgtgggctgctaatgctcgtggtctcgtggatgcgaggtgggattagttgtgtatgcatcaccgtcccctaccgtccctccctcggccccgttaccgaccccgttagggaacgccggccccggtaccctcctactcccgtaccgtcgaccgtacggttaccgtacgtaccgaacgtaccgtccctaccgtgacctaaggtacggtaaagtgaacctaacgtaagtttagtacggtattagtactcgtacgaacgaacgtacgccgtaggcctacgtaccctacgaacctacgtcctagtacttacgttaacggtttcgggtaaccgttacggtcccggtaccgggttcccggaccgttagaccggttacgttcggtaaccgtggcgttaagggtacgtcgtacgaccggtaactaccggtattaccttcgaactaggttaacgaatctacggagtcggtaaggtggtacggtacgngttaaaggtagggttgtttagggttttaacgg

SEQ ID NO: 7777 - DNA, 804 bp, Homo sapiens
  misc_feature: GYAE6OF01A7G6I.37.71.G05.1.454.CMB.1.raw
tcagtagtgtagatcacgaccggtgctcgatttagtgtcgtcgcaagagagagggggtcaggctggaactgaggagcaggtgggggcacttctcctctaacactctccctgttgaagctctttgtgatcaggactcctcagttcaccttctcacaatgagctcctactcagctcgtgggctgactatgctcgtggtctcgtggatgcgaggtgggattagttgtgtatgctatacgtacgtacccctattccttccccgtcggtccccgtaccgacccgtagggaacgaccggtccccggtaccctccgtattcccgttcccgtacggtaccgttacggttactacggtaccgacgtaccgtcccttaccgtacgactaacggtaacggtaaacgtacggaacctaaaccgtaaacgtttacggtttacgggttacgttacggtaacgtttccggtaggaaccgaacggtaaacgggtcccggaaggggtaccttaacggttcccctaaaccgtaacccgttaacgtttacccgtaggtttaaccgtttaccgtttaaccggggtttaccgggtttaacccgttaaacccgggttcccgggttaccccgggttccccgggttacgttacggaccggtttacggtacgtcggtcggtacgtaggtaccgtacgtcgacgtaccaaggttactacgttaccacgtacgtacggaacgttacgccggtaaggaccgtaaagggcgggtaacgggacggttacgtacgggtaacgggttttggtttacggggttttaaggggtttaac

SEQ ID NO: 7778 - DNA, 728 bp, Homo sapiens
  misc_feature: GYAE6OF01AWKFQ.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaagtgctcgtgggtctcgtggatgcaggtgggatagttgtgatgcatcacgtccccactcctccctcggccccgtccaccccgtgggacgacggtcccggcctacctactccgtcctaggctacggtcctagtccgacgtacgtccctcgtacgacgtaagtaggaaacgtcggaacctaacgttaacgttagttgggtactttaggacttcgtacggaacgtaacggaacggacccggtaggggtaccctaccggttaccctaacccgtaaccgtaaacccgttccgttaacggtacctttacccgtttacggtttcccgggttaacgtaccgggttccccgggtcccggtttacccgggtccctacggtacggttacgggttaccgacgggttacggacctaggggtactaccggtacggaacgtccgaacgttacgttacgtttaccgaccgttaaggtacggaagtacctaaggacgacggaggtacgggtacgggtaacgtcgaagggttacgttcgggttagggttttacgg

SEQ ID NO: 7779 - DNA, 828 bp, Homo sapiens
  misc_feature: GYAE6OF01D6K8G.37.71.G05.1.454.CMB.1.raw
  modified_base (169)..(169): a, c, t, g, unknown or other
  misc_feature (169)..(169): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggtattttccttgttgcttgttttagaaggngtccatgtgagtacagctggtggaatcggtgggggacgtcgttaggtacgaggtccgtgggtacgggtccctaggtacgtacctccgtccgttggtgtcctagttccgtcgtacggtacttcccgtacccgttccgtagtttccttttgaacttagtggacgtccggtccggggtcccggccggtccgtaccggaggggtacgggtcgtaggggtacggttacgggtcctcgtacgtcctaacttacggtaagttaacgtaagttccggtaaacctaaactattaacctaccgtacgactaaaggtttgttttaggacggtaacggggtccttaccctttaccgaacctaccgtccgtaccgaacggtaaccgaaacccgaaccgacgaaacgtaccgttaccttacgtttccgtttgtttccgttacgtaaccttaaggtaacctacgggaccgttaccggtacgtaacggaccgggtaacccggtaccccgggtaaaccggtcccggggttaaccgtacgggttaccctttaacgttaacgttaccggttagggtccgtaacggggtacggttaccgggtacggggtacgggtcgggttcgggtaggttacggtcggtaccgggttccgtaccggttaccgttacccggttaaccgg

SEQ ID NO: 7780 - DNA, 754 bp, Homo sapiens
  misc_feature: GYAE6OF01CMGT9.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactcctcccctgttgaagcttctttgtgatcaggacctcctcagttcaccttctcaacaatgaggcctccctgctcagctccgtggggctgactaatgctcgtgggtctcgtggatgacgtaggtgggtattagttggtagatgactacgtcctaccgtcccctaccgttcccgtccccgtccggtaccccgttacccgaccccggttagggaccggtacccggtccccggtccttaccgtaccttcccgtaccgtcgaccggttacggttaccgtaccggtaccgtaacggtaccctcccgttaccgtacgtacgtaacggtaaggtaaacgtacggtaaacctaaccgtttaacgtttaaggttggtacgtttaggtactcggtacgaccgtaaggtacggacggtacgtcgtactacccaccgtaactacgtcgtagttctacgtttacggttcgtacgtaccgggtccggtacccggtcgggtacctaggtacgtcggtacgacgggtgtacgtaggtacggacgtacgacggtacctaagttcgttaaccgtacaacggtacgtagaagttaccgagaaccggttggacgggttacggacggttaacggcgggttaaggtaagggttttgggtttaacggggttacg

SEQ ID NO: 7781 - DNA, 833 bp, Homo sapiens
  misc_feature: GYAE6OF01EUWAD.37.71.G05.1.454.CMB.1.raw
  modified_base (317)..(317): a, c, t, g, unknown or other
  misc_feature (317)..(317): n is a, c, g, or t
tcagtagtgtagatcacgaccggtgctcgatttagtgtcgtcgcaagagagagggggtcaggctggactgaggagcgagggtgggggcacttctccctctaacactctccctgttgagctcttgtgatcaggactcctctagttctaccttctcacaatgaggcctccctactcacgctccgtgggctgctatgtctcgtggtctcgtggatgcgtaggtagggtattagttgtgtagtgtctatcacgtaccctacctcctccctcgaccccgtccgaaccccgtacggacgacggtcccggaccctaccgtactncctccgtcgacgtacgtctacgtctaggaccgtacccgtcccgtacgtacgtaacgtaacggtaaacggtggaaaccctaaccgtaaaaccttttaaacgtttacgggtaacgttttacggggttaaactttaccggttaggtaccgtaaacgggtaaacggtacccggaactaggggggtaccctaacgggttaccgttaaccccgtaacccgtaaaccgttacccgttacggtaacgtttaccggtttaaacgtttaacccggggtttaccggtttaaaccgttacccgggggtaccccgtttacccggggggtttacccccgttaccgggtaacccgtaacgggtttaccggtaaccggttacggggttacgtaacgggttacgggtaacgttaccgtaacgggtaccgtaaccgtaacggtaacgtttaaccgtaacgtaaccgttaacggtaaacggtaaacgttaccgtaacggtacggtaacggtaacgggttacgggtaagggtacgg

SEQ ID NO: 7782 - DNA, 729 bp, Homo sapiens
  misc_feature: GYAE6OF01DR3XN.37.71.G05.1.454.CMB.1.raw
  modified_base (237)..(237): a, c, t, g, unknown or other
  misc_feature (237)..(237): n is a, c, g, or t
tcagtagtgtagatcacgaccggtgctcgatttagtgtcgtcgcaagagagaggtgccttagccctggattccaaggcattttccacttggtgatcagcactgaacacaaaggctcaccatggagttggggctgttctggtattttccttgttgcttgttttaagaaggacgtcctacgtggtgaggtacagtcgtgggtagaagttcgggtagggggtacgtcgtttaggtaaccnggtccggtaggggacgggttcccctaggaacgtaccttccgttccgtggtcgcgtacttcggttctacgggtaccttcctacccgtttcgagtttctttacgaactcgtggacgtcggttcgggtccccggccggtccgtaccgggaggggacggttcggtagggtacggttcgggtaccttcgacgttcctacgtacgttaacgttaacgaagttacgtaaacctaaactacgttaactaaccgtaccgtatacggttagtttggaacggacggtcctcgtaccaccgtctactcgacgacgaccacgacgtagcgtctactcttcgttctgacgtatcgtacgacgacgtaccgtaggacgtaccggaccggtacgtaccgggcgtacctacgttacttacgttacgtagtcgacgtaggtacggacgggtacgggtcggtacgggttcgtcgggttacgtcccggttacgtccgttaccgttaacccgg

SEQ ID NO: 7783 - DNA, 702 bp, Homo sapiens
  misc_feature: GYAE6OF01D71G8.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggacagcctggacggtcctgagctctcctgtgcatcgtctgattcaccttccgagtcttttgactatgagcgtcgggtccgccgggctccgaggggagggtcgtgggaggtgggtctcatccatcgtagttacaagtcggtacaaaccataactactacgctagtagttttgagaacgggtcccgtcttaccacctactcctaccgaaggacgaaccgtaaccgacccgaaaggacgtaccttccgtttacttcggttttcctacggtaccttaagttaggttacggtaacctacgggccgttaacgggaacggtaccggggaccccgaaccgggtaccggacccgggtcttacccgtttaattaacttttaccggttggtacggtaccgggtaaaggtagggttacggggacccggggttcggggtacggggtccggttacggggttacggtaccccgggtttccggggttaccggtaccgttttaaccccgg

SEQ ID NO: 7784 - DNA, 750 bp, Homo sapiens
  misc_feature: GYAE6OF01DR5OO.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctccgtggggctgctaatgctcgtgggtctcgtggatgcgaggtggggaattattgtgatcgcatccacgtccccacttcctccctcgccccgtccaccccgtagggacgaccgtcccggccctccactcctccgtgcgtaggtctagtcgaagacgtccctcgtgacaagtaggaaatggaaccaacgtaactttagttggtattaggtactcgtgtacgaaggacggtaccgacgggtactacgttaccctaccaaccgtaacccttcgtagtaacgtttaccgtttacggttttaccgggttaaccttaacgggtcccccgggttacccgggtttcccggggtaccccgttagggtacccggttacggggtttaccgtacgggttcgggtcgtaacggggtacgggtacccggttaccggggacttaacgtacggttaactttcccggaactaacgtaggaaacgtacgttaccgaacggtacggtaagggtacgggttacggggtagggtaccggttaagggtaaacgggtttgggtttttaacgggggtttggttttaaacgttaccggg

SEQ ID NO: 7785 - DNA, 709 bp, Homo sapiens
  misc_feature: GYAE6OF01CJZBN.37.71.G05.1.454.CMB.1.raw
  modified_base (612)..(612): a, c, t, g, unknown or other
  misc_feature (612)..(612): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatcgctcgtgggtctcgtggatgcaggtggggattagttgtgatgctatcacgtccccacttcctccctcgcccgtccacccgtggacgacgccggcctccactcctaccgtgccgtacggttacgtacgtcgaacggtaccgtcccgtacgttcgaccgtaaggtaacggtaaaacgttacggaaaccttaacgttaaaccgtttaagttcgggtaagttttcgggttaacttcgtacggacgtaaggaaacgccggtaagggacctacggtaccctaaccaaacctaccgttcccgtagtaaccgttcgtttaacggtttccgggttaactacgggtccccgggtccggttcccggggtacccttgggaaccgtgggttacacgggttcgcgtaaggtcgactcggacgtacaacggtntacgttcgaaccgtagtaaggaacgttctacgaacggtcgaaggtcggggtaaggaccgttagggtagtacgggttagggtttggggtttaaacggg

SEQ ID NO: 7786 - DNA, 751 bp, Homo sapiens
  misc_feature: GYAE6OF01BXHBS.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactcctcccctgttgaagctctttgtgatcaggactcctcagttccaccttctcacaatgacgctccctgctcagcctccgtgggctgctaatcgctcgtggtctcgtggatgctaggtgggattagttgtgatgcatcgaccgtccccactcctccctacggccctaccgacccgtggacgacgcccgtacctccacttcctcgtcgacgttacggtacctacggtacgaacgtccgtcccttccgtggaactagggtaaacggaaacgttcggaaacctaactttaaacgttttaggttaggtacgtttagggtactacgttacggaaccgaaggtaaccggcggtaacgggtacctaccggttaccctaacccgaacccgttaccgtttaccggaacgttactttaccggtttaacgggttttacccggttaaccgttaaccgggtcccgggggttaccccggttccggggttaccctacggtaaccggttacggttacgagggtcgtacgtagggtacgactacggacgtacacggttacttacgtcccaagttaccgtaaggaacgtcgttacgaaggacggtacgggttacggacggggtacgttacggtaagggttacgttgggttttacggggttttaacg

SEQ ID NO: 7787 - DNA, 801 bp, Homo sapiens
  misc_feature: GYAE6OF01AVMR6.37.71.G05.1.454.CMB.1.raw
  modified_base (191)..(191): a, c, t, g, unknown or other
  misc_feature (191)..(191): n is a, c, g, or t
  modified_base (730)..(730): a, c, t, g, unknown or other
  misc_feature (730)..(730): n is a, c, g, or t
tcagtagtgtagatcacgaccggtgctcgatttagtgtcgtcgcaagagagaggggccttagccctggattccaaggcatttccacttgttgatcagcactgaacacaaaggacctcaccatggagttggggcgtgttctggtattttccttgttgcttgtttttagaaggagtccactgtgaggtacagngtggtggaatcggtgggggaggtcgttggtacgagtccgtgggacgggttcccgtaggacgtaccttccgttcctcggttgacgtgttccggttcgtaggtacctttaccgtacccgtttaccgagttccgtttttacggaactagttacggtacgtccgggttcgggtccccgggtaccccggtccgtcccggaaggggggtaacgggttccgttagggggccggttacggggttccttaccgaccgttccgactttaacgttaacgttaaccgtaaaggttccggtaaaccaaaaccgttaacgttaacgtttaaccctaacggtaccgttaaggtttacgtttttagggtaacggggtaacggtcccggtacctttacggtaaaccctacgttacccgaccgtagaaccgaaaccctaacgaacccgaagtccgtaccttcgttaccgtttgttacctagtacgtaactggtaccgactacgcgacgaacggtaacgcccggagtacccggcgttctacttaagttccttggtacncgggtacaggttcgtcggggcgtcggtggtaccttcgggtctacggttaccgggactttcggttacgtacg

SEQ ID NO: 7788 - DNA, 788 bp, Homo sapiens
  misc_feature: GYAE6OF01AHJ10.37.71.G05.1.454.CMB.1.raw
  modified_base (252)..(252): a, c, t, g, unknown or other
  misc_feature (252)..(252): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggatttttcctgttgcttgttttagaaggagtccactgtgaggtacagctggtggaatcgtggggagcttggtacagcctggacggtccctgagactctcctgtgctagtcgtntggacttccacccttcggagtcttttagacagtcgacggtcgtcggggtccggcccggtctaccggaggggtacggtccgtggtacggtgggtcctacgacttccgatccgtaagttacaacgttcggtaacctaaaccgtataactaccgtacgactaacggttagttttaggaacgggtaaacgggccccgtttactaacccaaccgttactacccgttaccgaacgggaaacggtaacccgaaaccgtccgaaaacggacgttaaccttccgttcgtttacgtttacctaccggtactaagttacgtacggtaacctaccggaccgttacgggaacgaccgggaccccggtaacgggtacccgggtacccggtccgtttaacctaacgttttaacgttacccggttggaaacggttacccgggaaaggttaccgggtaacgggggtccggggttacccggggttaggtccgggttacggggttacgtaccccgggtttcccgggggtaacggtttacccggtttaaacccggg

SEQ ID NO: 7789 - DNA, 632 bp, Homo sapiens
  misc_feature: GYAE6OF01D707W.37.71.G05.1.454.CMB.1.raw
  modified_base (384)..(384): a, c, t, g, unknown or other
  misc_feature (384)..(384): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggatttttccttgttgcttgttttagaaggagtccactgtgaggtacagctggtggaatcgtgggggagcttggtacagcctgggagggtccctgagactctcctgtcgctatcgtctggtacttcctaccttccgacgtcttttgactatgagcgtcgggtccgccggctcccgaggggaacgggtcgtgggagtgggtctcactccatacgagttacaatcggtacaacatatactacgcagtntttgtggaacgggccgtcttccacctatcctaccgagacgaaccaaccgaccaaaggacgtctccttcgttcgtttctgtactatacgtcggactacgcctaggaagacggacccggacggaccggcggtaccttacgtattaaccgttacgtacggtcggacggtagtaacgggtgggacccgggtcgggtacggtcggttacgggtggtacccgttacgggtcccgttaccgttccgttaaacccg

SEQ ID NO: 7790 - DNA, 850 bp, Homo sapiens
  misc_feature: GYAE6OF01D2K5Y.37.71.G05.1.454.CMB.1.raw
  modified_base (143)..(143): a, c, t, g, unknown or other
  misc_feature (143)..(143): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggacctcctnattcaccttctcaacaatgaggcctcctgctcagctcgtgggctgactatgtctcgtggtctcgtgatgacgtagggtgggtatttagtgtgattcgacctagtaccgtacccgtcccttacctcccttaccccggtccgtacccccgtacccgtacccgtagggaaccgccggtcccccgtcctacctactcccgtacgtcggaccgttaggttactcgtacgaaccgtccgtccttccgacgactaaaggtaacggtaaaccgtacggtaaacctaaacgttttaacgtttaacgggttggtttaacggtttacggttaacgttccggtagaacgtaaaccgggaaccggtccgggtaaacgggccttacccgggtaacctaacccggtaccttaaccgttacccggtaacgtttaccgtttacggttttaacgggttaccggtttaaccggttaccgggtccccggggttcccgggttacccggtacccgttacggtaccggtcgttaacggtacgggtacggtacgttagggtacggttacgtaccgtaacggacggttaacccgtagttaaccttaccgtaaacggtacccgtaaggtacgttaaacggtcgttaaacggaaccgggttaagggtacgggttaaggtacggggttacggtaaggggtttaaacgggtttgggttttaacggggttttaaggg

SEQ ID NO: 7791 - DNA, 742 bp, Homo sapiens
  misc_feature: GYAE6OF01DZNDJ.37.71.G05.1.454.CMB.1.raw
  modified_base (250)..(250): a, c, t, g, unknown or other
  misc_feature (250)..(250): n is a, c, g, or t
  modified_base (552)..(552): a, c, t, g, unknown or other
  misc_feature (552)..(552): n is a, c, g, or t
  modified_base (608)..(608): a, c, t, g, unknown or other
  misc_feature (608)..(608): n is a, c, g, or t
  modified_base (615)..(615): a, c, t, g, unknown or other
  misc_feature (615)..(615): n is a, c, g, or t
  modified_base (624)..(624): a, c, t, g, unknown or other
  misc_feature (624)..(624): n is a, c, g, or t
  modified_base (633)..(633): a, c, t, g, unknown or other
  misc_feature (633)..(633): n is a, c, g, or t
  modified_base (638)..(638): a, c, t, g, unknown or other
  misc_feature (638)..(638): n is a, c, g, or t
  modified_base (664)..(664): a, c, t, g, unknown or other
  misc_feature (664)..(664): n is a, c, g, or t
  modified_base (683)..(683): a, c, t, g, unknown or other
  misc_feature (683)..(683): n is a, c, g, or t
tcagtagtgtagatcacgaccggtgctcgatttagtgtcgtcgcaagagagagggggtcaggctggaactgaggagcgagggtgggggcacttctccctctaacactcctccctgttgaagtcttctttgtgatcgaggtacctcctctacgttcctaccttctacaacgtaagtcggacggcctcctgtcctcgcgtccgtccggtgggtactcgtacgttagtcgtcgttcggttggtcgtcgtaggngtcgaggtgggtagggtattggttgagtgtcgctacgttccgtaacccttcccctccgttccccgttaccccgtcccggtaccccccggtacccgtacccggtacgggccggtaccccggtccccgccccttctaccgttccgtacggtcggtaccgttacggtacctacgtaccgcggttcccctaccttggacgtaacgtacgtaaagtacgaactacggttaaactttaggttagtagtacgttaggctcggtagacgtaaacgtcggaacgtcgtacacctacccgttaacccgtacncgggttattacgttggttacccggttcgtaaccggccggtcccggtcccgtacggnttacggntcggtacgngactcgggngtacngtccggatactcagtccctagagtanaccggtatccgtaggacgngggtaaacgggtggtacgtacggtgggttacgttaacgggttttgggtaggtttaacgg

SEQ ID NO: 7792 - DNA, 758 bp, Homo sapiens
  misc_feature: GYAE6OF01EFOSX.37.71.G05.1.454.CMB.1.raw
  modified_base (155)..(155): a, c, t, g, unknown or other
  misc_feature (155)..(155): n is a, c, g, or t
  modified_base (235)..(235): a, c, t, g, unknown or other
  misc_feature (235)..(235): n is a, c, g, or t
tcagtagtgtagatcacgaccggtgctcgatttagtgtcgtcgcaagagagaggtgccttagccctggattccaaggcatttccacttggtgatcagcactgaacacaaaggacctcaccatggagttggggctgttctggtattttccttgttncttgttttagaaggatccatgtgaggtacagcgtggtgaatcggtgggggagtcgttggtacagccgtgggacggtcccngacgtacctctccgtgtcgactagttcgtcgtggtactttccgtacccgtttccggagttcgtttacgactagtggacgtcggtaccgggtcccggcccgggtcctaccggagggggtacggtcgtagggtacggtcggtcctcgtacctcattacgtacgttaactaacgtcggaacctaaacgtattaacgtacctaacgattaacgggttacttttcggaagggtacccgggtacccttccgtttaaccacccttacgttacccgtacgaaacggtacccgtaaccaaccggtaccgtaaacggtacgttccttacgttaccgtttcggtttccagtaccctaattacgtcgtaacgcgtacgtacggacgtaccgggacccgtacggtacgtacccggttacttaccgttaagttacgttacggtgtacggtaccggtagtaccgggtcggggtaacgggttcggtacgggtcccggttgggacgttacccgggttccggtaccgtacgtttaacccgg

SEQ ID NO: 7793 - DNA, 702 bp, Homo sapiens
  misc_feature: GYAE6OF01C6GVC.37.71.G05.1.454.CMB.1.raw
  modified_base (314)..(314): a, c, t, g, unknown or other
  misc_feature (314)..(314): n is a, c, g, or t
  modified_base (665)..(665): a, c, t, g, unknown or other
  misc_feature (665)..(665): n is a, c, g, or t
tcagtagtgtagatcacgaccggtgctcgatttagtgtcgtcgcaagagagagggggtcaggctggaactgaggagcaggtggggcacttctccctctaacactcctcccctgttgaagcttcgtttgtgatcaggactcctcagttcaccttctcacaatgagcctccctgcctcagctccgtggggctacgctaatcgcctcgtcgggtctcgtggatggcgaggtgggattagttgcatgcacgtcgtaccgtccctactcctcccgtccgtcccgtacccacccggttgacggacgccccggtcctaccncgttcctccgtgaccgtacggttcttacggactacggtacgtccccgtcgttcgaacgtacgtaaggaacgtgaacctaattaaacgttgttacgtgtttacggtactcgtcgaacgagtaacgccgtaaggctaccgtcctaacaccgtacctaccgttataccttacgtttcggttcggttaaccgtacggtcccgggtacccggttccgggacctcggtacgttacgttcgaacggttcgaacgtacgggtacgtacgtacggtacgactaacgttcggtacttaccgaacgtagttaacgaacggacttacccggagtagggtaaacggtgggtccggtaaacggtntagggggttaaacgttggttttacggggttttaacgg

SEQ ID NO: 7794 - DNA, 722 bp, Homo sapiens
  misc_feature: GYAE6OF01DQBME.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctccctgttgaagcttctttgtgatcaggtacctcctcagttcaccttctcaacaatgacgctcctgctcagtccgtccgtgggctgactaagtcgtctcgtgggtactcgtggtatcgacgtaggtggggtattagttcggtagtatagctacgtccaaccgttccccctaattcccgtccccgtccggtaccccgttacccgacccccggtagggaacgccggtccccggtaccctcccaacgttccgttaccgttcggacgacgggttctaacggtaccacggtacgtccccttcgtgaccgtaagtacggaaaagtcggtaacaacgttaacgttagttacgggaatttcggacttcgtacgaaccgtaagacgccgaggtacgtacgtacccacaccgtaacctcgtagtacttcgttaagttcggttactaacggtccgggtacccgttccgggtccgtaggccgttaggtccgtgttacggcgtaaggtcggtataccggagtacgtacgtacggtaattaccgaaagtccgtaaaggacgtaagacaacggtcgtaacgggtaggtggtaaacggtcgtgggaaacggtttgtagggtttttaacccgg

SEQ ID NO: 7795 - DNA, 804 bp, Homo sapiens
  misc_feature: GYAE6OF01A1OPE.37.71.G05.1.454.CMB.1.raw
  modified_base (171)..(171): a, c, t, g, unknown or other
  misc_feature (171)..(171): n is a, c, g, or t
  modified_base (188)..(188): a, c, t, g, unknown or other
  misc_feature (188)..(188): n is a, c, g, or t
tcagtagtgtagatcacgaccggtgctcgatttagtgtcgtcgcaagagagaggtgccttagccctggattccaaggcatttccactttggtgatcagcactagaacaacaaaggactcaccatgggagttggggcttgttctggtattttcttgtgtcttgtttagaggngtccatgtgagtacagngtggtagatcggtgggggagtcgttagggtacacggtccgtaggggacggttccctgtaacgtctccgttccgtggttcgctacgttccggttcgttacggtactttacccgttacccgtttaccggacggtttcttttacggaaccttaggtacgacggttccggttccgggggcccggtccccggggtacgttaccgggaaacgggggttacggggttccggttaggggtaccggggtttcgggtccgttacgtacccgtaccgtagttaccggtaacgttaacgtaacggtacgtaaccgaaactacttaacgtacgtaccgtacgtacgttagtttggacggttaaccgggtcctaccgttaccgacccttagttaccctacggaaggaccgtaaccaacgtaccaacggtacgtccttacgttacctttcgttactacgtacgtactacgggtaccgtacgtaaccggttctaacgggaacgtaccggacccggacggtaccgtccggtaacttaccgtaagttacttaccgaggttaacgtcggaaagttcggacggggtcgtagggtacgacgggtagtaccggttaggttcccgacggttcttaaccg

SEQ ID NO: 7796 - DNA, 788 bp, Homo sapiens
  misc_feature: GYAE6OF01C83Y6.37.71.G05.1.454.CMB.1.raw
  modified_base (127)..(127): a, c, t, g, unknown or other
  misc_feature (127)..(127): n is a, c, g, or t
  modified_base (145)..(145): a, c, t, g, unknown or other
  misc_feature (145)..(145): n is a, c, g, or t
  modified_base (187)..(187): a, c, t, g, unknown or other
  misc_feature (187)..(187): n is a, c, g, or t
  modified_base (243)..(243): a, c, t, g, unknown or other
  misc_feature (243)..(243): n is a, c, g, or t
tcagtagtgtagatcacgaccggtgctcgatttagtgtcgtcgcaagagagagggggtcaggctggaactgaggagcaggtgggggcacttctccctctaacactcctccctgttgagcttctttgngatcgaggacctcctacngttccaccttctcacaatgagtcctaccctactcagctccgngggctgactatcgctcgtgggtctcgtggtatgacgtagggtgggtattagttggngatacgctacgtccacggtcccccacttccctcccgacggtcccccgtaccaccccggtaggaacgccggtcccgccttacctacttcccctccgtggaccgttaggtaccgtttacgaccgaacggtacccgtcccgtccgtacgaccgtaaggtaacggaaaccgttacgaacctaaactttaacgtttaggtacggttaagttcgtactccgtagacgtaaacggaccgtaccggacggtacctaacgttcctaacccgtaaccgttaaccttccgtagttacctttaccggtttaacggtttaccggttaacccgtaccggggccccgggtttaccccgtaccggggttaccctaaggtaccggtttacgggtagacgggttacgacggttacgtaaccgggcgtaaccggacgtaaccgtattaacgtacgtaccgtaacgtaacggagttaaccagtaaccggaggacggtaaggggtcggtacgggttaggtaccggttaagggttcgggtttaggtttccggggttttaacggtaac

SEQ ID NO: 7797 - DNA, 716 bp, Homo sapiens
  misc_feature: GYAE6OF01BFRT8.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctgctcagctccgtggggctgctaatgctcgtggtctcgtggatgcgaggtggggattagttgtgagtgcatcaccgtcccactcctcccgtgtcctcgtccacccgtggacgacgcccggtcctcccattccctccgtcgccgtacggttcgtacgtacgacggaccgtcccttccgcgtactaaggtaacggtaaacgtccgggaaactaacgttaaacgtttagttacggtagttacggttatactggtacgaagggtaacgtccgaggggtactacggttaccacccgtaaaccttaccgttccgtaagttaccttaacggtttaccggtttaccgggtttaaccgtaaccgggttcccgggggttaccccggtacccggggttcccttaagggtaacccgttagggttaccgtagggttcggacgttacggtacgtacgttacggaccggtatacgtacgttacgttaccaccgtaaaggtacgaacgtatacgaacggtgaagggtacgtacgggtacgaggttcggagttcgggttttaaggg

SEQ ID NO: 7798 - DNA, 859 bp, Homo sapiens
  misc_feature: GYAE6OF01CD34B.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcaacaatgaggcctccctgctcacgtccgtccgtggggtctgactaatcgctcggtcggtcctcgtaggacgtgacgtaggtaggggtaattagttaggtgtatcggactactccgtaccgtccctacctcccgttcccgtaccgtacccgtacccgacccgtaggtaacggaccggcccggtccctacctaccgttccgtccgtcggaccgtacgttccgtaaacgtccgacggtacctcctaccgtcgacgtaaggtaacggtaacgtacgtaaactaacggttaaattaggttcgggtaattacggttacgtacgttacggaacgtaacgggtaaaccggcggtaacggggtacctaaccgtaccgtaacccgtaacctaccgttaccgtaacgtacgtttaccggtttacggtttaccggttaacccggtaccgggtttaccccgggtaccccgggttaccccggggtaccgttaacggtaccggttaacgggtttacgtacccggggtacgtaccgggtacggttaccggtaacggtacgtaccgggtaacttaaccggttaacggtcccgtttaaaccgaacggtaaacgttaaacggaccggtaaacggtacctaaacgggtccgggtaagggtaacgggtacgggtagggtacccgggtaaggggtttaaccggttggggtttaacggttttaccggg

SEQ ID NO: 7799 - DNA, 760 bp, Homo sapiens
  misc_feature: GYAE6OF01CFTAO.37.71.G05.1.454.CMB.1.raw
  modified_base (191)..(191): a, c, t, g, unknown or other
  misc_feature (191)..(191): n is a, c, g, or t
tcagtagtgtagatcacgaccggtgctcgatttagtgtcgtcgcaagagagagggggtcaggctggaactgaggagcaggtggggcacttctccctctaacactcctccctgttgaagcttcttgtgatcaggactcctcagttccaccttctacactaatggacgtcctcccgtagctcacgtctccggngggctacgactagtcgtcgttcggtcggtactcggtaggtagtcgacggtagggtagggtatttagttggagtactacgtacctacgtaccgtacccgtaaccccgtcttccccgttccccgtacccgggtacccctaccggtaacccggagggaccgcccgtaccccgtcccgtactcgtccctccgtcgtaccgtacgtacgtacgaccgtaagtcctcccgtactggaacgtagtaacgaaccgtcgaaacttaacgttagtttaggtacgttaagtttcgaactccggtaacgaacgtacggaacgttcccgggatacccgtaactaccctaaccgacttaaccgtacgtacgttacgttacgtttacggttacggtaccgtacgggtccccggtaccgggtcgtaccgagtaccggtcgtagcggtcgtagtacgtacgtcggtacgaccgtaactacgtactacgtacgaacgtacgtaacgacgttaacgagaacgttcggaacggttaagggacgtaacgggtacgtaaaggttcggttagggttttacggtttaaacggg

SEQ ID NO: 7800 - DNA, 666 bp, Homo sapiens
  misc_feature: GYAE6OF01B0DIX.37.71.G05.1.454.CMB.1.raw
  modified_base (340)..(340): a, c, t, g, unknown or other
  misc_feature (340)..(340): n is a, c, g, or t
  modified_base (502)..(502): a, c, t, g, unknown or other
  misc_feature (502)..(502): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggtattttcctgttgctgttttagaaggagtcactgtgaggtacagctgggtgaatcgtgggggagtcttggtacaggcctggaggtccctggacgtactctcctgtgctatcggtctggacttcaccgttccgagtcttttagactatgagtcggttcgggtccgccggggtccgtaccgaggggtaacgggtcgtagggnggttacggggtcctcgacttccgattcgtacgtaacaacgtacggtactaaacctatactaacgtacgactagttactttagtaggtacggccgtaccgttacacctacttacctcgaagacgtaaccgaaacgacctaaacgcgcctactcgttacgtttnacgtcagttactaggacacgtcgtacgacggtacgaccggacgccggtacgtccggtacttaacgttaagtttccggagtttcggaacggtgaacgtcggggacgggcgggttacggtcggtacgggtacgttaaccggtccggttaccgttacgttaacccgg

SEQ ID NO: 7801 - DNA, 850 bp, Homo sapiens
  misc_feature: GYAE6OF01DQHYH.37.71.G05.1.454.CMB.1.raw
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (789)..(789): a, c, t, g, unknown or other
  misc_feature (789)..(789): n is a, c, g, or t
tcagtagtgtagatcacgaccggtgctcgatttagtgtcgtcgcaagagagagggggtcaggctggaactgaggagcagggtgggggcacttctccctctaacactcctccctgttgaagctctttgtgatcaggacctcctctagttccaccttctcaactaatgaggcctccctgctcagctccgngggctgactatcgcttcgtggttccncgtggatggccgagggttgggatttagttggtcgatcggacctacgtaccgtaccgtcccccttacgttccctccccggtccgaccccgtccctaaccccggtaggaccggccggtcccccgccttaccctactttacccgtcccgaaggccgtacggttaccgttaacgtccgacgtacccggtccccttcgtcgacgtaaggtaaacgggaacttaccggaaacctaaacgttaaggtttacgttagggttacgtttacgggtaacttccggtaacgacggaacgggaaaccgggtccgtaaagggcccttaaccggttcccaacccctaacttaccccgttaccggttattaaccgttaccccggtttaaggtttccgggttaccgttaacccggggttccccggggttccccggttccccggggttactaccgggttacgttacgggtacctagggttccggaaacgttgggtaccgtacggtaccgtacgggtaaccctaggttacggtaaccttttcccgaaaccggtagttaacggaaacgttaccgacggtaacgacggggttaagnggggttaaccgggacggttaggggttgtaaaagggttttcggttttaggggtttaacccgg

SEQ ID NO: 7802 - DNA, 764 bp, Homo sapiens
  misc_feature: GYAE6OF01B2L43.37.71.G05.1.454.CMB.1.raw
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgcttgttttagaaggtacgtccatgtgaggtacagtctgggtaggtaattcggtggggggagtcgtttaggtacacggtccgtggggtacgggtccctaggacgtacctctccgtgtcgcacgtccttcgttggtttcactttctttacgacctaacgtccgcctagtcggacgtccgtacggggtccctaccgacggtccgtaccgggaagggggtacgggtcgtaggggtacggttcgggtctacggtaaggtttactttaggtgggttagtacggtaactaccgactaactacgtacgacacgtaccgtccggtacggaccgggttccgtacctaccggttcacgaagtacgaactaacttaccggaaagtaacgttaccggtacttaacgtacgtaaggtaactacggaactaccggtcgtaaggacggaccgaccgggaagtacccgtacggttacctttaagttacgttcgttaggtacggtacggaacgggttacccttacgtacccgttacccgttagtacgccgtacgggtccgtcggtttcggtcccgttggttaccgttacggaccggttacgggccggggtaccgtacccggggtaaccc

SEQ ID NO: 7803 - DNA, 864 bp, Homo sapiens
  misc_feature: GYAE6OF01DEK1B.37.71.G05.1.454.CMB.1.raw
tcagtagtgtagatcacgaccggtgctcgatttagtgtcgtcgcaagagagagggccttagccctggattccaaggcatttccacttggtgatcagcactgaacacaaaggactccacagtggtaggttgggctgttcgtggttactttttccgttggttgtcgtttaggttttaaggaaggtacgttccagtagtgaacggtacagtcgtggtaggtaatcggtagggggacgtcgttaggtacaggtccggtggaccgggtccctaggacgtactctccgtgtagctagttccggtacgtacgttaccttaccgttacccgttacgtacgtttctttacgaacgttagttacgacggtccgggttccgggtcccgggaccgggtaccgttaaccgggaacggggtaaccgggtggttagggtaacggttcggttaccgtacgttacctaccgtaacgttaacgtaacgttaaccgttaaacgtacgtaaaacccgtaaaccgtaacgttaaacctaacggtaccttaacgttaacgtttaagtttacgggaaccggtaacggtcccgttacccgtaccgtaccctaacctaccgttaacccgaacgtaaccggtaaccgtaacccggaacgtaacgtaaccttccggttaccttacccggtttgttacccgtatacggtaacgtttacgacggtacgtaccgtagacggtaaccggtaccggaccgcccgggtaacgtcccgtacgttaactaccgttaactggttacggacgtaacggtcgggaaccggttcgggacgggtcggttacggtacgtggtaccgttacggttaccggtcgttaaaccggtgtttaaaccccgg

SEQ ID NO: 7804 - DNA, 615 bp, Homo sapiens
  misc_feature: GYAE6OF01A6CUS.37.71.G05.1.454.CMB.1.raw
  modified_base (286)..(286): a, c, t, g, unknown or other
  misc_feature (286)..(286): n is a, c, g, or t
  modified_base (478)..(478): a, c, t, g, unknown or other
  misc_feature (478)..(478): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctcgtggtctctggatgcaggtgggattattgtgatgcatcacgtcccactctcctgcccgtcaccctggacgacgccggcctccactctccngctaggtctagtcagacgcctccgtgacagtagaagtcggaacctaactaaacgttagttggtattacggtacttcgtgactaaggaaacgccggtacgggactacgtaccctaccaactaacctcctagtacttactacgttcggttactaacggtcgggtccgtacccggggtccctagtacgtacggtnacgggtcgtccgaaggtcggacttacggacggtcaacgtagtacttacggaactacgtacgaaagtgtacaacggcgtaaggtacggtaagggtacggtccgttaagggtacgttaggttacggggtttttaacggg

SEQ ID NO: 7805 - DNA, 790 bp, Homo sapiens
  misc_feature: GYAE6OF01C5H3Q.37.71.G05.1.454.CMB.1.raw
  modified_base (126)..(126): a, c, t, g, unknown or other
  misc_feature (126)..(126): n is a, c, g, or t
  modified_base (242)..(242): a, c, t, g, unknown or other
  misc_feature (242)..(242): n is a, c, g, or t
  modified_base (333)..(333): a, c, t, g, unknown or other
  misc_feature (333)..(333): n is a, c, g, or t
tcagtagtgtagatcacgaccggtgctcgatttagtgtcgtcgcaagagagagggggtcaggctggaactgaggagcagggtgggggcacttctcctctaacactctccctgttgagcttctttgngatcaggtacctcctcagttcctaccttctacacaatggacggtcctccctgctcacgctccgtgggctgactatgtctcgtgggtctcgtggatgcgtaggtgggtattagttgngtatcgactactccgtaccgtcccctaccttcccgtccctccggtccccgttacccgaccccggtagggaccgccggccccgtcctacccncttcccgtccgtacggacgtacggttactacgtaccgacgtccgtccctcgtcgaacgtaaggtaacggtaacgtacggaaaccttaaccgtttaaagtttagggttaggttaacgttcggttacgtaccgtggtaaccgaacgggtaaccggccggtaacggtaaccctccggttacccaacccgtaaccgtacccgtacgttagtaccgtttaccgtttacgggtttaccggttaaccgttccgggtaccccggggttccccgggttccccgggttaccgtacgggaccgtttacgggtcgtaacgggtcggaccggttagggtacgtacgtcggtaacggtcctaagtcgttaccttaccgaagtaccgtaaagtacgtaccagaaggtaccggttaaggagggttccggaaggggttacgaggggttaacggttggttttaggggtttaacgg

SEQ ID NO: 7806 - DNA, 825 bp, Homo sapiens
  misc_feature: GYAE6OF01COCAE.37.71.G05.1.454.CMB.1.raw
tcagtagtgtagatcacgaccggtgctcgatttagtgtcgtcgcaagagagagggggtcaggctggaactgaggagcagggtgggggcacttcctccctctaacactcctcccctgttgagtctctttgtgatcaggactcctctagttccaacccttctacaactaatggacgcctaccctactcagtcctccgtggggctgactagtgtcgttcgtcgggtctcgtaggctggtcgtagggtgggtaattgtttcggtagtacgtcgtaccacgttaccctacgttcccccctacttccccgtaccccgtcccggtaccccgtacccgtacccggaggaaccggaccggtccccgtccctcctacttcccgttccggtaggccttacggttactacgcgacgtaccgtcctcgaacgactacggtaaggaacgtacgaactaaccgtagtttaggtacggtagttacggtacctcgtagaaccgtaaggggaacccgaggaccggtacttaaacctcccgtaacccgtaacctaaccgttccgtaagttaccggttttaacccggttttaaccggttaacccgggttaacgttaaccccggggtcccgggttacccccgggtttaccgggtacccctttaaccgggacgggtttacggtaaccggtacgttacggacgggttacgtaacgggcgtttaacccggagggtaccctaaggttaccgttcgaaccctaaggtaaccgaggtaaccctagtaaccggaggtaacgtgggagggtaacgcgttaaggagggttattacgggtttgggttacgttaacg

SEQ ID NO: 7807 - DNA, 829 bp, Homo sapiens
  misc_feature: GYAE6OF01DU0E1.37.71.G05.1.454.CMB.1.raw
tcagtagtgtagatcacgaccggtgctcgatttagtgtcgtcgcaagagagagggggtcaggctggaactgaggagcgagggtggggcacttctccctctaacactcctcccctgttgaagtcttctttgtgatcgaggtactcctctagttccaccttctacaactaagtggacggtcctccctgtcctacacgtccgtccggtgggctgtactaagtcgtcgttcggtcggtcctgtaggtgtggacggtagggtagggtattagtttgtgtagtcgacctacgtcctacccgtacccctccgttccctcccgtcccgtaccccgttaccgacccggtggaccggtcccgcccgtcctaccgtcctccgtcctggtaccgtcggttaccgtacgtaccgtacgtccgtcctcgtacgacgtaaggtaacggaacgtacgtaaaccgttaaacttacgtttaacgttaggtaggtttacgtacgtcgtagtaacggaacgtaccggtacggacgtccgtaacctacccgtaactaccgtaacgttccgagttaccgttacgtttaccggtaccggttaccgtacccgggtccccggtaccggtcgtccgtaggtaaccgtggtaacgtcgggacgtaccgtaggtacgtacgtacgaccggtaacgttactacggttaaacccgtttccggaaacgtacgggttaaaaacggttcgtaaacccggtaacgggttaagcggggttaacggggttaacggggacgggtttacggtaaaggggtttagggtttaacggggtttttaacggggttttaccggttttaaaggg

SEQ ID NO: 7808 - DNA, 816 bp, Homo sapiens
  misc_feature: GYAE6OF01BZYDJ.37.71.G05.1.454.CMB.1.raw
tcagtagtgtagatcacgaccggtgctcgatttagtgtcgtcgcaagagagaggggccttagccctggattccaaggcattttccacttggtgatcagcactgaacacaaaggactcaccatggagttggggctgttctggtatttttccttgttgtcttggttttagaaggtcgtcctacgtgtgtaggtacgagtcgtgggtaggaagttcgggtggggggagtcgttcggtacgacggtccgtaggggtacgggttccctaggacgtccttccgttccgtgtacgctacgtcgtcgtgtaccttaccgtaccgttccgtagttctttcgaatgtagcggtcggtccgggtcccggcggtccgtacggagggggtaggtcgtggacggttcggtctcactccgtatacgtacgttaacacgttacgtaacctaaacgtataaccgtacgtacgacgttagtttgtttaggacggaacggtcctactaccgacgtactccgtaacgacgtaacgaaccgaaccgtaccgaacgaccgtctaccgttcgtttacgtttcgtacgtacgtaacgtacgtacggtaccgtacgtacggtacggtaaccggaaccggtacccgggtaacccgggtaccgggtacccgttaccgttaccgtttaagtttccgtttaacggttaccggtacgggtaacgggtacggttaccggggtaacggggtaccggggttccggggttaccgggttcgggttaccgggtaccggaccgggtttttttacccgggacccggtttaacccggttcccggtttaaacccgg

SEQ ID NO: 7809 - DNA, 836 bp, Homo sapiens
  misc_feature: GYAE6OF01C9TEQ.37.71.G05.1.454.CMB.1.raw
  modified_base (120)..(120): a, c, t, g, unknown or other
  misc_feature (120)..(120): n is a, c, g, or t
tcagtagtgtagatcacgaccggtgctcgatttagtgtcgtcgcaagagagaggggggtcaggctggaactgaggagcagggtgggggcacttctccctctaacactcctccctgttgancttctttgtgatcgaggtacctcctctacgttcctaccttctacacaagtgacggcctcccgtgctcacgtcgtccggtgggctgtactatcgtctcggtcggtctacgtggattcggcggtagggtagggtattagttgtacgtatcgctactccgtacccgtaccctaccgttcccgtacccgttcccggccccgttacccggaaccccggttaggggaaccgacccggtcccccggtacctacccgttccttccgtccgtacgggacgttacggttacgttacggaccgtacggtaccgtcccgttaccgaggtaccgtaagggttaaacggaaacggtttacggaaaccttaaaccgtttaaggtttacgggtttaaggtagtttaacgggttactacgacggacgaacgggtaccgaccggggtacgccttaaccgtaccaacctaaccttaccgtattaacgtcgttacggtttacgttaaccggttccgtaacccggggttcccggtacccgggtttccgggtacccgttaggtaccggttcgggtaacgttccgggagttaccggtagggtacgtacggtcgtacgaacggttaacgttacgttcgtaacgtacgtacgttacgggactacggtacggaacggtaccgtaagggtagggtcgggacgttaggttacgggtaaggtttgggttttaacggggttttagg

SEQ ID NO: 7810 - DNA, 895 bp, Homo sapiens
  misc_feature: GYAE6OF01EE83D.37.71.G05.1.454.CMB.1.raw
tcagtagtgtagatcacgaccggtgctcgatttagtgtcgtcgcaagagagagggggtcaggctggaactgaggagcagggtgggggcacttctccctctaacactctcccctgttgaagcttctttgtgatcaggacctcctctagttcaccttctcaacaatgacggcctccctactcagtcctccgtggggctgtcttaatcgtcctcggttcgggtcttcgtggagtgacgtagggtagggtattagtttggtgtagtcgactacgtccgtacccgtcccctaccttcccgttccccgtccggtcccccgttacccgtaccccggtgggaccggaccggtccccggtacccctaccttaccgttcccgttcccgtaacggtaccggttaccgggttaccgtacggtaccggacggtacccgtccccgttcgtacggaactaacggtaaagggtaaacgtaccggtaaactaaccgtttaaagtttacggttagggttaagtttcggtaacgttacgtacggaacgaaccggtaaaccgggtaccggtaacggtacctaccgttaaccctaaccgtaacccttacccgttacgttacgttaactttaaccgggttttacggtttaaacccgggttaccggttaccgggttcccccgggggttccccgggtacccggggttaccttaaccggttaacgggttcgttaccgggtggtacgggttacggtacgggttaacggaccgtaccgggaacgtacttaacgttaactccttaaccgaacgtagtacggtaaagttccgaaaggttaaggaagggtaacggggtgggtaacggtaccgggttaggtaacgggtttaagggttttcggggttttagggtttaagttaacccg

SEQ ID NO: 7811 - DNA, 821 bp, Homo sapiens
  misc_feature: GYAE6OF01BP5TD.37.71.G05.1.454.CMB.1.raw
  modified_base (672)..(672): a, c, t, g, unknown or other
  misc_feature (672)..(672): n is a, c, g, or t
  modified_base (746)..(746): a, c, t, g, unknown or other
  misc_feature (746)..(746): n is a, c, g, or t
  modified_base (759)..(759): a, c, t, g, unknown or other
  misc_feature (759)..(759): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgacggctccctgctcagtctccgtgggctgctatgctcggtggtctcgtggtatgcgtaggtagggtattagttaggtcgtaagtcgtacctacgttaccgaacccgttccccctaccttccccgttccccgtccgtcccccgttaccctaccccggtaggaccggtaccggccccgtaccctacccttactcccgttccgtcggacgttcggttaccttacgtacgtacgccgtaccccgttcgacgtacgtaagtaacgggttaaacgtccggtaactaaaccgtttaacgtttaggttacggttgtttaacgggtacttacgtacgtaacgtaacggacggtacccggtacggtaaccgttccgtacccgttacccgtaacgttccccgttaacggttcgttaactttacccggtttacgggtttcccggttaacggtcccccggtttacccggggttcccccggttacccgggtttacccgtaaggtttacccggttacgggtttacncgggttacggaacccgttgggtacgtaccgtacggaccgtacgtaccgtacgttactaccgaacgttcggtaanacgccgtaaacgnggaacgtacgggttagacgggtacgtaccgggagtttaagttccgggttttggggttaacgg

SEQ ID NO: 7812 - DNA, 947 bp, Homo sapiens
  misc_feature: GYAE6OF01A99RJ.37.71.G05.1.454.CMB.1.raw
tcagtagtgtagatcacgaccggtgctcgatttagtgtcgtcgcaagagagagggggtcaggctggaactgaggagcaggtgggggcacttctcctctaacactctcccctgttgaagcttctttgtgatcgaggacctcctctagttctaccttctcacaatggaggcctccctgctcgacgtccgtccgtggggcttgtactaagtcgtccgtcgtgggttcctcgtaggtactcggacggtaggggttagggtattagtttacggtagacgtgtacctacgtaccgtacccgtacccctacctccccgttaccccgtccggaccccccgttaccgtaccccggttacgggaacggacccggtaccccggtccccttacctaccccgtttccccgtaccgtccggtaccgtaaccgggtttaccgttaacggtaccgtaaacggcccgttaccccgttccgtaccggtaaaccgtaaaggtaaaccggggtaaacttaacccgggtaaaccttaaaacggttttaaccgtttagggttttaacggggtttaaccggtttacgggttactacccgttaggaaccgggtaaaacggacccgggtaacgtaaccggggttaaaccgttacccggtaccctaacccgtaacccgttaacccgttcgttaaccgtttaaccgtttaccggtttaccgggttttaccgggtttaacccggttacccggggtttcccccggggttccccgggtttaccccgggttaccgtaacgggttacggttaacggtttacggacgggttacggtaccgttacgggtaccgtacgtacggacgtaccggaacttaccgtaacttccgaacgtacgagtaacgtccgacgtacggcgttaaggacgggttacgggtaccgggagttaggggtacggtttgggtttaacccgggtttaggg

SEQ ID NO: 7813 - DNA, 883 bp, Homo sapiens
  misc_feature: GYAE6OF01B1RY6.37.71.G05.1.454.CMB.1.raw
  modified_base (107)..(107): a, c, t, g, unknown or other
  misc_feature (107)..(107): n is a, c, g, or t
  modified_base (580)..(580): a, c, t, g, unknown or other
  misc_feature (580)..(580): n is a, c, g, or t
tcagtagtgtagatcacgaccggtgctcgatttagtgtcgtcgcaagagagaggtgccttagccctggattccaaggcatttccacttggtgatcagcactgaacanaaaggactcaccatggagttggggctgttctggtattttccttgttgcttagttttagaaggacgttccattgtaggaaggtacagtctggtaggaatcggtgggggagtcgttggaacagccgtagggacgggtccctgagacttctcctggtcgacagtccgtagtacggtacttaccgtacccgttcggtagttaccgttttgaaccgtagtagacggtccggttacggggttccccggtaccggggcctacccgggtaaagggggtaacgggttccggtagggtacggttacggggtaccctcttaacgtaccgtaacgtaccggttaaaagtttaaccgaacgttaaccgggtaaacctaaaacctaagtaattaaacccggtaccgtaagtaacggttttaagtttttacggaaacggggttaacgggtaccccttaacgttacctaaccgtagttaccccgttaanaacggtaacgtaaactaacccggaaacgtaaacgtcggtaacctttctaaccgtttggttttaaccgtacacgtttaaagtaacggtaacggaacgtaccggttactaacgggaaacgggaacccgacccggaaccggttaacgggacccgttaacttacgtaaaacgtttaccgttaggtacgttaaaggggcggtaaaggtaacgggtttaaccgggccgggggttcggggttaacgtacccggtttaggggtacgttaaccccggggttaccggtacggtttaaccccgtttaaacccgg

SEQ ID NO: 7814 - DNA, 683 bp, Homo sapiens
  misc_feature: GYAE6OF01BQI3B.37.71.G05.1.454.CMB.1.raw
  modified_base (160)..(160): a, c, t, g, unknown or other
  misc_feature (160)..(160): n is a, c, g, or t
  modified_base (202)..(202): a, c, t, g, unknown or other
  misc_feature (202)..(202): n is a, c, g, or t
  modified_base (270)..(270): a, c, t, g, unknown or other
  misc_feature (270)..(270): n is a, c, g, or t
  modified_base (401)..(401): a, c, t, g, unknown or other
  misc_feature (401)..(401): n is a, c, g, or t
  modified_base (572)..(572): a, c, t, g, unknown or other
  misc_feature (572)..(572): n is a, c, g, or t
  modified_base (580)..(580): a, c, t, g, unknown or other
  misc_feature (580)..(580): n is a, c, g, or t
  modified_base (595)..(595): a, c, t, g, unknown or other
  misc_feature (595)..(595): n is a, c, g, or t
tcagtagtgtagatcacgaccggtgctcgatttagtgtcgtcgcaagagagagggggtcaggctggaactgaggagcgaggtggggcacttctccctctaacactcctcccctgttgaagtcttcttgtgactcaggtacctcctctagttccaccttcncgaacaagtcgacgtcctcccgtgcctcgacgtccgtccggngggtcctgtactacgtcgtccttcggtcggtcctggtggagtcgtagtagggtggtattagttcgtanacgtgactactaccgtaccctccctccgttcccgtcccgtaccgtccccgtaccgaccggtacggacccgtcccggtcccctacccgtcctcgtcccttcgcgtaccgtacgtaccgtcgtacgacgtccncccgttagcgtaacgtaggtaacgaacgcgtaactaacgttacggttgtaggtattcggactacgacggacgtaaaccggcgtacggttaccgacctaccgtacctaccgtacgttacccgtgtacgttacgttcgttacgggtcctaaccggtccggtccgtcgtaccgntcggtagnggtcgtagcgtacgnggtcacgtacgacgtactacgttacacggtctacggagtaagtacgcgacgaggtgacgtggacgtacgtgtagtcgttgtcgttaag

SEQ ID NO: 7815 - DNA, 664 bp, Homo sapiens
  misc_feature: GYAE6OF01BZ8NS.37.71.G05.1.454.CMB.1.raw
  modified_base (554)..(554): a, c, t, g, unknown or other
  misc_feature (554)..(554): n is a, c, g, or t
  modified_base (582)..(582): a, c, t, g, unknown or other
  misc_feature (582)..(582): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgagctccctgctcagctccgtggggctgctaatgctcgtgggtctcgtggatgcgaggtggggtattagttgtgatgactactctaccgtcccctactcctcccgtcgccccgtccaccccgtaggacgacgcccggtcctaccgtactcctccgtcgtcgtacggtacctagtcaggccgtccctctgactagtaacggaagtacgaactacgttaactttagtaggttagttggtactcgagtacgaacggaacggccggaaggtcctacgttaccctacccaaccgtaaccttccgtagtactttacggttaacggttttccgggttaacctacgggttcccggggtcccgtttacccggggtacctacggtacgtacggttcgacggtcgngtacggtgacgtcgagactagtacgttnttacgacgtacagtaaacgcgttacgaagtcgaagggtggttacggaggttacgaggtacgggtttgttgggggttttaacg

SEQ ID NO: 7816 - DNA, 690 bp, Homo sapiens
  misc_feature: GYAE6OF01CQBEA.37.71.G05.1.454.CMB.1.raw
  modified_base (174)..(174): a, c, t, g, unknown or other
  misc_feature (174)..(174): n is a, c, g, or t
  modified_base (523)..(523): a, c, t, g, unknown or other
  misc_feature (523)..(523): n is a, c, g, or t
  modified_base (560)..(560): a, c, t, g, unknown or other
  misc_feature (560)..(560): n is a, c, g, or t
  modified_base (615)..(615): a, c, t, g, unknown or other
  misc_feature (615)..(615): n is a, c, g, or t
tcagtagtgtagatcacgaccggtgctcgatttagtgtcgtcgcaagagagagggggtcaggctggaactgaggagcaggtgggggcacttctccctctaacactctccctgttgaagcttctttgtgatcaggactcctcagttcaccttctcacaatgaggcctcctgctcngcctccgtgggctgctatcgctcgtggtctcgtggactgacgtggtagggtattagttgtgtaagtcgctaacgtccgtacccgtccctccttcccgtcccgtccgtccccgtacccgcccggtagggaaccgtccgtccccgtacctcctaccgttccttccgacgtcgtacgttactcgtacgaccgtccgtcccttcgcgtacgtagtaaggtaacgtacgaactaacgttagttagtagtagttcgtctgagacgacgacgacggcgtacgtctccgtaactactaccttcaagttcttacgtttcggttacggtcaccgggtcccgggtccgttccgggtaccnggtaccgttggtaccgagggtcgtgacggttgtaacnccggaagtacctaacggttacgttacctaccggaagttacggaacgtaaacggtnacgggaacgtcgggtaagggtaggttacggaagggttacgggagtttaagggttggggtttttcggtttaaacgg

SEQ ID NO: 7817 - DNA, 744 bp, Homo sapiens
  misc_feature: GYAE6OF01AK9W8.37.71.G05.1.454.CMB.1.raw
  modified_base (515)..(515): a, c, t, g, unknown or other
  misc_feature (515)..(515): n is a, c, g, or t
  modified_base (651)..(651): a, c, t, g, unknown or other
  misc_feature (651)..(651): n is a, c, g, or t
  modified_base (678)..(678): a, c, t, g, unknown or other
  misc_feature (678)..(678): n is a, c, g, or t
tcagtagtgtagatcacgaccggtgctcgatttagtgtcgtcgcaagagagagggggtcaggctggaactgaggagcagggtgggggcacttctccctctaacactcctccctgttagaagtcttctttgtgatcgaggtacctcctactagttccacctttctacaacaagtgacggtcctcctgactcgagtccttccggtgggccttagacttaagtcgtccttcggttggtcctcggtggtagtcggacggttaggggtgggttattacgttaggcggtactcgtactaacgtcgtacccgtcccctcgttccccgttccctccggtaccccttccgaaccggtcgaccggtcccggccccgtaccctaccttaccgttcccgtccggtagtacccggttacgttacgttaccggaaccgtaacggtcccgttccccgtagtacgacgtaaggtaaacgttaacgactaccgttaaaacgtttacgtttacgttaggttaacgttcgtacngtaccggaacgacgacgcgagtacctacgacacgtaacgtctacggtacttacgttacgttcgtaacggttaccgtacgggtccgttacccggtcggtcgtacgtagtctaggcgtcgtgtacggcgtacgcgacncgtacgtacttacgtacagtaacgtanacgtacgcgtaacggcgtaacggtgaggtacgtagggtaagtttcggttaaagttcggtttaacgg

SEQ ID NO: 7818 - DNA, 870 bp, Homo sapiens
  misc_feature: GYAE6OF01D2BRR.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcaacaatgacggcctccctgctcagctccgtgggctgactatgctcgtcggtctcgtggatgcgagggtggggtattagttggtgagttcgactactccacccgtcccctaccttcccttccccgtccgacccccgtccccgacccggtggaccgaccggtcccccgtccctcctacttcctcccgtcggccgttacggtcgtacgtacgacggtacccgtcccttaccgacgtacgtaacggtaacggtaaacgtaccggtaaaccaaaccgtttaagtttaggttaggttaacgtttggtaacgttcgtacggaaccgaaacgggtaacccgtaccgggtacgggtaccgtaacccggttaccccttaaccccaacccggttaacccctttacccgggttaagtttaaccgtttttaaccgggttttacccgggttttacccggggtttaaaccgtttaaccccgggggtttccccgggggtttaaccccccgggttttaccccgggggtttaccctacggggttaaccggtttaaccgggttcggtaaccggggtacggttaacggggttaagggtaccggtacgttaaccggacggttaccgtaaagttacggttaccttaccgaacgtaccgtaaaggactacgtaacgacggtggtaagggtggtaacgggtacgtagggttaggagggtttagtttaggggttttccgg

SEQ ID NO: 7819 - DNA, 262 bp, Homo sapiens
  misc_feature: GYAE6OF02F72HS.37.71.G05.1.454.CMB.1.raw
  modified_base (261)..(262): a, c, t, g, unknown or other
  misc_feature (261)..(262): n is a, c, g, or t
tcagtagtgtagatcacgaccggtgctcgatttagtgtcgtcgcaagagagagggatcaggcacagatttcacactgaagatcagcagagtggaggctgaggatgttgggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnn

SEQ ID NO: 7820 - DNA, 262 bp, Homo sapiens
  misc_feature: GYAE6OF02G70GB.37.71.G05.1.454.CMB.1.raw
  modified_base (260)..(262): a, c, t, g, unknown or other
  misc_feature (260)..(262): n is a, c, g, or t
tcagtagtgtagatcacgaccggtgctcgatttagtgtcgtcgcaagagagagggatcaggcacagatttcacactgaagatcagcagagtggaggctgaggatgttgggtttattactgcatgcaaggtctacaaactcctcggatcaccttcggccaagggacacgactggagattaaacgaactgtggctgcaccatctgtcttcatcttcccgcatctgaatctacactactgagcgggctggcaaggcgcatagnnn

SEQ ID NO: 7821 - DNA, 266 bp, Homo sapiens; identical to SEQ ID NO: 7631
  misc_feature: GYAE6OF02INDR4.37.71.G05.1.454.CMB.1.raw
  modified_base (263)..(266): a, c, t, g, unknown or other
  misc_feature (263)..(266): n is a, c, g, or t

SEQ ID NO: 7822 - DNA, 267 bp, Homo sapiens
  misc_feature: GYAE6OF02I5WYT.37.71.G05.1.454.CMB.1.raw
  modified_base (263)..(267): a, c, t, g, unknown or other
  misc_feature (263)..(267): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnnnn

SEQ ID NO: 7823 - DNA, 290 bp, Homo sapiens
  misc_feature: GYAE6OF02IXTV0.37.71.G05.1.454.CMB.1.raw
  modified_base (288)..(290): a, c, t, g, unknown or other
  misc_feature (288)..(290): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttgggtttattactgcatgcaaggtctacaaactcctcggatcaccttcggccaagggacacgactggagattaaacgaactgtggctgcaccatctgtctcatcttcccgcatctgaatctacactactgagcggctggcaaggcgcatagnnn

SEQ ID NO: 7824 - DNA, 294 bp, Homo sapiens
  misc_feature: GYAE6OF02GY8LW.37.71.G05.1.454.CMB.1.raw
  modified_base (291)..(294): a, c, t, g, unknown or other
  misc_feature (291)..(294): n is a, c, g, or t
tcagtagtgtagatcacgaccggtgctcgatttagtgtcgtcgcaagagagagggtaggtccctgacaggttcagtggcagtggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnnn

SEQ ID NO: 7825 - DNA, 263 bp, Homo sapiens
  misc_feature: GYAE6OF02HM70P.37.71.G05.1.454.CMB.1.raw
  modified_base (262)..(263): a, c, t, g, unknown or other
  misc_feature (262)..(263): n is a, c, g, or t
tcagtagtgtagatcacgaccggtgctcgatttagtgtcgtcgcaagagagagggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnn

SEQ ID NO: 7826 - DNA, 512 bp, Homo sapiens
  misc_feature: GYAE6OF02GW46V.37.71.G05.1.454.CMB.1.raw
  modified_base (468)..(468): a, c, t, g, unknown or other
  misc_feature (468)..(468): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatctgggggaggcttggtacagcctggagggtccctgagactctcctgtgcatcgtctggattcaccttccgagcttttgacatgagctgggtccgccgggctccagggaaggtctggagtgggtctcatccatcagttacaatggtcaaaccatatactacgcagattttgtgaagggccgcttcaccatctccagagacaacgccaagagctctctgttctgcatatggacagcctgagagccgacgacgcggctctatattactgtgcgagntggacggcggtggctgggtcgacgtcgggtcgtacgtcttaccg

SEQ ID NO: 7827 - DNA, 265 bp, Homo sapiens
  misc_feature: GYAE6OF02I8AE5.37.71.G05.1.454.CMB.1.raw
  modified_base (262)..(265): a, c, t, g, unknown or other
  misc_feature (262)..(265): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcggctggcaaggcgcatagnnnn

SEQ ID NO: 7828 - DNA, 515 bp, Homo sapiens
  misc_feature: GYAE6OF02G30V2.37.71.G05.1.454.CMB.1.raw
  modified_base (378)..(378): a, c, t, g, unknown or other
  misc_feature (378)..(378): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatctggggagcttggtacagcctggagggtccctgagactctcctgtgcatcgtctggattcaccttccgagcttttgacatgagctgggtccgccgggctccagggaagggtctggagtgggtctcatccatcagttacaatggtacaaaccatactactacgcagtaattttgtgaagggccncttcaccatcctccagagacaacgccaagagctctctgtttctgcatatgacagcctgagagccgacgacgcgctctatattactgtgcgaagagtgggacggcggtggcgtgggtcgcggtcggtcgtacttaccg

SEQ ID NO: 7829 - DNA, 490 bp, Homo sapiens
  misc_feature: GYAE6OF02IGA0K.37.71.G05.1.454.CMB.1.raw
tcagtagtgtagatcacgaccggtgctcgatttagtgtcgtcgcaagagagaggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcagtccccactctccctgcccgtcacccctggagagcccggcctccatcctcctgcaggtctagtcagagcctcctgcatggaaatggacacaacttatggattggtatctgcagaagcagggcagtctcacaactcctgatctattcgggttctaagtcgggcctccggggtccctgacagttcagtggcagtgatcgacggcacagatttcacactagagatcagcagagtggagcgtaggagagttggtttaggg

SEQ ID NO: 7830 - DNA, 484 bp, Homo sapiens
  misc_feature: GYAE6OF02IOI7N.37.71.G05.1.454.CMB.1.raw
  modified_base (371)..(371): a, c, t, g, unknown or other
  misc_feature (371)..(371): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
  modified_base (465)..(465): a, c, t, g, unknown or other
  misc_feature (465)..(465): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctcgccccgtcacccctggagacgccggcctccatctcctgcaggtctagtcagacgcctcctgcatggaatggacacaacttattggattggtatctgcagaagcaggcagtctccacactcngatctattcgggtctaagtcgggctcgggtcctgacngtcagtggcagtgatcgagcacngtattcacactgaagntcagacagagtggacggntggaggtagtggtttaggg

SEQ ID NO: 7831 - DNA, 521 bp, Homo sapiens
  misc_feature: GYAE6OF02GFV46.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcacccctggagacgccggcctccatcctcctgcaggtctagtcagagccctcctgcataggaaatggacaactaacttattggattggtatctgcagaagccagggcagtctccacaactctgatcttagttcgggttactaagtcgggtcctccgggtcctgactgttcagtggcagtggatcgaggccaacagtactttcgactacgtagaagtactcagcgaaggaggtaggacggtcgtaggacgggtattgggtttagggg

SEQ ID NO: 7832 - DNA, 778 bp, Homo sapiens
  misc_feature: GYAE6OF02JV34J.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatattgtgatgcatcagtccccactcctccctgcccgtcaccccgtggacgacgcccggcctccactctcctgcacggtctagtcacgacgtccctccgtgcctagtagggaaaactcgggaacctaaccgtaaactttacgtttgggtaacgtttgggttaacttccgttagtaccgaaacgggaaacggtacccgaagggggtacctaacggttacctacccgtaaccgtaaacccgttcccgttaggtaacctttccgtttaaaggttttcccgggggtttaaccttaaaccggttccccgggggtaccccgttcccgggggttaccccttaggtaaccgttacgggtttccgacggggttacgggaccgttacggtacgggtaacgtccggaacgggtccctaaacggtacggttaagttttacccgaaaccgtacgttaacggtaaacggtacctttacggaacggtaccggtaaacggggtacgggtttacgggggaacggttaccggttaaggggtaaggggttacggttttaggggggttttttaacgggggg

SEQ ID NO: 7833 - DNA, 267 bp, Homo sapiens; identical to SEQ ID NO: 7822
  misc_feature: GYAE6OF02FUILR.37.71.G05.1.454.CMB.1.raw
  modified_base (263)..(267): a, c, t, g, unknown or other
  misc_feature (263)..(267): n is a, c, g, or t

SEQ ID NO: 7834 - DNA, 262 bp, Homo sapiens
  misc_feature: GYAE6OF02G19TF.37.71.G05.1.454.CMB.1.raw
  modified_base (259)..(262): a, c, t, g, unknown or other
  misc_feature (259)..(262): n is a, c, g, or t
tcagtagtgtagatcacgaccggtgctcgatttagtgtcgtcgcaagagagagggatcaggcacagatttcacactgaagatcagcagagtggaggctgaggatgttgggtttattactgcatgcaaggtctacaaactcctcggatcaccttcggccaagggacacgactggagattaaacgaactgtggctgcaccatctgtcttcatcttcccgcatctgaatctacactacgagcgggctggcaaggcgcatagnnnn

SEQ ID NO: 7835 - DNA, 509 bp, Homo sapiens
  misc_feature: GYAE6OF02FX9U7.37.71.G05.1.454.CMB.1.raw
  modified_base (366)..(366): a, c, t, g, unknown or other
  misc_feature (366)..(366): n is a, c, g, or t
  modified_base (467)..(467): a, c, t, g, unknown or other
  misc_feature (467)..(467): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatctgggggagcttggtacagcctggagggtccctgagactctcctgtgcatcgtctggattcaccttccgagcttttgacatgagctgggtccgccgggctccagggaagggtctggagtgggtctcatccatcagttacaatggtcaaaccatatactacgcagattttgngaagggccgcttcaccatctccagagacaacgccaagagctctctgttctgcatatggacagcctgagagccgacgacgcgctctatattactgtgcgagntggacggcggtggctggtcgacgtcggtcgtactcgttaccg

SEQ ID NO: 7836 - DNA, 293 bp, Homo sapiens
  misc_feature: GYAE6OF02HKNDU.37.71.G05.1.454.CMB.1.raw
  modified_base (284)..(284): a, c, t, g, unknown or other
  misc_feature (284)..(284): n is a, c, g, or t
  modified_base (290)..(293): a, c, t, g, unknown or other
  misc_feature (290)..(293): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttgggtttattactgcatgcaaggtctacaaactcctcggatcaccttcggccaagggacacgactggagattaaacgaactgtggctgcaccatctgtcttcatcttcccgcatctgaatctacactactgagcgggctggcaaggcncatagnnnn

SEQ ID NO: 7837 - DNA, 297 bp, Homo sapiens
  misc_feature: GYAE6OF02G76K8.37.71.G05.1.454.CMB.1.raw
  modified_base (293)..(297): a, c, t, g, unknown or other
  misc_feature (293)..(297): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttggggtttattactgcatgcaaggtctacaaactcctcggatcaccttcggccaagggacaagactggagattaaacgaactgtggctgcaccatctgtcttcatcttcccgccatctgaatctacactactgagcgggctggacaaggcgcatagnnnnn

SEQ ID NO: 7838 - DNA, 518 bp, Homo sapiens
  misc_feature: GYAE6OF02G9UB3.37.71.G05.1.454.CMB.1.raw
  modified_base (376)..(376): a, c, t, g, unknown or other
  misc_feature (376)..(376): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
  modified_base (472)..(472): a, c, t, g, unknown or other
  misc_feature (472)..(472): n is a, c, g, or t
tcagtagtgtagatcacgaccggtgctcgatttagtgtcgtcgcaagagagaggggccttagccctggattccaaggcatttccacttgttgatcagcactgaacacaaaggactcaccatggagttggggctgttctggattttccttgttgctgttttagaaggagtccactgtgaggtacagctggtggaatctgggggagcttggtacagcctggagggtccctgagactctcctgtgcatcgtctggattcaccttccgagcttttgacatgagctgggtccgccgggctccgaggggaaggtctggagtgggtctcatccatcagttacaatggtcaaaccatatactacgcagtatttgtgaagggccncttcacctatctccagacgacaacgccaagngctctctgtttcngcatatgacagcctgagacgccgagacgcggctctatattactgtgcgaagngtgggacggcggtaggcgtggtcgacgtcgggtcacgtcttaacgg

SEQ ID NO: 7839 - DNA, 644 bp, Homo sapiens
  misc_feature: GYAE6OF02HUYBK.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcagtccccactctccctgccccgtcacccctggagacgccggcctccatcctcctgctaggtctagtcagacgtccctcctgctagtaggaaatgggaactaactaacttagtttggatttggtaattctagctaagaaagccgaggggcaggtcctaccaacaacttcctagtacttcttagtttacgggttactaacgttccggggtcccgttacccgggggttccctaggaaccgtacgggtttaccgagggtttcggacgtaaggtcgggtactacggaggtaccgtaacgagttaaccttttaccgaaccttacgtacggtaaacgtaagttccgaaggtaccgaaggtaggttacggggtaacgggccgttaggggtaaggtacggttttgggttttaacggggg

SEQ ID NO: 7840 - DNA, 636 bp, Homo sapiens
  misc_feature: GYAE6OF02H3QGP.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctgctcagctcctggggctgctaatgctctgggtctctggatgcaggtggggatagttgtgatgcatcacgtccccacttcctccctgccccgtccacccctggacgacgccggcctccactctccctgctaggtctagtcagacgccctcctgcagtaggaaatggaaccaactaacttagttggattggtatcgtgcaagaacgccgagggcaacgtctaccacaaccgtcccgattcgttaagttcgggttactaacggtccgggtcccgttccgggtcccttaggacgtaggttccgaggtcgggctaggtcggtactcgaacggcaacgtacggtactttcgaactacgtaggtaaacgtacgttacggaacgtacgtaacgggtaaggttaggggaacggggttaccgttaaggggtaacggggtttaacggttttagggggtttttaaggggttttttaaacg

SEQ ID NO: 7841 - DNA, 577 bp, Homo sapiens
  misc_feature: GYAE6OF02IRWPQ.37.71.G05.1.454.CMB.1.raw
  modified_base (371)..(371): a, c, t, g, unknown or other
  misc_feature (371)..(371): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatattgtgatgcatcagtccccactcctccctcgcccgtcaccccctggacgacgccggcctccatcctcctgcaggtctagtcagacgcctctgcataggaatggacactaacttagttacggattggtatctgacagaagcgagggcagtcnccactaactcctagattcttagttcgggttactaacgtccgggccgttcccggggtcccttagaccgtaggttcacgggttcgacgaggtgggactcgaggcaacgtagtactttacactacgttagaacgtactccgaaggtaccgaaggtaacgggtagggacggtaccgtagggaacggttaggtttaggtttttaacggggg

SEQ ID NO: 7842 - DNA, 592 bp, Homo sapiens
  misc_feature: GYAE6OF02JUSLW.37.71.G05.1.454.CMB.1.raw
  modified_base (357)..(357): a, c, t, g, unknown or other
  misc_feature (357)..(357): n is a, c, g, or t
  modified_base (392)..(392): a, c, t, g, unknown or other
  misc_feature (392)..(392): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctggagggtccctgagactctcctgtgcatcgtctggtattcaccttccgagtcttttgactagtgagcgtgggtccgccgggtctccgaggggaggtctggagtgggtctcagtccatcagttacaagtcgtacaaactntaactactacgcagtattttgaggaacgggtcctnttaccgaccatccgtaccgaacgtaagaaccaaaccggaccaaaggacgtctccgttacttcggtttacttacggctaagttagttcggaactaggtccctaggaacgcgacccgaacggaccgtcggcttacgtaatacttacgtcgtgacgagagtgggacggtcggtggcgtggtcgtacgtcggtacgaccttacg

SEQ ID NO: 7843 - DNA, 267 bp, Homo sapiens; identical to SEQ ID NO: 7822
  misc_feature: GYAE6OF02GLOMM.37.71.G05.1.454.CMB.1.raw
  modified_base (263)..(267): a, c, t, g, unknown or other
  misc_feature (263)..(267): n is a, c, g, or t

SEQ ID NO: 7844 - DNA, 537 bp, Homo sapiens
  misc_feature: GYAE6OF02GTUQR.37.71.G05.1.454.CMB.1.raw
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgcccgtcacccctggagacgccggcctccatctcctgcaggtctagtcagagcctcctgcagtggaaatggaacactaacttattggattggtatctgcagagccagggcagtccncacactcctnatctattcgggttctaagtccgggtccgtccggggtcctggacctaggttcaggtggacgtagtggatcgaggcaacgagtactttcactactaggaagtatacgagtccgaaggtaggtagggaggtccgtagggtaacggttagttgggttttaacgggg

SEQ ID NO: 7845 - DNA, 583 bp, Homo sapiens
  misc_feature: GYAE6OF02GM0NZ.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactcctccctcgccccgtccacccctggacgacgcccggcctccatcctcctgcgaggtctagtcagacgcctcctgcagtaggaaatcggaacactaacttagttggtattggtatctgacaagacgcgaggcagtcctccacactctagacttctagttcggttactaacgtccgggccgttccgggtccctggacgtacggttcagggtcggacgtaggtcgacgtcgaggtccagtacgtactttacgaaccgtacgtagtaaacgactacgaacgtacgaagggtggtacgggacggtaccggtagggtagggttaggtttagggttttaacgggg

SEQ ID NO: 7846 - DNA, 659 bp, Homo sapiens
  misc_feature: GYAE6OF02HSLYL.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtggggggaggtcgttgggtacagccgtgggacgggtccctggagactcctccgtgtgcatcgtctggattccaccttccgaaagtctttgacatgagcgtcgggtccgccgggcctccgagggagggtcgtgggaggttgggtctcactccatctagttacaagtcggtacaaacctatatactacgcagtattttggtaggaacgggcccgtcttaccacctacttcctaccacgaacgaaccgtaaccgacccgaaagacgtacctcttcttcgtttaccgtgtacctagttagtacggacgacgtccgtaggtacggaccggacccgaaccgggaccgccggtcctacgttaacttaacgttacgttcggtacggtacggtaaggtacggtcggggaccgggtcggggttcgggcggttcgggtcggtaccggttccgggttaccggtaccgtttaccg

SEQ ID NO: 7847 - DNA, 519 bp, Homo sapiens
  misc_feature: GYAE6OF02G185S.37.71.G05.1.454.CMB.1.raw
  modified_base (463)..(463): a, c, t, g, unknown or other
  misc_feature (463)..(463): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgccccgtcaccccctggagagccggcctccatctcctgcaggtctagtcagagcctctgcatggaaatggacacaacttattggattggtatctgcagaagccagggcagtctccacactcctgatctattcgggttctaagtcgggcctccgggtccctgactaggtcagtggcagtggatcgaggcacagtatttcacctacgtagaacgtntacagcgaaggtaggtagggagggtccttagggacgggtagttgggttttaagggg

SEQ ID NO: 7848 - DNA, 649 bp, Homo sapiens
  misc_feature: GYAE6OF02H0PE8.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtgggatattgtgatgcatcagtccccactctccctcgccccgtccacccctggagacgccggcctccatcctcctgctaggtctagtcagacgccctcctgcagtaggaaatcggaacactaactttagttggtaatttggtaattcgtgactaagaacgccgaggggctacgtcctaccaactaaccttcctagacttacgttaagtttccgggttactaacggttccgggtcccgttcccggggttcccctaggtaccgtagggtttaccgagggttcggacctagggttcggacttaccggacgggtaccaacgttaaggtacttttaccgaacttaccgttaaggaaacgtactaccgaaggtaccgtaagggtaacgggtacggggacggtaccggttagggaagggttaggtttgggttttaacggggg

SEQ ID NO: 7849 - DNA, 524 bp, Homo sapiens
  misc_feature: GYAE6OF02HK6BV.37.71.G05.1.454.CMB.1.raw
  modified_base (366)..(366): a, c, t, g, unknown or other
  misc_feature (366)..(366): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactcctccctgccccgtcacccctggagagccggcctccatctcctgcaggtctagtcagacgcctcctgcatggaaatggacactaacttattggattggtatctgcagaagccgagggcagtcnccacaactctagatctagttcggttactaacgtcgggccgttccggggtccctgacgtcggttcaggtgcgagtggatcgagcagagtactttcgactacgtagaagatacgagcgaaggaggtggacggtctagggaaggttgttggttttacgggg

SEQ ID NO: 7850 - DNA, 634 bp, Homo sapiens
  misc_feature: GYAE6OF02HAHI6.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactctccctcgccccgtcacccctggagacgccggcctccatcctcctgcacggtctagtcagacgcctctgcagtaggaaatggacaactaacttattggtattggtatcgtgcaagacgccgagggcagtctaccactacctctagattactagttccgggttactaacggtccgggcccgttcccggggtccctacggtacgtacggttcgaggttcggaccgtaggttggacttacggacgggtaccgaacgtaacggttaacttttacgaaccgtacgttaagggtaaacgtaagttaccgaacgtaacccggtaagggtacgggttacggggtacgggtaccggttagggtaacgggtttaggtttaggggttttttaacgggggg

SEQ ID NO: 7851 - DNA, 777 bp, Homo sapiens
  misc_feature: GYAE6OF02HC2KY.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtgggctgctaatgctcgtggtctctggatgcgtaggtgggtattagttgtgatgcatcgacgtccccactcctcctcgcccgtccacccgtggacgcgcccgcctccacttcctccgtgcgtacggttccgtagtccgaggtaccgtcccctccgtcgacctaaggtacggaaaacgtcggaacctaaccgttaaacgtttagttacgggtaatttacgggttaactccgtacggacgtaaacggaaacggcccggtaacggggacctaaccggttaccctaacccaaaccgttaaacccgtttccgttacggtaactttaccggtttaacggttttacccgggggtttaacttaaccggggttcccggggtacccccggtttccccgggggttacccttacgggtaaccggttacgggtttccgaagggtccgggtaacgtacgggttagggaaccttaccgggaggtaccctaacgttaaggttacctttaccgaaccggtacgtttacggaaacgtacgttccggaacgtacgagggtacggtacggggacggtccgttaaggggtaaggtttaggttttggggttttaacggg

SEQ ID NO: 7852 - DNA, 594 bp, Homo sapiens
  misc_feature: GYAE6OF02I1G3B.37.71.G05.1.454.CMB.1.raw
  modified_base (449)..(449): a, c, t, g, unknown or other
  misc_feature (449)..(449): n is a, c, g, or t
tcagtagtgtagatcacgaccggtgctcgatttagtgtcgtcgcaagagagaggggtcgaggctggaactgaggagcaggtgggggcgacttctccatctaacactctcccctgttgaagctctttgtgatcaggactcctcagttcaccttctcacaatgaggctccctgctcagctcctggggctgctaatgctctgggtctctggatgcagtggggatattgtgatgcatcagtccccatcctccctgccccgtcaccccctggagacgcccggcctccatcctcctgcaggtctagtccagacgtccctcctagccaagtcgggaaaatcggaactaaccgaactttagttggtatttaggtactcgtagcaaggacgccgaggggcagtcctccacaactcctgattctagttcgggtctaagtccgggccttcccggggtccngtacgtagggtttccagtcggctaggttggacttccgaagggtcccacgtaaggtacttttcccgaaccgtatacggtaaaagcgttacccgaagaccgttaggaggttcgggaaggtcctaggttacggggaatttttcggggg

SEQ ID NO: 7853 - DNA, 646 bp, Homo sapiens
  misc_feature: GYAE6OF02I8K14.37.71.G05.1.454.CMB.1.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (343)..(343): a, c, t, g, unknown or other
  misc_feature (343)..(343): n is a, c, g, or t
  modified_base (571)..(571): a, c, t, g, unknown or other
  misc_feature (571)..(571): n is a, c, g, or t
tcagtagtgtagatcacgaccggtgctcgatttagtgtcgtcgcaagagagaggggtcgaggcgtggaactgaggagcaggtgggggcgacgttctccctctaacactctcccctgttgaagctctttgtgtatcaggactctcagttcaccttctcacaatgaggctccctgctcagctcctggggctgctaatgctcgtgggtctcttggatgctaggtggggatagttggngattgnatcacgttccccatcctccctcgcccgtccaccccgtggacgcgcccgcctccactcctcctcgctacgggtcctacgtaccaggaccgtccctccgtgaccngtacggaaatcggacactaacttagttgagttagtatcgactgaacgagccagggactgttcctacccaactacctcctaggtacttcgttagttcggttactacggtaccgggtcccgttccggggttaccctaggtaccgttagttccggaagggttccgacggtagggttaccgagttaccggaggtacctaagacgttaacgtttaccgacttacgtggaaacncggttaacgacggtacgtaacggtaggttacgggccgtaacggtgggtaacggtaggttgggtttttaacggggg

SEQ ID NO: 7854 - DNA, 508 bp, Homo sapiens
  misc_feature: GYAE6OF02IHOO2.37.71.G05.1.454.CMB.1.raw
  modified_base (322)..(322): a, c, t, g, unknown or other
  misc_feature (322)..(322): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (460)..(460): a, c, t, g, unknown or other
  misc_feature (460)..(460): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggatttttccttgttgctgttttagaaggagtccactgtgaggtacagctggtggaatctgggggagcttggtacagcctggagggtccctgagactctcctgtgcatcgctggattcaccttccgagcttttgacatgagctgggtccgccgggctcccagggaagggtctgggagtgggtcncatccatcagttacaatggtacaaaccatatactacgcagtatttgtgaaggccgcttcaccatctccagagacaacgcaagnctctctgtttcngcatagngacagctgagacgccgacgacgcgctctatattacngtcgcgagatgggacgcggtggcgtggtgaccgtcggtacgattaccg

SEQ ID NO: 7855 - DNA, 551 bp, Homo sapiens
  misc_feature: GYAE6OF02I1XP7.37.71.G05.1.454.CMB.1.raw
  modified_base (502)..(502): a, c, t, g, unknown or other
  misc_feature (502)..(502): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatattgtgatgcatcacgtccccactcctccctgccccgtcaccccgtggacgacgcccggcctccatcctcctgcaggtctagtcagacgcctcctgcataggaaatggaccaactaacttagttggatttggtatctgacagaacgccgagggcagtcctaccactaactcctagtacttcttagtttcgggttacttaacgtccgggtcccgtccgggtcccttggacgtggttcagtgacgtggtagactcgacgcacagtcttacacctagtagaacgtntacgaagcgaggaggtgggaagcggtaggaaggttagttgggtttaggg

SEQ ID NO: 7856 - DNA, 529 bp, Homo sapiens
  misc_feature: GYAE6OF02H2KMC.37.71.G05.1.454.CMB.1.raw
  modified_base (474)..(474): a, c, t, g, unknown or other
  misc_feature (474)..(474): n is a, c, g, or t
tcagtagtgtagatcacgaccggtgctcgatttagtgtcgtcgcaagagagaggggccttagccctggattccaaggcatttccacttggtgatcagcactgaacacaaaaggactcaccatggagttggggctgttctggattttccttgttgctgttttagaaggagtccactgtgaggtacagctggtggaatcgtgggggaggcttgggtacagcctgggagggtccctgagactctcctgtgcatcgtctggattcaccttccgagtcttttgacatgagctgggtccgccgggctccgagggaggtctgggagtgggtctcatccatcagttacaatggtacaaaccatatactacgcagtatttgtgagggcctcttcaccatctccagagacaacgccaagacgctctcttgtttctgcatatggacagcctgagacgccgacgacgcgctctatacttactgtgngagagtggacgggcggtggcgtggtcgaccgttcgggtacgtaccttcgtaaccg

SEQ ID NO: 7857 - DNA, 513 bp, Homo sapiens
  misc_feature: GYAE6OF02FNXO1.37.71.G05.1.454.CMB.1.raw
  modified_base (470)..(470): a, c, t, g, unknown or other
  misc_feature (470)..(470): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctccctgccccgtcacccctggagacgccggcctccatctcctgcaggtctagtcagagcctcctgcatggaaatggacacaacttattggattggtatctgcagaagccagggcagtctaccaacaactcctgacttctatttcgggttctaagtcgggccttccgggtccctgacgtggttcaggtgcaggtggatcgaggccacagtatttcactactagaagntcgagcgaggagtggaggtctaggaggtagttggtttacgggg

SEQ ID NO: 7858 - DNA, 573 bp, Homo sapiens
  misc_feature: GYAE6OF02HDJLM.37.71.G05.1.454.CMB.1.raw
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttgggtacagcctgggagggtccctgagactctcctgtgcatcgtctggattcaccttccgagtcttttgacatgagctgggtccgcgggctccgagggaggtctggagtgggtctcatcatcagttacatggtacaaacatatacncgacagtatttgngaagggcctnttcacatctacgagacacaacgccaagacgctctcttcgttctcgctatagtcgacaggcctggacgtacgcccgacggaccgcggtacctactaattacgttacgtgttcggacgtacggagttcggggaccgggtcgggtacgggtccgtggggttacgaccggttaccgggtccgtaccgttccgttaacccgg

SEQ ID NO: 7859 - DNA, 562 bp, Homo sapiens
  misc_feature: GYAE6OF02IEJQS.37.71.G05.1.454.CMB.1.raw
  modified_base (486)..(486): a, c, t, g, unknown or other
  misc_feature (486)..(486): n is a, c, g, or t
  modified_base (508)..(508): a, c, t, g, unknown or other
  misc_feature (508)..(508): n is a, c, g, or t
  modified_base (525)..(525): a, c, t, g, unknown or other
  misc_feature (525)..(525): n is a, c, g, or t
tcagtagtgtagatcacgaccggtgctcgatttagtgtcgtcgcaagagagaggggtcaggctggaactgaggagcaggtgggggcacttctccctctaacactctcccctgttgaagctctttgtgatcaggactcctcagttcaccttctcacaatgaggctccctgctcagctccgtggggctgctaatgctctgggtctctggatgcaggtggggatattgtgatgcatcacgtccccactcctccctcgccccgtacacccctggacgacgcccggcctccatcctcctgcaggtctagtcagacgccctctgctagtaggaaaactggaacaactaacttagtggtaattggtatctgacaagtaacgcgaggcagtccacacaactcctagactcttagtttcgggttactaaggtccggcccgttaccgggtccctagacgtaggttcaggttcgacgtagtgatcgacggcaaacgngtacttcgactacgtagaaacngtaccagaccgtaaggngtacgggagtcctagggacggtagttgggtttacggg

SEQ ID NO: 7860 - DNA, 522 bp, Homo sapiens
  misc_feature: GYAE6OF02J0KWE.37.71.G05.1.454.CMB.1.raw
  modified_base (329)..(329): a, c, t, g, unknown or other
  misc_feature (329)..(329): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
tcagtagtgtagatcacgaccggtgctcgatttagtgtcgtcgcaagagagagggggtcagactggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatattgtgatgcatcagtccccactcctccctgccccgtcacccccgtggacgacgcccggcctccatcctcctgccaggtctagtcagcgcctctgcatggaaatggacanaacttagtgattggtatctgcaagacgccgagggctagtctacacaactcctagatctagttcggttacagtccgggctccgggtcctgacnggtcngtgcagtgctacgagcacgagtacttcactacgtgaacgctaccgaggtacaaggtaggtcggaacggtcgtaggtacggtagttcggttttaggg

SEQ ID NO: 7861 - DNA, 605 bp, Homo sapiens
  misc_feature: GYAE6OF02IRH38.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactcctccctgcccgtcaccccctggagacgccggcctccatcctcctgcaggtctacggtcagacgccctcctcgcagtaggaaatggaacactaacttagttaggtattggtactccgacgaacgaacgccgaagggctacgtcctaccaacaaccttcctagacttcgttacgtttcgggttactaacgtccgggtcccgtccggggttccctcgacgtaggttcgaggtcggcgtaggtcggactcgaggtcaacgtagtacttttacaccgtacgttaggaacgtacgtacgaagaccgtaaggaggtaagggacggtcggttagggaaggtacggtttaggggtttaggggttttaacg

SEQ ID NO: 7862 - DNA, 567 bp, Homo sapiens
  misc_feature: GYAE6OF02HG2IA.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctcctggggctgctaatgctctgggtctctggatgcagtggggatattgtgatgcatcagtccccactcctccctgccccgtcacccctggacgacgcccggcctccatcctcctgcaggtctagtcagacgcctcctgcataggaaatggaacactaacttagttggattggtatctgacagaagccgagggcagtctccgactaactcctagactcgttacgttcggttactaacgtccgggccgttccggggtcctggacgtaggttcaggtcggctaggtcgatcgacggccaacgtagttacttcaactacgtagaagtactcgacgcgtaaggtggtagggacggtcgtagggtaagggttagtttagggtttaggggttttaacg

SEQ ID NO: 7863 - DNA, 833 bp, Homo sapiens
  misc_feature: GYAE6OF02GX619.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagctagtgggtaccgtcagacgtctcctcgtgcgactacgtcgtgtaggtacttcctacccgttcgacgtttcgttttacgaacttgtacggacgtcgggttccggggtccccggccgggtcccgtaacggggaagggggtacggttcggtagggtacggggttcggttcctacgtaccgtacctagttacggttaaacgttaaaccgtaaggttccggtaaaacccaaaacgttattaaaccgttaaccgtaacgacgtaagttttaggttttacgggaacggggtaacccggggtcccttacctttaacccgaaccttcgttaccccgtaccggaaaggtaaaccgaaaacccgtaacccggaaacccgtaaagggtccgttaccctttcccgtttccggttttacggtttaccgacgtaacttaagttacggtaccggaaccgttaccggtacccggttagggaacgggtacccggaaccccggtaacggtaccccgggccggtttaccttaacgtttaaacgttacgtttacggtcggtacggaaccgtaaggtacggtcgggaccgggttggtcggtacggttcggtaccgtaccgggttccggtacgttacccg

SEQ ID NO: 7864 - DNA, 521 bp, Homo sapiens
  misc_feature: GYAE6OF02GM9RK.37.71.G05.1.454.CMB.1.raw
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatctgggggaggcttggtacagcctggagggtccctgagactctcctgtgcatcgtctggattcaccttccgagcttttgacatgagcgtgggtccgccgggctccgaggggaagggtcgtggagtgggtctcgatccatcagttacaatgtacaaaccatatactacgcagtattttgtagaacggccgcttcacatctcagagacaacgcaagagctctctgtttcngtactatatcgacngcctgagacgccgacgcgcgtctctatatactgtgacgtagagtaggacggtcggtggcgtggtgccgtcggtcgtacgttaccg

SEQ ID NO: 7865 - DNA, 297 bp, Homo sapiens
  misc_feature: GYAE6OF02HES4R.37.71.G05.1.454.CMB.1.raw
  modified_base (292)..(297): a, c, t, g, unknown or other
  misc_feature (292)..(297): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnnnnn

SEQ ID NO: 7866 - DNA, 587 bp, Homo sapiens
  misc_feature: GYAE6OF02GCV46.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcacgtccccactctccctgcccgtcacccctggagagccggcctccatctcctgcaggtctagtcagacgccctcctgctagtagggtaaaactcggaacaactaaacttagtttcggaatttgggtatctgacagaacgccgaggctagtctaccaactaactctgatcttaagttccggttataacgtccgggccgttcccggggtaccctgaccgtaggttcaggtcgcgtagtggtactcgacggacaactacgtactttaccgactacgtaaggaacgttacgacgtaacgacgaaggtaggttcgggaacggtaccttgggaaaggttagtttacgggtttttaagggg

SEQ ID NO: 7867 - DNA, 291 bp, Homo sapiens
  misc_feature: GYAE6OF02IFGJK.37.71.G05.1.454.CMB.1.raw
  modified_base (288)..(291): a, c, t, g, unknown or other
  misc_feature (288)..(291): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttgggtttatactgcatgcaaggtctacaaactcctcggatcaccttcggccaagggacacgactggagattaaacgaactgtggctgcacatctgtcttcatcttcccgcatctgaactctacactactgagcggctggcaaggcgcatagnnnn

SEQ ID NO: 7868 - DNA, 529 bp, Homo sapiens
  misc_feature: GYAE6OF02ICNR0.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactcctccctgcccgtcacccctggagacgcccggcctccgatctccctggctagggtctacgtcagacgccctcctgctagtaggaaatggacaactaacttagttaggatttggtatctgcaagaagccagggcagtctccacaactctgatctattcggttctaacgtcggccttccgggtcctgactaggttcaggtggcagtgatcgaggcacgagtactttacactacgtagaagatacgagacaggtaggtggaggtcgtaggaggtagttggtttaacggg

SEQ ID NO: 7869 - DNA, 593 bp, Homo sapiens
  misc_feature: GYAE6OF02GWA6J.37.71.G05.1.454.CMB.1.raw
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (401)..(401): a, c, t, g, unknown or other
  misc_feature (401)..(401): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatgcaggtgggattattgtgatgcatcacgtccccactcctccctcgccccgtcaccccgtggacgacgcccggcctccatcctcctgccaggtctagcagcncctcgngcagtaggaatcggaactaactaacttagttggagtttggtatcgtgacaaggaacgcgaggctagtcctaccactacctctntactcgttagttcggtactacggtccgggtccgttcccgggtccaggtactcgggttcaggttcggactaggtcgactacgacggcaacgtagttaacgttacacgttacgtagtaaggtacctaggaacgcgtaaggtcgggtaacggacggtacgttaagggaacggtttaggttacgggttttaacggg

SEQ ID NO: 7870 - DNA, 600 bp, Homo sapiens
  misc_feature: GYAE6OF02JZSGS.37.71.G05.1.454.CMB.1.raw
  modified_base (573)..(573): a, c, t, g, unknown or other
  misc_feature (573)..(573): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagcctccgtggggctgctaatgctctgggtctctggatgcaggtgggatattgtgatgcatcacgtccccactcctcccgtcgccccgtccaccccgtggacgacgcccggtcctccactcctcctgcacggtctacgtcacgacgccctccgtgacagtaggaaatcgaacactaacttagttgattggtatcgtgacgaacgaacgtccgaaggtcacgtctaccgactaactctagtactcttacgttacggttactaacggtccgggtccgttacccggggttcctacggaacgttacgggttacacgggtcgacgtaggacgtacgtcgacgaccagacgttacttacgactacgtgaacgtaacgtacgaagcggtaagtacggcgggaacggngtacggaaggttcgttagggtttaagg

SEQ ID NO: 7871 - DNA, 587 bp, Homo sapiens
  misc_feature: GYAE6OF02IA4KT.37.71.G05.1.454.CMB.1.raw
  modified_base (230)..(230): a, c, t, g, unknown or other
  misc_feature (230)..(230): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
tcagtagtgtagatcacgaccggtgctcgatttagtgtcgtcgcaagagagaggggtcgaggctggaactgaggagcaggtgggggcgacgttctccctctaacactcctcccctgttgaagctctttgtgatcaggactcctcagttcaccttctcacaatgaggctccctgctcagctcctggggctgctaatgctctgggtctctggatgcaggtggggatagttgngatgcatcagtccccactcctccctcgccccgtcacccccgtggagacgccccggtcctccactcctcctgcaggtctagtcagcgcctcctgcagtgaaatggacactaacttntggnttggatcngcagacgccgagggcagtcctacgacctaactccgtagacttcgtagtttcgggtactaagtccgggcctcccgggtcctggactgtcaggtgcaggtgatcgaggtccacgtagtactttacgaccgtacgtagtaaacggacttacccgaaggaccgtaaaggtggggttacgggaacggggtaccttagggggtacggtaacgggttttgggtttttaaacgggggg

SEQ ID NO: 7872 - DNA, 297 bp, Homo sapiens
  misc_feature: GYAE6OF02F6X7N.37.71.G05.1.454.CMB.1.raw
  modified_base (285)..(285): a, c, t, g, unknown or other
  misc_feature (285)..(285): n is a, c, g, or t
  modified_base (291)..(297): a, c, t, g, unknown or other
  misc_feature (291)..(297): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtctcatcttcccgccatctgaatctacactactgagcgggctggcaaggcncatagnnnnnnn

SEQ ID NO: 7873 - DNA, 620 bp, Homo sapiens
  misc_feature: GYAE6OF02IFSKR.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctcctggggctgctaatgctctgggtctctggatgcagtggggattattgtgatgcatcacgtccccactcctccctgccccgtccaccccgtggacgacgcccggccctccatcctcctgcaggttctacgtcacgacgcctcctgcagtaggaaatggaaccaactaactttagttggtacttggtactcgtagacaggaacgccgaggggactacgtccacctaacaactcctgactctagtttcggtactaacgtccgggccgtcccgggttcctcggacgtacggttcgaggtcggcgtaggtcggacgtcgaggactaactacgtactttccgaacgtacgtacgaacgtacgtacgaacggtacgaagggttaacggtagggtacgggtaccggttagggaagggttaacggtttggggtttttacggggttttaacg

SEQ ID NO: 7874 - DNA, 568 bp, Homo sapiens
  misc_feature: GYAE6OF02GTNH9.37.71.G05.1.454.CMB.1.raw
  modified_base (321)..(321): a, c, t, g, unknown or other
  misc_feature (321)..(321): n is a, c, g, or t
  modified_base (463)..(463): a, c, t, g, unknown or other
  misc_feature (463)..(463): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctccgtggggctgctaatgctctgggtctctggatgcaggtggggattattggtgatgcatcacgtccccactcctccctcgcccgtccaccccgtggacgacgcccggcctccatcctcctgacaggtctagtcagacgcctccngcagtaggaaatggaacactaacttagttggattggtatctgacagaacgccgagggcacgtcctacaactactcctgactcttagttccggttactacgtccgggccgtccgggtccctgacgtggtcaggtcggcgtagnggacgtcgaggacacgtagtactttcaacctacgtagaacgtatcgacgtacgaaggtaggtagggacgtcgtagggtaggtaggtttcggtttagggttttaac

SEQ ID NO: 7875 - DNA, 648 bp, Homo sapiens
  misc_feature: GYAE6OF02JLKQV.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctgggctgctaatgctctgggtctcgtggatgcagtgggatattgtgatgcatcagtccccactctccctgcccgtcacccctggacgacgccggcctccagtcctcctgcgtaggtctagtcagacgcccttcgcgcagttacggaaaatcggaacaacctaaacgttagtttaggtagtttacgggttattcgtaggtaccaagaacgtccgaagggtcacggttcctacccgaactaacctccgtagtacgttcttaacgtttcgggttaccttaaagtcccggggtacccgttcccgggggttacccttacggaaccgtacgggtttccaagggttcgacggtacggtggtacgttacgacggtcaaccggtataccgtttcaaccgtacgtggtaaacgacgttacacggtaccgagtagggtacggtaggtccgtaggacgggttagtttggggttttaacggg

SEQ ID NO: 7876 - DNA, 563 bp, Homo sapiens
  misc_feature: GYAE6OF02GVFV4.37.71.G05.1.454.CMB.1.raw
  modified_base (509)..(509): a, c, t, g, unknown or other
  misc_feature (509)..(509): n is a, c, g, or t
  modified_base (528)..(528): a, c, t, g, unknown or other
  misc_feature (528)..(528): n is a, c, g, or t
tcagtagtgtagatcacgaccggtgctcgatttagtgtcgtcgcaagagagaggggccttagccctggattccaaggcagtttccacttggtgatcagcactgaacacaaaggactcaccatggagttggggctgttctggattttccttgttgcttgttttagaaggagtccactgtgaggtacagctgggtggaatcgtggggggagcttggtacagcctgggacgggtccctggagactctcctgtgcatcgtctggattcaccttccgagtcttttgactatgagctgggtccgccgggctccgagggagggtctgggagtgggtctcatccatcagttacaagtggtacaaacctatataactacgacagtattttgtggaacgggccgtcttcacctactctaccagacgaactaaaccgacctaagacgcctctcttgtttctgacatactggacacgtcctagagacgccgacgacgcggctactataatctgtagcgagngtacgggacggcggtaggngttcgggcgtaccgtcgggtcgtactcgttaaccg

SEQ ID NO: 7877 - DNA, 677 bp, Homo sapiens
  misc_feature: GYAE6OF02HJT6R.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatgcaggtgggatattgtgatgcatcacgtccccactcctccctcgccccgtccacccctggacgacgcccggcctccactcctcctgctacggtctagtcagcgccctctgactagtaggaaatcggaacaactaaactttagttggtagtttaggtatcgtgacaagtaacgccgaggctacgtccacctaacaacctcctagtacttcgttagtttccgggttactaacggtcccgggtcccgttcccggggttcctaggtaccgtagggtttccgagggttcggacgtacgggttacggaactccggtaacgggtcctaaaccggttagttaaccgttttaccgaaccgtaacggttaggaaaccgtaacttcccggaaaggtacccgaaaggggttagggttacggggaacgggttcggtaacgggttaaggggtttaccggttttggggttttaaccggggg

SEQ ID NO: 7878 - DNA, 589 bp, Homo sapiens
  misc_feature: GYAE6OF02HS9FT.37.71.G05.1.454.CMB.1.raw
  modified_base (553)..(553): a, c, t, g, unknown or other
  misc_feature (553)..(553): n is a, c, g, or t
tcagtagtgtagatcacgaccggtgctcgatttagtgtcgtcgcaagagagaggggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggattattgtgatgcatcagtccccactcctccctgccccgtcaccccgtggacgcgcccggcctccacttcctcctgctaggtctagtcagcgcctcctgcataggaaatggaacaactaacttattggatttgggtactcgtagcgaagaacgcgagggtcacgttcctacccgaacctaactccgtagacttcttagtttcgggttactaacggtcccgggccgttcccggggttaccctggtaacgtacggttcgaggtggctaggttgactcgacggcaacgtagtaactttcgacgtacgtagaagctcgaagtcgaaggaggtacggnggtccgtaggaagggttacgtttgggttttaacggg

SEQ ID NO: 7879 - DNA, 567 bp, Homo sapiens
  misc_feature: GYAE6OF02H9DO4.37.71.G05.1.454.CMB.1.raw
  modified_base (278)..(278): a, c, t, g, unknown or other
  misc_feature (278)..(278): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
  modified_base (396)..(396): a, c, t, g, unknown or other
  misc_feature (396)..(396): n is a, c, g, or t
  modified_base (522)..(522): a, c, t, g, unknown or other
  misc_feature (522)..(522): n is a, c, g, or t
tcagtagtgtagatcacgaccggtgctcgatttagtgtcgtcgcaagagagagggggtcaggctggaactgaggagcagggtgggggcacttctccctctaacactcctcccctgttgaagcttctttgtgatcaggactcctcagttccaccttctcacaatgagcctccctgctcagcctccgtggggctgctaatcgctcgtgggtctcgtggatgcgaggtggggattagttgtgatgcatcactcccactcctcctcgccctcaccctggacncgccgcctcactctcctgcgagtctagcagacncctngacagtacgaagtcgaactaactaattagtggtatcgtatcgngacgaagacggccgaggatacgtacacacaactcgtanatctagttcgttacgtacgtcggaccgtccgggtcctagacgtagtcgacgtggtacgtagtgtaacgtcgacggtacacgtagtacgttacacgtacgtagaacgaacgtacgagcgtaacgggnggttaaggacgggtactagggtaaggttacggtttgggtttaagg

SEQ ID NO: 7880 - DNA, 606 bp, Homo sapiens
  misc_feature: GYAE6OF02JYKAB.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatattgtgatgcatcacgtccccactcctccctgccccgtcaccccgtggacgacgcccggcccttccacttctccctgctacggtctacgtcagctcctctgacagtcggaaatcggacaactaacttagttaggtacgttaggtatcgtgacgtaagaagccgagggctagtcctaccgaactaaccttcctagacttctacgtttcgggttacctaaggtccgggacccgttccgggtccttaggacgtaggttcagggttcgcgaggttcgactacggacgtcgaacgtacgtagtttaccgaccgtagtacggaagtaacttcgaacggtacgaggtaaggtcgggacggtccgttagggaagttacggtttagggtttacggg

SEQ ID NO: 7881 - DNA, 617 bp, Homo sapiens
  misc_feature: GYAE6OF02GGP2B.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctcgtggatgcaggtgggatattgtgatgcatcacgtccccactctccctgcccgtcacccctggacgacgcccggcctccatcctcctgcgaggtctagtcagacgcctcgtgcagtaggaaatggaacacctaactttagtaggtatttggtatcgtgacaagacgcgagggcagtcctacacactcctagtactcgttagtttccgggttactaacggtccgggtcccgttcccggggtacctggaccgtaggttccgaggttcgggacgtaggtacggacttacggagggtacctaacgtacgttactttacgaccgtacgtaggaacggtcgtacgaacggtacgtaagggtacggttacgggaagggttccgtaagggtacgggtttacggtttaggggttttaacgggg

SEQ ID NO: 7882 - DNA, 644 bp, Homo sapiens
  misc_feature: GYAE6OF02HLZE9.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctccctgttgaagctctttgtgatcaggactcctcagttcaccttctcacaatgaggctccctgctcagctcctggggctgctaatgctctgggtctcgtggatgcaggtggggtatattgtgatgcatcacgtccccactcctccctcgcccgtccaccccgtggacgacgccggcctccactctcctgctaggtctagtcagacgtcctctcgctagtagaagtcggactaactaacttagttggtaatttggtattcgtagacaaggtaacgccggagggacctacggttcctaccaacctaaacctccgtagtactttccttaaggtttaccgggttacgttaaacggtccggggtacccggttcccggggtccctacggtacgtaacgggttcgtaacggttcgggacgtacgggttacggacttacggaacggtactaacgtagtactttacaacgtacgtagaacgtactacgaacgagtaaggtaggtacgggtacggacgtagggtagtacggtttaggttttaacgggg

SEQ ID NO: 7883 - DNA, 300 bp, Homo sapiens
  misc_feature: GYAE6OF02JC0CL.37.71.G05.1.454.CMB.1.raw
  modified_base (294)..(300): a, c, t, g, unknown or other
  misc_feature (294)..(300): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatccttcccgcatcctgatctacactactgagccgggctggcaagggcgcatagnnnnnnn

SEQ ID NO: 7884 - DNA, 633 bp, Homo sapiens
  misc_feature: GYAE6OF02I22RD.37.71.G05.1.454.CMB.1.raw
  modified_base (424)..(424): a, c, t, g, unknown or other
  misc_feature (424)..(424): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactctccctgcccgtccacccctggacgacgcccggcctccgactcctcccgtgccgacgggttctacggtcacgacgtccctcctgccacgttaggaaactcgggaacaaccgtaaacttagttcggtatttgggtatctagactaagaacgccgagggcctagtccaccaacacctctanactcttagtttcgggttacaacgtccggggtcccgttccgggtcctagtaccgttacggtcacggttggacgaggtagggtacttaccgaacggcctaacggtacgttacgttttacgaactacgaaggtaacgaaccgttacgaaaggctaagggtacgttacgggacgggttacgacgggtaaggtgtttaggggtttttaacgggg

SEQ ID NO: 7885 - DNA, 651 bp, Homo sapiens
  misc_feature: GYAE6OF02J1KY5.37.71.G05.1.454.CMB.1.raw
tcagtagtgtagatcacgaccggtgctcgatttagtgtcgtcgcaagagagaggggtcgaggctggaactgaggagcaggtgggggcacgttctccctctaacactctcccctgttgaagctctttgtgatcaggactcctcagttcaccttctcacaatgaggctccctgctcagctcctggggctgctaatgctctgggtctcgtggatgcaggtggggattagttgtgatgcatcacgtccccactctccctcgcccgtcaccccgtggacgacggcccggcctccgacttcccgtcccgtgccgtaggttcctacggtcaggacgcccttccgtgccagttaggaaaacgtcgggaaccaacttaacgtttaagttgggtaactttgggtacttcgtgacaacggaacgtccggagggccgtagtaccctcccaacgaaccttccgtacgtatttccgttagtttccgggttataaccggttccggggaccttccccggggtacctacggtacggtacggttccgtagggtaggtccgtaagggtcggtaatccggaaggtcctaacgtagtacctttaccgactacgtacgtaagctacaggacaggtaggtaggacgcggttaggaggttagttgggtttacggg

SEQ ID NO: 7886 - DNA, 722 bp, Homo sapiens
  misc_feature: GYAE6OF02H2WF6.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctcgtgggtctcgtggatgcaggtggggatagttgtgatgcatcacgtccccactcctccctcgccccgtccaccccgtggacgacgccggtccctccactcctccgtagccgtaggttctagtcacggacgtcccttccgtagactaggtaggtaaacgtcggaaccaacgttaaacgtttgttacgggtagtttacgggttaacttcgtaggtaccgtaaaggaaaccggtaccggtaaggggaccgtaacgttaccctaccccgaaactaaacccgttccgttaaggtactttacggtttacggtttaccgggtttactaaccgggttccgggtcccggttcccggggttaccctacgggtaccgttagggtaccgtagggttcggacgtagggtacggtactaccggacgggtacacggttaacgttactttaccgaaccttacgtaagtacgtacgtaacgacggtacggaaggcgggtacgggacggtcgtaagggtaggtttaggtttgggtttttaacggg

SEQ ID NO: 7887 - DNA, 640 bp, Homo sapiens
  misc_feature: GYAE6OF02I3IDZ.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggctccctgctcagctccgtggggctgctaatgctctgggtctctggatgcaggtgggatattggtgatgctatcacgttccccactcctccctcgccccgtaccaccccgtggacgagcccggcctccagtcctccgtgctaggtctagtcgagacgtcctcgtgactagtaggaaatcggaacaactaacgtttagtgtaattggtatcgtgacgtaagaacgcgaacgggcagtcctaccaacgaactccgtagacttacctagttccgggttaactaacggtccgggtcccgttccggggtccctaggaaccgttcggttacgtaggttcggacgacggttacggtactcggaccgggactaacgtagtacgtttaccgaacgacgttaaggacgtaacgttgaacggtaccaagggttacgggtaacggtacgggtacgttaacgggtaaggttagttttcggggtttaaggg

SEQ ID NO: 7888 - DNA, 560 bp, Homo sapiens
  misc_feature: GYAE6OF02IOF63.37.71.G05.1.454.CMB.1.raw
  modified_base (390)..(390): a, c, t, g, unknown or other
  misc_feature (390)..(390): n is a, c, g, or t
  modified_base (505)..(505): a, c, t, g, unknown or other
  misc_feature (505)..(505): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgtttttagaaggagtccactgtgaggtacagctggtggaatctgggggagcttggtacagcctggagggtccctgagactctcctgtgcatcgtctggacttccacctttccgagtcttttgactatgagcgtgggtccgccgggctccgagggaagggtctgggagtgggtctcactccatcagttacaagttgtacaaaccatactactacgcagtatttgaggaacggcctnttaccacctatcctaccagacgaaccaacgccaaagacgtctctcttgtttctgtctatacgtcgaactcgcctgagacgaccgacgacgcgctactatagttctgtcgacgagngtacgggcggtcggtggtcgtgggttcgtacgtcgggtacgtacgtacgttaccg

SEQ ID NO: 7889 - DNA, 640 bp, Homo sapiens
  misc_feature: GYAE6OF02FHJYN.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggacctctcagtctaccttctcacaatgaggctccctgctcagctccgtgggctgctaatgctcgtgggtctcgtggatgcgaggtgggtattagttgtgtatgactactcaccgtccccactcctccctcgccccgtccacccgtggacgacggcccggtcctccacttcctcctgcgtacggtctacgtcgagactcctcgtgacagtaggaatgaacactaattagtgtagtttagtactcgtcgacaacgacgcggacggactacgtccgtaccaaactaccgttcgagtacttcgttaggtttccggttaaacaccgggtcccgggtcccggttccgggtacctaggtacgttcggttagacggtcggacgtagggtcgtagtaccggacgaccaacgttaagttccttaccgaaccgttagaacggaacgtacacgaacggtcgaagggttcggacggggtaagtccggtagggaacggtttaggtttaggggttttaacgg

SEQ ID NO: 7890 - DNA, 695 bp, Homo sapiens
  misc_feature: GYAE6OF02HHW16.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgaatcacgtccccactcctcccctgccccgtccacccccgtggacgacgcccggcctccatcctcctgcaggttctagtcagacgccctcctgcaagtggaaatggaacactaacttagtggtattggtatactacaagaacgccgagggctagtcctacccaacaaccttcctagtacttaccgtttacgtttccggggttactaaacggttcccggggtacccgtttaccccgggggtcccttaggtaaccgttacgggtttaccgagggttcgggaccgtagggttacgggtaacttccggaacggacctaacgtaaggttaacctttttaccgaaccgtaacgttaggaaacgttacttaccggaaggtaccggtaaagggtaacgggttagggaacgggtcgttaacggggtaagggttacggttttacgggggtttttaggggtttttaattaacccggg

SEQ ID NO: 7891 - DNA, 271 bp, Homo sapiens
  misc_feature: GYAE6OF02F1PSS.37.71.G05.1.454.CMB.1.raw
  modified_base (239)..(239): a, c, t, g, unknown or other
  misc_feature (239)..(239): n is a, c, g, or t
  modified_base (265)..(271): a, c, t, g, unknown or other
  misc_feature (265)..(271): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatccttcccgcatctgaatctacactacngacgcgggctggcaaggcgctatagnnnnnnn

SEQ ID NO: 7892 - DNA, 614 bp, Homo sapiens
  misc_feature: GYAE6OF02IBC9A.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtgggattattgtgatgcatcacgtccccacttcctccctcgccccgtcacccctggacgacgcccggcctccattcctcctgcaggtctagtcagacgcctcctgacagtggaaatcggaacactaacttattggtacttggtaatcgttcgacaacgtaagcccggagggtacacgtcctaccgaactaaacctcctagtacttaccgttagtttccgggtttactaacggtccgggtcccttcccggggtacctgtaaccgtggttacagggttcgacgtacggtggactacggaggtccaacgtagttacctttagacctaccgttaggtaacgaacttacgagtaccgaggaggtagggacggtacttagggaaggttggttaggttttaacgggg

SEQ ID NO: 7893 - DNA, 616 bp, Homo sapiens
  misc_feature: GYAE6OF02HN6RZ.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatattgtgatgcatcacgtccccacttcctccctgccccgtccacccctggacgacgcccggccctccactcctccctgcgtacggtctagtcagacgcccttcctgccagtaggaaacgtcggaaccaactaacgttagttggtaagttggtatcgtgacaagaacgccgagggactacgtcctccgaactacctctagtacttcgttaacgttccgggttactaacggtcccgggtccgttcccggggtacctcggtaccgtgttcgacggtgacgtaggtcgactcggacgtcacgtacgtactttacgactacgtagtaacgtacgtaccgaggtacgtaggtacgggtagggacggtacgttagggacgggttagtttaggggttttaacgggg

SEQ ID NO: 7894 - DNA, 773 bp, Homo sapiens
  misc_feature: GYAE6OF02HWEB3.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtgggctgctaatgctcgtggtctctggatgcaggtgggatagttgtgatgcatcacgtccccactcctcccgtcgcccgtccaccccgtggacgacgcccggcctaccactcctcctgcctacggttcctagtcagacgccctccgtgctagtaggtaaaatcggaacaactaaaccgtttagttagggtaatttagggtttacttacgtagacgtaaaggtaaacgacccgggtacgggtacctaacggtttccctaacctaaccgtaaaccttcccggtttagaaacctttacgtttaacggtttaccggggtttaaccttaaaccgggtttcccgggggtaacccccggttttcccgggggttaccccttaacgggtaaaccccgtttagggggtttacccaacggggtttgggaacccggttagggtttacgaacggttacccggaacgggtaacctaacgtaacggtaccttttaaccgaacgttacgtacggaaacggtaactaccggtacgtaacggaaagggtacggtacggggtaaccggtaccggttaaggtaacgggtttcgtttaaggggttttaacgggg

SEQ ID NO: 7895 - DNA, 578 bp, Homo sapiens
  misc_feature: GYAE6OF02HGDQ7.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctgggagggtccctgagactctcctgtgcatcgtctggattcaccttccgagtcttttgacatgagctgggtccgccggctccgagggaggtctggaggtgggtctcatccgatcagttacaagtggtacaaaccataactactaacgcacgtattttggagaaggggtcccgtcttaccacctactcctaccagacgaacaaccgaccaaagacgtcctctacttgtttctgctactagttcggacacgtccgtgacgacgccgacgacgcgtctactattacgttactgtcgcggtagtacggtcgggaccgggtcggtggcgttgggtccgtacggtccgggtaccgtacgttaacccg

SEQ ID NO: 7896 - DNA, 709 bp, Homo sapiens
  misc_feature: GYAE6OF02JUI5N.37.71.G05.1.454.CMB.1.raw
  modified_base (344)..(344): a, c, t, g, unknown or other
  misc_feature (344)..(344): n is a, c, g, or t
  modified_base (523)..(523): a, c, t, g, unknown or other
  misc_feature (523)..(523): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtgggctgctaatgctcgtggtctcgtggactgcgaggtgggattagttgtagtatgctatcacgtccccactcctcccgtcgccccgtccaccccgtaggacgacgcccggtccctaccgacttcctaccgtcgccgtacgtctacgtcgagtccgccctcgtnacgtagtagaacgtaggaaccaactaacttagttcggtatttagggtatccgtagacgaagaacgtacggacggactacgtacctacccgaactaacccgtcgtagtaccgttcgtttaacggtttacccgggttaaccaccggggttaccggtccccggtttacccgggggttacccnggtaacccgttacggggttacaaccgggttggtaaccgagggttcgggtaactacccggaggtaaccgttacgaaacgtttaccgtttaaccaccgttaccgaaggttaaccgtgttaccgaggtaaccgaggtaccgggaggtaccggtgtaaggtaacgggttaggttttaggtttaaaccggg

SEQ ID NO: 7897 - DNA, 682 bp, Homo sapiens
  misc_feature: GYAE6OF02H4XDB.37.71.G05.1.454.CMB.1.raw
tcagtagtgtagatcacgaccggtgctcgatttagtgtcgtcgcaagagagagggggtcaggctggaactgaggagcagggtgggggcacttctccctctaacactctcccctgttgaagctctttgtgatcaggactcctcagttcaccttctcacaatgaggctccctgctcagctccgtggggctgctaatgctcgtgggtctcgtggatgcgaggtggggattagttggtgactgactatccaccgtcccctacttccctcctccgccccgtccaccccgtggacgacggccggccctcacgttcctccgtgcgtacggtctacgtcgacgaccgtcctccgtcgacagtacggaaagtacggaacctaactaacgttagttaggtattcggtatcgtagacgaagacgacggacggctacgtccacaacctaccgttctagtacttacgttacggttacgggttacctaacggggttcccgggtcccggttaccccggggttcctaagggtaccggttaggttcgacgggttcggcggtagggttacggactaaccggcggtaactacgtaggttacttccgaaactacgtaaggtacgtacgtacgacggaacgtagggtacggttacgggaagggtccggtaagggttaaggtttcggtttaacgggtttacggg

SEQ ID NO: 7898 - DNA, 588 bp, Homo sapiens
  misc_feature: GYAE6OF02I6KP8.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctcctggggctgctaatgctctgggtctctggatgcagtggggatattgtgatgcatcacgtccccactcctccctgccccgtccacccctggacgacgcccggcctccatcctcctgcaggtctagtcagacgccctcctgcctagtacggaaagtcggaaccaactaactttagttggtattggtatcgtgcagaacgcgagggctacgtcctaccactaacctctgacttcgttagtttcgggttactaaggtccgggcccgttccgggtccctagacgtaggttcaggtcggctggtcgtagtcgaggcacgtagtacttcgaactacgtagaactacgtcgaagcgtaaggtacggttaggggacggtcgtagggtaacgggtagtttaggggttttagggtttaacg

SEQ ID NO: 7899 - DNA, 606 bp, Homo sapiens
  misc_feature: GYAE6OF02HDGS5.37.71.G05.1.454.CMB.1.raw
  modified_base (545)..(545): a, c, t, g, unknown or other
  misc_feature (545)..(545): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttcttacaatgaggctccctgctcagctccgtggggctgctaatgctcgtgggtctcgtggatgcgaggtggggattagttgtgatgacatcacgtccccactcctcccgtcgcccgtccaccccgtggacgacgcccgcctcactctcctgcgtaggtctagtcacgacgtcctctcgctaagtaggaaacgtcgaactaactaactttagtaggtattggtactcgtacgacgagaacgccgaggactacgtcctaccaactaccttcgtagtacttcgttaggttaccggttacgtaaccggtccgggtcccgtacccgggttcctagacggttgttaccaggtcgcgtagtggactcgacggtacaatacgttactacgacgtagtagaacnctaacgagcgaaggtcggtaggagtcggtaggtaaggtttgtttagggttttaggttaacg

SEQ ID NO: 7900 - DNA, 558 bp, Homo sapiens
  misc_feature: GYAE6OF02H5508.37.71.G05.1.454.CMB.1.raw
  modified_base (394)..(394): a, c, t, g, unknown or other
  misc_feature (394)..(394): n is a, c, g, or t
  modified_base (458)..(458): a, c, t, g, unknown or other
  misc_feature (458)..(458): n is a, c, g, or t
  modified_base (497)..(497): a, c, t, g, unknown or other
  misc_feature (497)..(497): n is a, c, g, or t
tcagtagtgtagatcacgaccggtgctcgatttagtgtcgtcgcaagagagaggggccttagccctggattccaaggcatttccacttggtgatcagcactgaacacaaaaggactcaccatggagttggggctgttctggattttccttgttgctgttttagaaggagtccactgtgaggtacagctggtggaatcgtggggggagcttggtacagccctggagggtccctgagactctcctgtgcatcgtctggattcaccttccgagtcttttgacatgagcgtgggtccgccgggctccgagggaagggtctgggagtgggtctcactccatccgagttacaagtggtacaaaacctataagtactacgacagtatttgtagagggtccncttcaccatcctccagacgacaacgccaagagctctactgtttctgcatatggacagcctaganacgccgacgacggcgctcgtattactacgtgtgcgtagngtacgggacggtcgggtcggcgtcggtcgtaccgttccgggtactacgttaccgttaaccg

SEQ ID NO: 7901 - DNA, 535 bp, Homo sapiens
  misc_feature: GYAE6OF02GVBGC.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccactctcccctgccccgtcacccctggagagccggcctccatctcctgcaggtctagtcagagcctcctgcatggaaatggacacaacttatggattggtatctgcagaagccaggcagtcaccacaactcctgactcttagttcgggttactaacgttccgggccgttcccggggtccctaggaccgtagggttcaggtcggcaggtcggatcgagggccaacgagtacgtttacactacgtgaagtatacgagcaagaggtaggacggcgtaggacggtagtggttttacgggg

SEQ ID NO: 7902 - DNA, 606 bp, Homo sapiens
  misc_feature: GYAE6OF02FHGZS.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctccgtggggctgctaatgctctgggtctcgtggatgcaggtgggatattgtgatgcatcagtccccatcctccctcgcccgtccaccccgtggacgacgcccggccctccacttcctaccctgccgaggtcctaggtcaaggacgtccctccgtgctagtacgggaaattcgggacctaactaacgtttattcgggatttggtatcgtggcaagaacgccgagggcagtctccacactctgtactctagttcggttactacggtccggccgttccgggtcctggacgtacgggttcgaggtcgacgtaggtacggtactacggacgcgaacgtacgtacgtttaccaacgtacgtagaacgagtcggagtaccgaaggtagggtacggacggtacgtaggtaaggtgtttacgggtttaggggtttaacc

SEQ ID NO: 7903 - DNA, 615 bp, Homo sapiens
  misc_feature: GYAE6OF02HPK2E.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctcctggggctgctaatgctctgggtctctggatgcaggtggggattattgtgatgcatcacgtccccactcctccctcgcccgtcaccccgtggacgacgcccggcctccgatcctcctgcgaggtctagtcagacgcctcgtgacagtaggaatggaactactaactttagttggtacttggtatcgtgcgagaacgcgagggcagtcctcactaacctcctgtatcgttacgttcggtactacgtccgggtccgttccgggtcctcggacgttcggttcaggtcggactaggtaggactcgaggtaccagtacgttacttaccaacgtacgtaggaacgtacgttacaaggtaccgtaagggtacgggtacggggaaacggttcgttaggggaaacgggtttacggttttacgggggttttaaggggttttttaacg

SEQ ID NO: 7904 - DNA, 266 bp, Homo sapiens; identical to SEQ ID NO: 7622
  misc_feature: GYAE6OF02INCDA.37.71.G05.1.454.CMB.1.raw
  modified_base (262)..(266): a, c, t, g, unknown or other
  misc_feature (262)..(266): n is a, c, g, or t

SEQ ID NO: 7905 - DNA, 602 bp, Homo sapiens
  misc_feature: GYAE6OF02HUTMU.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcagtccccactcctccctgccccgtcacccctggacgacgccggcctccatctcctgcaggtctagtcagacgcctctgcataggaaatggacaactaacttatggattggtatctgactagaacgccgagggctagtccgtaccaacaacgtcctagacttcttagtttcgggtacttaacggtccgggtaccgttcccggggttcccgtgaccgtaggttcgaggtcggacgtaggtaggacgtacgacggtacaacgtagtactttaccacgtacgttaggaaacgtataccgtaaggaccgtaagggaggtacgggtacgggtacgttacgggtaagggttaggtttaggggtttttaacggggg

SEQ ID NO: 7906 - DNA, 779 bp, Homo sapiens
  misc_feature: GYAE6OF02IM4WA.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgcttgttttagaaggagtccactgtgaggtacagctggtggaatcgtgggggagcttggtacagcctggagggtccctgagactctcctgtgcatcgtctggtacttccaccttccgagtcttttgacatgagcgtcgggtcccgccgggtctccggaggggtaaggggtcgtgggtaggtcgggtctacgtactcctatccgtacgttacaagttcggtaaccaaaaccgtattaactacctaaccgactaagttagttttggtaggaacgggtcccgtaccttaccgaccctacttccgtaccgaaggaccgaaccaaaccggaccctaaggaccgtccttaccttccgttgttttccctacgtaccctaagttacgtacgggtacctaacgggtccccgttaagggaaccggttaccgggaccccgggtaaccggggtaacccgggtcccgggttaccctttaaccgttaaacgtttaaaccgttttaccggttacgggttacggtaaccggggtaaggttaaccgggttacgggggggtaacccgggttccgggggttacgggtcggttacggggttccggtaacccggttcccggggttacccgttaacccgtttaacccgg

SEQ ID NO: 7907 - DNA, 741 bp, Homo sapiens
  misc_feature: GYAE6OF02JOOXV.37.71.G05.1.454.CMB.1.raw
  modified_base (248)..(248): a, c, t, g, unknown or other
  misc_feature (248)..(248): n is a, c, g, or t
  modified_base (399)..(399): a, c, t, g, unknown or other
  misc_feature (399)..(399): n is a, c, g, or t
tcagtagtgtagatcacgaccggtgctcgatttagtgtcgtcgcaagagagaggtgccttagccctggattccaaggcattccacttggtgatcagcactgaacacaaaggactcaccatggagttggggctgttctggattttccttgttgcttgttttagaggtagtccactgtgaggtacagctggtaggatcgtggggaggcttggtacaggcctggagggtccctggacgactctccgtaggngcagtcgtctggacttcaccttccgagtcttttacgactactgagctacgggtccgccgggtctccgaaggggaggtccgttggcggttcggtcgtcgactcccgagtcgtaaggttactaacgtggacctaaacacgtaatacttaccgntacggttaagttttcgacggaaacggggtccctaccgttaccgaactaaccgttcccggtacctaacggaacgtaaaccgaaccgggtacccaaacgggtacgtcttccgtaccgtttacgtttccgttacgccgtaacttagccggtaacgtacgtaccgttaggaacggtaccggacccgtaaaccggggaccggttacccggacgttaccggttaacttaacgtttaacccgtcggtttaagggaccggtaacggttaggtaccggggtaccggggtccgggttacggtcgggtacggtttccgggtaccggttaccggggttaccgtacccgtttacg

SEQ ID NO: 7908 - DNA, 654 bp, Homo sapiens
  misc_feature: GYAE6OF02GHJY4.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctctgggtctcgtggatgcaggtgggattattggtgatgcatcacgtccccactcctcctcgcccgttccaccccgtggacgacggcccggacctccatcctccgtcgcgtaggtcctagtcacgaccgcccctcgtcgacgtagtaaggaacgtacggaacctaacttaacgttagttcggtagttagtactcgtagaacgtaacgacggtacggaggacctacgtacctaccaaacgtacccgttctacgtacttcggttacgtttacggttacgtaaccgggtcccggtccgggttcccgggtaccgacgtacggttacggtacggtcggtcggacgtaggtacggtacacggtacggtacaacgttagttcctaccgaagtccgtaagagtcctaaggcgaagtacggtggacgggtacggtaggtaggtaaggtttacggtttgggtttaacggg

SEQ ID NO: 7909 - DNA, 621 bp, Homo sapiens
  misc_feature: GYAE6OF02GW7P7.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctcgtgggtctcgtggatgcaggtgggatattgtgatgaatcacgtccccactcctccctcgcccgtcaccccgtggagacgcccggcctccactctccgtgcgaggtctagtcagacgcctcctgcagtaggaaatggacactaacttagttaggtattggtactcgtagacgaagaacgccgagggctagtcctaccaactacctcctagattctagtttccgggttactaacggttcccgggcccgttcccggggtccctaggtaccgtacgggtttccgaggtcgggctacgggtaggacgttccgaggaccacgttaacggtactttaccgactacggtacgtaagtacgtacgaaggaccgtaaggtacggtagggtacgcgttagggaaggtttaggtttaggggtttacgggttttaacg

SEQ ID NO: 7910 - DNA, 657 bp, Homo sapiens
  misc_feature: GYAE6OF02G2FCX.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcacgtccccactcctccctgccccgtcaccccctggacgacgcccggcctccactcctcctgccaggtctagtcagacgcctccgtgctagtaggaaatgggaacctactaaactttagttacgggtagtttaggttattcgttggacaaggtaacgccggaaggggtaccaacgttcctacccaaccctaacctcccgttagtacttacgttaacggttttccggggtttacttaacggttcccggggtacccgttcccgggggttcccctaggtaccgtacgggttccgtacgggtggacgtagggtcggacgtcgacggacaactacggtactttacgactacgtacgaagtcgtacgacggacgaaggtaggtacgggacggtacgtacggggtaggttacggtttagggtttttacgggg

SEQ ID NO: 7911 - DNA, 679 bp, Homo sapiens
  misc_feature: GYAE6OF02ID95A.37.71.G05.1.454.CMB.1.raw
tcagtagtgtagatcacgaccggtgctcgatttagtgtcgtcgcaagagagagggggtcaggctggaactgaggagcagggtgggggcacttctccctctaacactctcccctgttgaagctctttgtgatcaggactcctcagttcaccttctcacaatgaggcctccctgctcagcctccgtggggctgactaatgctcgtgggtctcgtggatcgcgagggtgggattagttgtgatcgcatcacgtccccactcctccctcgcccggtaccaccccgtggacgcggcccggtccctacctctcctcctgctacggtctaggtcacgacgtccctcgtagcaagttagaagacggtaactaactaacttagtggaagtttcgtatcgtgacaaggaacggccgagggttacacgttaccacctaaccgtaacttcctgtaaccgttacgttacggttcggttactaacggtccggtcccggttcccggggtacctcggtaaaccgtgggttcgacggttagccggtaaggttcgtactaccgggacgaccgtaagtaacgtacctttaccgaataccgtaaggaaccgggtaataccggtaacggacggtaacgggtaaggtacgggtacggtacggttaagggttacgggtttagggtttacgggttttaacggg

SEQ ID NO: 7912 - DNA, 565 bp, Homo sapiens
  misc_feature: GYAE6OF02HBWNH.37.71.G05.1.454.CMB.1.raw
  modified_base (556)..(556): a, c, t, g, unknown or other
  misc_feature (556)..(556): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactctccctgccccgtccaccccctggacgacgcccggcctccattcctccctgcaggtctagtcaggcgcctctgcagtcggtaaaatgggaaccaactaactttagttgggtatttggtatcgtgcaagaacggccaggggcacgtcctaccacactccgtgacttcgtagtttcgggttactaacgtccggggacccgttccggggtccctggtactacgggttcaggtcggacaggttgatcgagctactacgtactttccacttctcaccgtataccaacgacgtcctgacgtaggtacctggacggtntaggtacgg

SEQ ID NO: 7913 - DNA, 770 bp, Homo sapiens
  misc_feature: GYAE6OF02FX044.37.71.G05.1.454.CMB.1.raw
  modified_base (225)..(225): a, c, t, g, unknown or other
  misc_feature (225)..(225): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatacttgnatgcatcacgtccccactctccctgcccgttcacccctggacgtacgcccggtcctccgatcctccgttcggaccgaggttcctacggtccgtaaggtaaccgtccccgttaccttggaccctaagttacggggtaaaactcgggaaccaaccgtaaactttacggttaggtactttagggtttaactcgttacgacgtaaaggtaaccggcccggtagggggtaacctaggtttaccctaccgaaccctaaaccgttcccgtaggtaactttccgtttaaggtttccccggggtttaataaacggttccccgggggtacccgtttacccgggggtaccccttaaggacccggttaggggtttaccctaaggggttccggacggttaagggttcggtaccgttaccgtacggggaccctagtaccggttagtttaccaaccgttacccgttaagaagttaccgtacgaaaccgggtgtaaccgggtaaggttcgggaacggttaccggtaacggaacgggttttacgttggggtttttaaccggg

SEQ ID NO: 7914 - DNA, 682 bp, Homo sapiens
  misc_feature: GYAE6OF02F5WMU.37.71.G05.1.454.CMB.1.raw
  modified_base (321)..(321): a, c, t, g, unknown or other
  misc_feature (321)..(321): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctggacgggtccctgagactctcctgtgcatcgtctggacttcaccttcgagtcttttgacatgagcgtcggggtccggcccgggtctccgagggggaagggtcnggggacggtgggttcctcactccatcaagttacaagtcggtaacaaacctataactactacgctagtattttaggnggtaacgggtccncttccaacctactcctccgaagaacgaccaaccgacgaaagcgacttcctcttagtttcctgtactattacgtacgggaacctacggcccgttagggaacgaacccgggtaccgtaaaccggaccgggtccgggtaccttaccgttaacgttaactttaccggtacggtcggtacggtaaggtacggtacgggggtaaccggggtacgggtcgggtcggttaggggtcggttaaccgggttccggttaccggtaccgttacccgttaaccgg

SEQ ID NO: 7915 - DNA, 620 bp, Homo sapiens
  misc_feature: GYAE6OF02JBPZB.37.71.G05.1.454.CMB.1.raw
tcagtagtgtagatcacgaccggtgctcgatttagtgtcgtcgcaagagagagggggtcgaggctggaactgaggagcaggtgggggcacttctccctctaacactctcccctgttgaagctctttgtgatcaggactcctcagttcaccttctcacaatgaggctccctactcagctccgtggggctgctaatgctcgtgggtctcgtggatgcgaggtggggattagtttggtgatgcatccacgtccccctactcctcccctcgccccgtaccaccccgtgggacgacggccccggtccctccactcctcccgtgccgacggttctacgtcgacgacgccctctcgacagtaggaaagtcggacactaactttagtaggtagttggtatcgtagcgaagacgcgaggcagtcctaccacgtaacctcgtagtacttcgttacgttccgggttatacggtccgggtacccgtccgggtctgaacgtgttcgagtcgcgagttggacttacggcgacacgtaattcgttagaccgtattcggaaatccgtgaacgtaggaacggagggttaccggacggttcgaagggttggtaacggttttggggtttaggtttaccg

SEQ ID NO: 7916 - DNA, 266 bp, Homo sapiens
  misc_feature: GYAE6OF02HBS8T.37.71.G05.1.454.CMB.1.raw
  modified_base (260)..(266): a, c, t, g, unknown or other
  misc_feature (260)..(266): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgcatctgatctacactatgacgcggctggcaaggcgcatagnnnnnnn

SEQ ID NO: 7917 - DNA, 763 bp, Homo sapiens
  misc_feature: GYAE6OF02JVVTH.37.71.G05.1.454.CMB.1.raw
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
tcagtagtgtagatcacgaccggtgctcgatttagtgtcgtcgcaagagagagggccttagccctggattccaaggcatttccacttggtgatcagcactgaacacaaaggactcaccatggagttcggggctgttctggattttccttgttgcttgttttagaaggtagtccatgtgaggtacagctggtggaatcgtgggggagcttaggtacagtccgtgggacgggttccctagngactctccgtgtgcatcgtntggattccaccgttccgagttccttttagactagttgagtcgtcggggtcccgccgggtcctccggaaggggtacggtctgggtacgtgggttcctacgacgttacccagttacgtaagttaccgtaaagttcgggtaacctaaaacctacgttaataacccgtttaagccgtaaagtttacgttttcggtaagggtaaccggggtccctaccgtttaccaaccgtaacgttccttaccgaacggtaacaccgtaaaccggaacccgtaaggaacgtcttaccgttacgttaacgtttcccgttaggaccttattaacgttacggacccaacgggttaccctagggtaacggttaaccgacccgggacgtaacccgggtcggtaccttacgttaaacgtacgtttaacgtcggtacgaccgggtagtacggtacggacggggtccggttacggacgttacggggtacgtccgttaaccggggtccttacggttacccgttaacg

SEQ ID NO: 7918 - DNA, 519 bp, Homo sapiens
  misc_feature: GYAE6OF02G1Q0P.37.71.G05.1.454.CMB.1.raw
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
  modified_base (474)..(474): a, c, t, g, unknown or other
  misc_feature (474)..(474): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctggagggtccctgagactctcctgtgcatcgtctggattcaccttccgagtcttttgacatgagctgggtccnccgggctccgagggagggtctggagtgggtctcatccatcagttacatggtcaaaccatatactacgcagtattttgngaacgggccgcttcaccatctccaganacaacgccaagacnctctctgtttctgctatntggacagcctgagacgccgacgacgcgctctatatactgtgacgganagtggacggtcggtggcgttggtcgacgtcgggtctacgttaccg

SEQ ID NO: 7919 - DNA, 524 bp, Homo sapiens
  misc_feature: GYAE6OF02HBKST.37.71.G05.1.454.CMB.1.raw
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
tcagtagtgtagatcacgaccggtgctcgatttagtgtcgtcgcaagagagaggggtcaggctggaactgaggagcaggtgggggcacttctccctctaacactctcccctgttgaagctctttgtgatcaggactcctcagttcaccttctcacaatgaggctccctgctcagctcctggggctgctaatgctctggtctctggatgcagtgggatatgtgatgcatcagtccccatctccctgccccgtcacccctggacgacgccggcctccatcctcctgcaggtctagtcagagcctcctgcataggaaatggacacacttatggattggtatctgcagacgcaggcagtcncanactctgatctagttcggttctaagtcggccgtccgggtccctgaccgaggttcaggttggctacggtgtactcgaggtacacgtaagtctttacactacgtagaacgtactcgaacgacgtaaggaggttcggaggcgtaggaggtacgttgggttttaacggg

SEQ ID NO: 7920 - DNA, 518 bp, Homo sapiens
  misc_feature: GYAE6OF02GPLJ0.37.71.G05.1.454.CMB.1.raw
  modified_base (415)..(415): a, c, t, g, unknown or other
  misc_feature (415)..(415): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctgggagggtccctgagactctcctgtgcatcgtctggattcaccttccgagcttttgacatgagctgggtccgccgggctccgaggggaagggtctgggagtgggtctcatccatcagttacaatggtacaaacatatactacgcagtattttgtgaacgggccgcttcacctatctaccagagaacaacgccaaganctctctgttctgcatangangctgagcgccgacgcgcgctctatacttatgtgcgtagagtcgggacggtggtggcgttgggtcgtacgtcggtcgacttacg

SEQ ID NO: 7921 - DNA, 404 bp, Homo sapiens
  misc_feature: GYAE6OF02IP40O.37.71.G05.1.454.CMB.1.raw
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (336)..(404): a, c, t, g, unknown or other
  misc_feature (336)..(404): n is a, c, g, or t
tcagtagtgtagatcacgaccggtgctcgatttagtgtcgtcgcaagagagaggggtaggtccctgacaggttcagtggcagtggatcaggcacagatttcacactgaagatcagcagagtggaggctgaggatgttggggttatactgcatgcaaggtctacaaactcctcggatccaccttcgccgaagggaccaacgactgggaagaacttaaaacgactggtggctgacaccattctcgttcgttcactcccttcccgccctatactagaactccttaacacttaccgtgacggtccgggctaggacctaaggccggaactgtagcntancnnnnnnnnnnnnnnnnnnnnnnnnnnnnnnnnnnnnnnnnnnnnnnnnnnnnnnnnnnnnnnnnnnnnn

SEQ ID NO: 7922 - DNA, 607 bp, Homo sapiens
  misc_feature: GYAE6OF02HFDKX.37.71.G05.1.454.CMB.1.raw
  modified_base (299)..(299): a, c, t, g, unknown or other
  misc_feature (299)..(299): n is a, c, g, or t
tcagtagtgtagatcacgaccggtgctcgatttagtgtcgtcgcaagagagaggggggtcaggctgggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactcctccctcgccccgtccaccccgtggacgacgcccggcctccatctcctgcnggtctagtcagacgcctcctgactagtaggaatcggaactactaacttagttggtagttgtactcgtgacgtagaacgccgagggctacgtcctaccaacaaccttccgtagtacttcttaaggttccgggttactaacggtcccggggtacccgttcccggggtccccttaggaccgtcgggttccagggttcggctagggtgtactcggacggacctaacgacgttaactttacgactacgtagaagtctaccgaggtccaagggaggtcggaggacgtaggacgggttagtttgggtttaacggg

SEQ ID NO: 7923 - DNA, 660 bp, Homo sapiens
  misc_feature: GYAE6OF02GHD05.37.71.G05.1.454.CMB.1.raw
  modified_base (294)..(294): a, c, t, g, unknown or other
  misc_feature (294)..(294): n is a, c, g, or t
  modified_base (625)..(625): a, c, t, g, unknown or other
  misc_feature (625)..(625): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctccgtggggctgctaatgctctgggtctctggatgcaggtggggatattgtgatgctatccacgtccccactcctcccctcgccccgtccaccccgtggacgacgccccggcctaccncttcctcctgcgtaggtcctaagtcaggactcccgtcctgacctagtagggtaaagtcggaactaccttaacgttagtagggtattcggtaacttcgtacgcgaagacgccgagggctacggttcctaccgacgtaacctcgtagacttcgttacgttcggttactacggtccgggtcccgtccgggttcctggtaccgttggttcagggtcgggactagttacgggacttacggacggtaccaacttaggtaccttaccgaacgttaacgtagaacggtacgtacgaacggtacgtaagggtaccggtagggaccggtacggttaacggnggggtttaacggttttaggggtttagggtttaacc

SEQ ID NO: 7924 - DNA, 688 bp, Homo sapiens
  misc_feature: GYAE6OF02JH2L6.37.71.G05.1.454.CMB.1.raw
  modified_base (231)..(231): a, c, t, g, unknown or other
  misc_feature (231)..(231): n is a, c, g, or t
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
  modified_base (423)..(423): a, c, t, g, unknown or other
  misc_feature (423)..(423): n is a, c, g, or t
tcagtagtgtagatcacgaccggtgctcgatttagtgtcgtcgcaagagagagggccttagccctggattccaaggcatttccacttggtgatcagcactgaacacaaaggactcaccatggagttggggctgttctggtattttccttgttgctgttttagaaggagtccactgtgaggtacagctggtggaatcgtgggggagcttggacaggcctgggacgggtcccnggacgacgttctaccgtgtcgctacgtcggtctggtacttccacccgttcgacgtcttttagactatgacgngtcggggtccgccgggctccggaagggggtaggttccgtagggtacggttcggggtaccncgtacgttccgagttcgaagtttaccaagttcggtaaccaaacgtattactacgtacganagtttagtttcgacggaacgggtcctacttaccacctagtccgtacgagaactaaccgaaccgtacgaagtacggtactccgttacgttacgtttcgagtacgtatacgtcgactcgtaccgtgaacgtacgacccgggaacgtccgggccgttacgttacttaattacgttaccgtgggtcgtaacggacgtcgggttaaccggcgggtcggtaggtcgtagggtacggttaccgttccgggtactacccgttaggttaaccgg

SEQ ID NO: 7925 - DNA, 596 bp, Homo sapiens
  misc_feature: GYAE6OF02GUISU.37.71.G05.1.454.CMB.1.raw
tcagtagtgtagatcacgaccggtgctcgatttagtgtcgtcgcaagagagaggggggtcaggctggaactgaggagcaggtggggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactctccctgccccgtcacccctggagacgccggcctccatcctcctgcaggtctagtcagacgcctctgcataggaaatggacactaacttagttggattggtatcgtgacaagaacgccgagggcacgtcctaccaactaacctcctagtactacttacgtttcgggttactaacggttccgggtcccgttccggggtccctaggaccgtacgggttcaggttcggacgtaggtggacgtcgacggaccaacgtacgtactttaccacgtacgtaggaacgtactacgaacggacgtaaggaggtacgggaggtccggtaggtagggttaggtttagggttttaacgggg

SEQ ID NO: 7926 - DNA, 537 bp, Homo sapiens
  misc_feature: GYAE6OF02GU9DG.37.71.G05.1.454.CMB.1.raw
  modified_base (375)..(375): a, c, t, g, unknown or other
  misc_feature (375)..(375): n is a, c, g, or t
  modified_base (434)..(434): a, c, t, g, unknown or other
  misc_feature (434)..(434): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggagcttggtacagcctggagggtccctgagactctcctgtgcatcgtctggattcaccttccgagtcttttgactatgagctgggtccgccgggctccgaggggaaggtctgggagtgggtctcatccatcagttacaatggtacaaaccatactactacgctagtattttgngaagggccgtcttccacctatcctccagacgaacaacgccaagacgctctcttgtttcngctatatggacagtcctagagacgccgacgacgcgctctaatattactgtgacgaggagtgggacggtcgggtggcgttgggtcgacgtcggtcgacttaccg

SEQ ID NO: 7927 - DNA, 669 bp, Homo sapiens
  misc_feature: GYAE6OF02HGQVH.37.71.G05.1.454.CMB.1.raw
  modified_base (200)..(200): a, c, t, g, unknown or other
  misc_feature (200)..(200): n is a, c, g, or t
  modified_base (356)..(356): a, c, t, g, unknown or other
  misc_feature (356)..(356): n is a, c, g, or t
  modified_base (506)..(506): a, c, t, g, unknown or other
  misc_feature (506)..(506): n is a, c, g, or t
  modified_base (525)..(525): a, c, t, g, unknown or other
  misc_feature (525)..(525): n is a, c, g, or t
  modified_base (562)..(562): a, c, t, g, unknown or other
  misc_feature (562)..(562): n is a, c, g, or t
  modified_base (566)..(566): a, c, t, g, unknown or other
  misc_feature (566)..(566): n is a, c, g, or t
  modified_base (578)..(578): a, c, t, g, unknown or other
  misc_feature (578)..(578): n is a, c, g, or t
  modified_base (614)..(614): a, c, t, g, unknown or other
  misc_feature (614)..(614): n is a, c, g, or t
  modified_base (621)..(621): a, c, t, g, unknown or other
  misc_feature (621)..(621): n is a, c, g, or t
tcagtagtgtagatcacgaccggtgctcgatttagtgtcgtcgcaagagagagggggtcaggctggaactgaggagcaggtgggggcacttctccctctaacactcctcccctgttgaagcttctttgtgatcaaggactcctctagttccaccttctcacaatgagctccctactcacgctccgtgggctagctaagtnctcgtgggtctcgtggatgcgaggtggggattagttgtagagtcgtacaactcacgttcccactacccgttccctttccccgccgtacccccggttaccctaaccccggagggaaccgaccggccccgggaccctaccctacttcccgtcccgtanccgtacggtaccttaggtacacggaccgtcccctcgtagcctaaggtagtaaacgcggaactaaccgttaattaaggttacgtaagtttggtttagacgttcgagaagaaacgccgaaagggcctacgttaccaccacctactaccgtanattctagtttaccgggtanacggtccggtcccggtccgggtactagaccgtgtacncggngccttagcgtanacgagtacacgtagtacttccatacgtagactaagntaacggntaaggtacgggtacacgggtgtaaggtataggtttgggtttaaccggg

SEQ ID NO: 7928 - DNA, 555 bp, Homo sapiens
  misc_feature: GYAE6OF02HKUR8.37.71.G05.1.454.CMB.1.raw
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttagaaggagtccactgtgaggtacagctggtggaatcgtgggggaggcttggtacagcctggagggtccctgagactctcctgtgcatcgtctggattcaccttccgagcttttgacatgagcgtggggtccgccgggctcccgaggggaagggtcgtggaggtgggtctcgactccatcagttacaagtgtacaaaccatatactacgctagtagttttgtaggaacgggccgtctcacctatcctccgaagagacgaacgacccgaagacgctcttcgttcgtttactcgtactatagtgacagccgtgacgacgcgacgcgcgctctatattacngtgcgngtagcgggacggtcggtaggcgttaggcgtacgtccggtacgtacgttaccg

SEQ ID NO: 7929 - DNA, 604 bp, Homo sapiens
  misc_feature: GYAE6OF02HHSNF.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggatttttccttgttgctgttttagaaggagtccactgtgaggtacagctggtggaatcgtggggggaggcttggtacaggcctgggagggtccctgagacctctcctgtgcatcgtctggattcaccttccgagtcttttgacatgagcgtgggtcccgccgggctccgagggagggtctgggagtcgggtctcatccatcagttacaatggtacaaacctatatacgtacgctagtattttgtggaacgggcctcttccaccatcctcgagacgacaacgaccaagcgtctctcttgttctgctatagtggactacggcctggaacggacgacccggaacggaccggccgtcctacgttaacttacgtttacgttggtacgaggtaacggaggttacggggaccgggtcgggttcgggtcggtaggggttaccgtaccgggttcgggtaccgtaccgttaccgg

SEQ ID NO: 7930 - DNA, 602 bp, Homo sapiens
  misc_feature: GYAE6OF02GCZLH.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctcgtggatgcaggtggggattattgtgatgcagtcacgtccccactcctccctcgccccgtcaccccgtggacgcgcccggcctccatcctccgtgcgtaggtctagtcagacgcctcgtgctagtaggaatggaacaactaacttagttaggatttggtatcgtgacaacggaacgtccgagggcctagtccaccaactactcctgtacttacgttagttcgggttactacggtcccgggtacccgttcccggggtccctaggtacgttacggtttacgagggtcgtaccgtaggtacggtacgtcgtaacggacctacggtattaccgttacacgtattaggaagtactcgagcgaggtaggtcggagtcgtaggacggttagttgggtttaacgg

SEQ ID NO: 7931 - DNA, 719 bp, Homo sapiens
  misc_feature: GYAE6OF02JRS7Z.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatatgtgatgcatcagtccccactctccctgccctccaccccgtggacgacgcccggcctccacgtctccgtgcgacggtctacgtcaggacgtccctacgtgcaagtaggaaactcggaccaactaaccttagtgtagttacggtactctaggtacaggtaacgcccgtaagggcctaggtccctacccaactaaccgttcctaggtactttaccgttaacgtttcggggttaaccttaaacggttcccggggtaccccggtttaccccggggggtaccccttagggtaacccggtacgggttttaccgacggggtttacgggaccgtaggggttacggtaccttaccgggaacggtacccgtaacgtaaacggtttactttaacccgaaccgtaccgttaaggaacggttacggttaaacccgcgggtaacgtaacggtaacgggttacggtaaaccgggccttaaggggacgggttacggtttagggtttttacggggg

SEQ ID NO: 7932 - DNA, 272 bp, Homo sapiens
  misc_feature: GYAE6OF02G165E.37.71.G05.1.454.CMB.1.raw
  modified_base (267)..(272): a, c, t, g, unknown or other
  misc_feature (267)..(272): n is a, c, g, or t
tcagtagtgtagatcacgaccggtgctcgatttagtgtcgtcgcaagagagaggggatcaggcacagatttcacactgaagatcagcagagtggaggctgaggatgttggggtttattactgcatgcaaggtctacaaactcctcggatcaccttcggaccaagggacacgactggagattaaacgaactgtggctgcacatctgtcttcattccttcccgccatctgaactctacactactgacgcgggctggcaaggcacatagnnnnnn

SEQ ID NO: 7933 - DNA, 612 bp, Homo sapiens
  misc_feature: GYAE6OF02IKP59.37.71.G05.1.454.CMB.1.raw
tcagtagtgtagatcacgaccggtgctcgatttagtgtcgtcgcaagagagagggccttagccctggattccaaggcatttccacttggtgatcagcactgaacacaaaggactcaccatggagttggggctgttctggatttttccttgttgctgttttagaaggagtccactgtgaggtacagctggtggaatcgtgggggagcttggtacagcctggacgggtccctgacgactctcctgtcgcatcgtctggattcaccttccgagtcttttagacatgagcgtggggtccgccgggctccgaggggtaaggtcgtgggaggtgggtctcgatccatcagttacatcggtacaaaccatactactacgcagtatttgagaacgggcctcttaccacctatccctacgaagacgaaccaaccgccaagagtcctctcttcgtttcctagtactatacgtggacacgtccgtagacgacgacccgacgtaccggccggtccttacgttaacgttaactttacgtggtacgcggtaaggacggtacgggacgggtccggtagggtcgtacgggttcggaccggttccgggtcgtacccgttcgttaaccgg

SEQ ID NO: 7934 - DNA, 748 bp, Homo sapiens
  misc_feature: GYAE6OF02ITSFN.37.71.G05.1.454.CMB.1.raw
  modified_base (249)..(249): a, c, t, g, unknown or other
  misc_feature (249)..(249): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttcctgttgcttgtttagaaggagtccatgtgaggtacagctggtgaatcgtgggggagcttggtacagccgtggagggtccctgacgactctcctgtgcagcctntggttcattcttagcaactaccgccatgagtcgtcgggtcccgccgtaggccctaccggaagggggtaacgggggtcgttggggaagggttcggggttcctacggtaagggtttaactttacggtgggttaaggttagggtaaaactacccgactaacgtaacccgtaacggcctaaggtacccgttccggtacgggaccggggtcccgtttaccacccggttctacccgaaggacgaacctaacgttaccgaaaggtaaccgtacggtctaacgtacgtaaggaaaacttcggaaaccacggtcccgtaaggaacggtaccgggacccggtaaagggacccgaacccggtccccttactttaagtttacccgtgggttacgaaccggagtaacgtccttaacggacggtaacgggtacttaacggacgaccgtaacggcctaacggtccttacggtacggtaaccggtaccgggtaccggggacccctaaacccgggg

SEQ ID NO: 7935 - DNA, 649 bp, Homo sapiens
  misc_feature: GYAE6OF02IW3A6.37.71.G05.1.454.CMB.1.raw
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
tcagtagtgtagatcacgaccggtgctcgatttagtgtcgtcgcaagagagagggggtcaggctggaactgaggagcaggtggggggcacttctccctctaacactctcccctgttgaagctctttgtgatcaggactcctcagttccaccttctcaacaatgaggcctccctgctcagctccgtggggctgactaatcgctcgtgggtctcgtggatgcgaggtggggtattagttgtagatgctactccgaccgtcccctacttcctcccgtcgccccgtcctaccccgtaggacgacggcccggtcctaccactcctcncgcgtaggtctagtcgagcgcctcgngcagtaggaatcgaactaacgtaacttagttcggtatttggtacttctaggaacgaagaaccgtacggacggactacgtacctaaccacctaacttccgtagtacttcgtttaggttccgggttactacgggtcccgggttcccgggttaccggtccgtacggaccgttagggttccgagggtcggacgtacgggttcgactcggaggtaccttagtactaacttccgactacgtaagaacgtcctagacgagtaggaggtacggcggtacgtagggtacgtttacgggttggtttaacgg

SEQ ID NO: 7936 - DNA, 614 bp, Homo sapiens
  misc_feature: GYAE6OF02F1ADO.37.71.G05.1.454.CMB.1.raw
  modified_base (224)..(224): a, c, t, g, unknown or other
  misc_feature (224)..(224): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtgggatattgngatgcatcacgtccccactcctccctgcccgtcacccctggacgacgccggcctccatctcctgcaggtctagtcagacgcctctgctagtaggaatggaaccactaacgttattggtactttgggtactcgttgactaaggaacgtccgaggggtcctaagtcctaccaactaacctccgtagacttcttagttcgggtttactaacgtccgggtccgttccggggtacctcgacgtaggtttccagggttcggactagggtcggtactacggaaggtccaaagtcgttaacgtttacgaacgtacgtacggtaaagtcgtacgaaggaccgtaggtaacgggttcgggaggtccggtaggtaacggttacggtttgggttttaacggg

SEQ ID NO: 7937 - DNA, 716 bp, Homo sapiens
  misc_feature: GYAE6OF02JCICM.37.71.G05.1.454.CMB.1.raw
tcagtagtgtagatcacgaccggtgctcgatttagtgtcgtcgcaagagagaggggtcgaggctggaactgaggagcaggtgggggcgacgttctccctctaacactctccctgttgaagctctttgtgatcagactcctcagttcaccttctcacaatgaggctccctgctcagctcgtgggctgctaatgctctggtctctggatgcagtgggattatcgtgatgcatcacgtcccacgtctccctgcccctcacccctggacgcgccgcctcatcctcctgcacggtctacgtcgaacgtcgcctcctcgctaacgtgggaaaactcgggaccaacgtaactttagtacggtagtttacgggtaacttcgtacgtacaaacggtaacgaccggagggtacctagttcccgtacccaaccgtaaaccttccgttacgtacttacgttacgttttaccgggttactaaaccggtccgggtacccgttcccggggttcccctacggtaccgttacggttaccgtaacggttcgggtacgtaccgggttacggactacccgggtaaggtaccgtaaccggtaacgtttaaccgttaccgtaaaccgtacgttaacgggaagtaaccggttaaccaaggttaccgaaggttaaccggtacgggtaaccgggtccgtttaaggggaccggtttaaggtttccgggtttttaaacggggg

SEQ ID NO: 7938 - DNA, 757 bp, Homo sapiens
  misc_feature: GYAE6OF02G2UV5.37.71.G05.1.454.CMB.1.raw
  modified_base (313)..(313): a, c, t, g, unknown or other
  misc_feature (313)..(313): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggattattgtgatgcatcacgtccccactcctccctgccccgtccaccccgtggacgacgccggcctccatcctcctgctaggtctagtcaggacncctcctgcagtaggaaatcggaactaactaaacgttagttggtagtttacgggttatcgtcgacgaaggaacgccggagggcctaacggtcctacccaaaccgtaaccttccgtagtacttaccgtttaaggtttccgggttactaaaccgggttccggggtaccccggtttcccgggggttcccctaggtaaccggttacgggttccgtaagggttcgggaccggttaacgggttcgggtaaccgttacgaacgggtacctaaacggtaacgttaacgttttaccgaaacccgttacggttaacggtaaacgtacggttaacccggtaacgggtaaccggtaaacggggttaacgggttaacggggggtaaccggggttaccggtaacggggggttaacggggtttacggggtttttaggggggtttttttaaacccgggggg

SEQ ID NO: 7939 - DNA, 729 bp, Homo sapiens
  misc_feature: GYAE6OF02GIT9G.37.71.G05.1.454.CMB.1.raw
  modified_base (232)..(232): a, c, t, g, unknown or other
  misc_feature (232)..(232): n is a, c, g, or t
  modified_base (333)..(333): a, c, t, g, unknown or other
  misc_feature (333)..(333): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggcctccctactcagctccgtggggctgctaatgctcgtgggtctcgtggatgcgaggtgggattagttgngatgcatcacgtccccacgtcctcccgtcgccccgtccacccgtggacgcgcccgcctccactcctccgtgcgtacggtctacgtcacgtacgtcccgtcngtactagtaggtaacgtcgactaacgtaactttagtaggtagttagtactacgtcgacgaacggtacgaccgtaggaccacgttccacctaactaccgtcgtacgtacttacgttacgttccggttaactaccgggttcccgggtacccgtccgggttaccctagggtaaccgttcggttacgtaggttacgggtacgtacggttacggtaacgtccggtaacggtacctaacggttaccgtttacgttaaccgaaccgttaacgggttacgaacggttacccgttacgggaaaccggttaccggtaaacgggttacgggttaacggtacgggttacggtttaaccggggttaagggtttagggttttttaccggggtttaagggttttaacccgg

SEQ ID NO: 7940 - DNA, 768 bp, Homo sapiens
  misc_feature: GYAE6OF02HVKJZ.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgcctccgggtctctggatgacgtaggtggggattattgtgatgacatcaccgtccccatcctccctcgcccgtccacccgtggagacgccggcctccatcctcctgcgtaggtactacgcgacgacgtccctcctagactaagtaggaaactcggaaacctaacttaaacgttagtttagggtaacgttaggttacttcgtacgacgaacggaacgtacccggacgggacctaacggtccctacccgtaaccgtaacccttccgttacgtaacttccgtttaacggtttaccgggtttaaccggttaaaccggttccccgggggttaccccgggttaccccggggttacccggttacgggttaaacccggttaccggggtttaccggacgggtacgggtaccggtacgggttacgggaccgttaccggaaggacccgtaacgttaacggttacctaaccgtaactaccgttacggtaagtaccgtaacggtacggtaacgtagggtaaacgggtcgggtaacgggtccggtaagggtaaccgggtttaaggttttagggtttagggtttttaacg

SEQ ID NO: 7941 - DNA, 929 bp, Homo sapiens
  misc_feature: GYAE6OF02J2LWN.37.71.G05.1.454.CMB.1.raw
  modified_base (234)..(234): a, c, t, g, unknown or other
  misc_feature (234)..(234): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgagctccctactcagctccgtgggctgactaatcgctcgtggtctcgtggatcgcgtaggtgggtaattgtttgngtagtcgactagtccgaccgtaccccctcttccgttccccgtcgccccgtaccaccccggttaggaaccggccggtccccgtccctaccctcttcccgtcccgtggaccgtacggttaccgtacgtaccgacgtccgtccgttaccgtagtaccgaacggtaacggtaacggtacggaaacctaaccgtttaacgttcggttaacgggtaagttcggttaacgtccgtacggtaaccggaacgggtaaccgtaccgggtaaccggtacccgtttaaccgttacccgtaacccgtaaccctttaaacgggttccccctttaaggggtaaaccctttttcccggttaaacgggttttttacccggggggtaaaccctttaacccgggggtaccccggggttttcccccggggttaacccggggttttccaaaccggggtttaaccgtttccgggggtttaaccgtacggggttacccggtaaccggggtttagttaacccgggttaaccggtttaccgaaccgggttaaccgtttaaaacccgggaggtttttaaccccgttacgtaaaccgggtaaacgtttcggaaaccggtttaccggtaacgtcccggggttaaataccggggttaaggccggtttaaccgggccgtttaaggttttaacgggtaccgggttttaggttttacggtaaccccg

SEQ ID NO: 7942 - DNA, 567 bp, Homo sapiens
  misc_feature: GYAE6OF02JJ27Y.37.71.G05.1.454.CMB.1.raw
  modified_base (408)..(408): a, c, t, g, unknown or other
  misc_feature (408)..(408): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgctgttttagaaggagtccactgtgaggtacagctggtggaatcgtggggggagcgttggtacagccgtgggacgggtccctggagacctcgtcctggtgcagtcgtctggtattccaccttccgagtcttttgactatgagcgtcgggtccgccgggctaccgaggggacggtcgtggaggtgggtctcgactcatcagttaccaagtggtacaaaccatactactacgctagtatttggagagggtcctccttnacctatcctcagactacaacgcaagcnctncttacgttcngctatacngganacgtccngagacgccgngacggcncgttactattagtcgtgnggacgtagnggtgggacgggtcggtacggcgtgggtacgcggtccggttcgaccgttactaaccg

SEQ ID NO: 7943 - DNA, 649 bp, Homo sapiens
  misc_feature: GYAE6OF02FMRW5.37.71.G05.1.454.CMB.1.raw
  modified_base (208)..(208): a, c, t, g, unknown or other
  misc_feature (208)..(208): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggntgcagtggggatattgtgatgcatcacgtccccactctccctgcccgtcacccctggacgacgccggcctccatcctcctcgcaggtctagtcagacgcctcctgctagtaggaaactggaccaactaactttagttagggtatttgggtattcgtgacgaaggaacgccgagggtccacggtcctaccaacacttcctagtacttacgttacgtttccgggttaccttaacggtccggggtcccggttcccggggttacccgttacgggtaaccgttaggggtttccgtaggggttcgggtacgagggttcggacgttccggaagggcctaacgtaacggttactttaccgacgtacgtaggaacgttaactcgaaggtctaaggggtagtcgggaacgggttcgttacgggaaggttagggtttagggttttaacgggg

SEQ ID NO: 7944 - DNA, 601 bp, Homo sapiens
  misc_feature: GYAE6OF02H0DT8.37.71.G05.1.454.CMB.1.raw
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (429)..(429): a, c, t, g, unknown or other
  misc_feature (429)..(429): n is a, c, g, or t
tcagtagtgtagatcacgaccggtgctcgatttagtgtcgtcgcaagagagaggggtcaggcttggaactgaggagtcaggtgggggcacttctccctctaacactcctcccctgttgaagcgtctttgtgatcaggactcctcagttcaccttctcacaatgaggctccctgctcagctctgggctgactaatgctcgtgggtctctggactgcaggtgggtatagttgcgattgcatcagtccctatctcctagacccgtnacccctggaagcgcgctcagtcnctcgcaggtcctagtcagacgtcctcctagnaacgtgggaaactggacctaacaacgttattgaagttcggaattcggtcaagaacgccaggnacgtnacctacaactctgaatctagttcggtcaatcggactccgggtccngtacgagtccgtagtgcgagtcggtatcgacggtactaacggtacagttttacccgaccgttaacgtacggaacgtaaactttccggaacggttaccgaaccggtttaacggacgggttaccggtacccggttaacggaagggtttacgttacgggtttttttaaaccgggg

SEQ ID NO: 7945 - DNA, 633 bp, Homo sapiens
  misc_feature: GYAE6OF02H1JMM.37.71.G05.1.454.CMB.1.raw
  modified_base (438)..(438): a, c, t, g, unknown or other
  misc_feature (438)..(438): n is a, c, g, or t
  modified_base (534)..(534): a, c, t, g, unknown or other
  misc_feature (534)..(534): n is a, c, g, or t
  modified_base (542)..(542): a, c, t, g, unknown or other
  misc_feature (542)..(542): n is a, c, g, or t
  modified_base (556)..(556): a, c, t, g, unknown or other
  misc_feature (556)..(556): n is a, c, g, or t
  modified_base (564)..(564): a, c, t, g, unknown or other
  misc_feature (564)..(564): n is a, c, g, or t
  modified_base (582)..(582): a, c, t, g, unknown or other
  misc_feature (582)..(582): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcctaccttctcacaaatggacggtcctcccctgctcacgtctccgtggggctgctaatgctcgtgggtctcgtgatgctagggtgggtattacgttgtgagtgactactccaccgtcccctcttcccgtcccttccgccccgtccgaccccgtaggaaccgtccggcccgtcctacctactcctccgtacgacgtacggtactaacggtcaacggtccgtcctaccgtgaccgtaagtaaggaacgtcgaactaacgttaacgttagtcgtaagttgtactcgtagacgtaanacggtcggacggtacttacgaccctacgaaccttactcgtatacttcgttagttcggtactccggttccggccgtcggtctgactggtcgagtcgngtacggtnacgtgagtcaagtnttaacctnacgagaactagcgtacgngtaacgaggtggaggtacgcgttgggtaacggtttacggttgtttaacggg

SEQ ID NO: 7946 - DNA, 289 bp, Homo sapiens
  misc_feature: GYAE6OF02HTCCW.37.71.G05.1.454.CMB.1.raw
  modified_base (187)..(187): a, c, t, g, unknown or other
  misc_feature (187)..(187): n is a, c, g, or t
  modified_base (258)..(258): a, c, t, g, unknown or other
  misc_feature (258)..(258): n is a, c, g, or t
  modified_base (264)..(265): a, c, t, g, unknown or other
  misc_feature (264)..(265): n is a, c, g, or t
  modified_base (267)..(289): a, c, t, g, unknown or other
  misc_feature (267)..(289): n is a, c, g, or t
tcagtagtgtagatcacgaccggtgctcgatttagtgtcgtcgcaagagagaggggatcaggcacagatttcacactgaagatcagcagagtggaggctgagatgttgggttattactgcatgcaaggtctacaaactcctcggatcaccttcggccaagggacacgactggagattaaacgactgngctgcacatctgtcttcattccttcccgcatcctagaatctacactactgaggccgggctggacaagggcncatagnngnnnnnnnnnnnnnnnnnnnnnnn

SEQ ID NO: 7947 - DNA, 638 bp, Homo sapiens
  misc_feature: GYAE6OF02GJN8Y.37.71.G05.1.454.CMB.1.raw
  modified_base (503)..(503): a, c, t, g, unknown or other
  misc_feature (503)..(503): n is a, c, g, or t
  modified_base (535)..(535): a, c, t, g, unknown or other
  misc_feature (535)..(535): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcgtgggctgctaatgctcgtgggtctcgtggatgcaggtgggattattgtgatgctagtcacgtcccactcctccctcgcccgtcacccctggacgaccgccgcctcctactcctccctgcgtaggtcctaagtcgacgacgtccctcgtagctaagtagaaaatcggaacctaactaaattagtttcggagtttacggtaacttctaggaacctaaggaacgcccggaagggtccaacggttcctaccgaactaactccgtagtactcgttaacgttcggtactacggtcggtacccgttcccgggtcctagaactggtttacgnggtcgtacgtagtagtctacggagacccgaanacgttacgttaccaacggttacgaggtaaactcgtaaccggaacgtaccgtaaggacggtaaggttacgggcgtaaggtaggtttacggtagggttttacggg

SEQ ID NO: 7948 - DNA, 309 bp, Homo sapiens
  misc_feature: GYAE6OF02IV3YW.37.71.G05.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (279)..(309): a, c, t, g, unknown or other
  misc_feature (279)..(309): n is a, c, g, or t
tcagtagtgtagatcacgaccggtgctcgatttagtgtcgtcgcaagagagaggggatcaggcacagatttcacactgaagatcagcagagtggaggctgaggatggttggggtttattactgcatgcaaggtctacaaactcctcggatcaccttcggaccaagggacacgactggagtaattaaacgactgtggctgcaccagtctntctcatccttcccgcatctgaactctaacactacgngacggtccggctggacaagggcacgtaatggcannnnnnnnnnnnnnnnnnnnnnnnnnnnnnn

SEQ ID NO: 7949 - DNA, 643 bp, Homo sapiens
  misc_feature: GYAE6OF02JEYSL.37.71.G05.1.454.CMB.1.raw
  modified_base (523)..(523): a, c, t, g, unknown or other
  misc_feature (523)..(523): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatcgcgaggtggggattagttgtgatgcatcgaccgtccccacttcctcccgtcgtccccgtccaccccgtggacgtacggccccggtcctcctactcctccgtcgccgtacggtcctagtcagacgtccctctcgcagtagaacgtcgaacctacgtaacttagttcgtagttcggtactcacgacgaacgaccgacggaggtccgtacgttaccacccaacctaacctcgtacgtacgttaccgttaggtttaccgggttacgtaaccggtcccgggtcccggttcccggtacccttagacggtcgttacgnggtcgtacgtggtacgtcacggtacggcaacgtagtactacgtaactacggtagtacgactagacggaggtaagtagggtacggaacgtcggtaggttaacggtggtttagggtttacgg

SEQ ID NO: 7950 - DNA, 629 bp, Homo sapiens
  misc_feature: GYAE6OF02I08E9.37.71.G05.1.454.CMB.1.raw
  modified_base (328)..(328): a, c, t, g, unknown or other
  misc_feature (328)..(328): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctcgtggatgctaggtgggattagttggtgatgcatcacgtccccactcctcccgtcgccccgtccaccccgtggacgacgccggcctccactcctcctgctaggttctacgtcagacgtcctantgactagtaggaagtcggaactaacgtaactttgtaggtatttacggtatcgtagacgtagaacgccggaggcgtacgtacctacactaacctccgtagtacttcgttacgtttaccgggttactaaccggttccgggcccgttcccggggttccacgggtaactacggttcaggttgacgtaggtgacgtcgaacgaccgtactagttaccttacgactagtacggaatacgttaccgaggtaaccggtagggtacggacgggtacgacgggttagggtacgggttagtttttacggggg

SEQ ID NO: 7951 - DNA, 877 bp, Homo sapiens
  misc_feature: GYAE6OF02I4LBW.37.71.G05.1.454.CMB.1.raw
  modified_base (253)..(253): a, c, t, g, unknown or other
  misc_feature (253)..(253): n is a, c, g, or t
tcagtagtgtagatcacgaccggtgctcgatttagtgtcgtcgcaagagagaggggggtcaggctggaactgaggagcaggtgggggcacttctccctctaacactctcccctgttgaagctctttgtgatcaggactcctcagttcaccttctcacaatgaggcctcctgctcagctccgtgggctgctaatgctctgggtctctggatgcaggtgggatattgtgatgacatcacgtccccactcctcccncgtccccgtccaaccccgtggacgacggcccggcctacccgacttccttacccgtgtaccgtaacgggttcctaaggtccgaacggaccggtcccttccgtacgacctaacgttaaggggaaacttagggaaccctaaactaaaccgtttaaggtttaggtaacgttttagggtttaactacgtttacgaaccggtaaaggtaaacgggaccccggaaaggggtccctaaaggttacccgttaaccccaaacccgttaaaacccgtttcccgtacgttaactttaccggttttaaacggttttacccggggtttaaaccgttaaaccgggttacccccggggggttaccccggtttacccccgggggggttacccctttacgggttaaacccgttaaccggggtttaaccgtaacgggggtcggttaacccggaggggtttaccgggaaaggttaccggtaacggggtacccttaaaaggtaaaccggtttaaacctttacccgaacgttaaccggtaacggtaaaacggtacctttaaccggaacggtaccgtaaagggtacggggttaacgggagggttacctacggggtaacgggttaggttaaccggggtttttaacggg

SEQ ID NO: 7952 - DNA, 762 bp, Homo sapiens
  misc_feature: GYAE6OF02HX17V.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcactttctcacaatgaggctccctgctcagctccgtggggctgactaatgctcgtgggtctctggatgcaggtgggattagttgtgatgcatcacgtccccacttcctcccgtcgccccgtccgaccccgtggacgacgcccggtcctccgtattcctaccgtgccgtacgggttcctaagtccgacgtaccgtccctaccgttcggacctaaggtaggtaagtacggtaaccaaccgttaaacttttgttacgggtagttttacgggtacttcgtacggaacgaacggtaacggccgtaagggtcctaacggtcccttaaccaaccgttaaaccgttcccgttagtaaccgtttacggtttaacggttttaccgggttaaccttaaacgggttccccgggggaacccgtttccccgggggttacccttacggtaacggttaacgggttccgtaagggtcgggtaacgttaggggtacgtaccacgggtacggactaacgtacgttacgtttaccgaaccgtagttaacggaacgtacgttaccggaagtcggaagggttccggtaacgggccggtaacgtaggggtaacggttagggtttagggttttaaacgggg

SEQ ID NO: 7953 - DNA, 780 bp, Homo sapiens
  misc_feature: GYAE6OF02IA0C2.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctcgtggatgcaggtggggattattgtgatgcatccacgtccccacttcctccctcgcccgtccaccccgtggacggacgcccggtcctccatcctccgtgccgtaggttcctagtcgacgtaccgtcccttaccgtcgactaagtaggaaaacgtcgggaaacctaaaccgtaaacgtttagtttagggtaagttttagggtacttacgtacggacctaaaggaacggcccggtaaggggtcctaacggttccctacccgtaaacctaacccgttcccgttagtaacctttacgtttaacgggtttaccgggtttaaccgttaacggttcccggggtacccggtttcccggggttaccctaaggtaccgttacgggttacgtacgggtcggtaccgtacgggttacggacttccggaacggtaccctaaacggtacgtttaaaccgtttacccgaaccgtttaacgttaagggtaaacgtaccgttaacggaacggtaacggtacggtaaggggtttcggggaacggttccggttaagggtaacggggttttacggttttaggggttttttaacgggg

SEQ ID NO: 7954 - DNA, 598 bp, Homo sapiens
  misc_feature: GYAE6OF02HT8QJ.37.71.G05.1.454.CMB.1.raw
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
  modified_base (379)..(379): a, c, t, g, unknown or other
  misc_feature (379)..(379): n is a, c, g, or t
  modified_base (501)..(501): a, c, t, g, unknown or other
  misc_feature (501)..(501): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctctctgctcagctccgtggggctgctaatgctctgggtctcgtggatgcgaggtgggtatattgtgatgctatcacgtcccctactcctcccgtcgccccgtccaccgtggacgccggcccgcctcctctcctccgtncgtaggtctacgtcgagcgtcctcngctagtagaacgtagaacacttaactttagtggtagtttagtagtcgtgaanacggtagcggtagctagtacctacaccgtaacttcgatacgttacttacgtttcggtacgtacggtccgggtaccgtttccggtcctacggcgtaggttccgtggtcggacgtaggtcggancgacggtcacgttacgttactccagtacgtaagacgttacacggagtacgagggtaacggtggtacggacgtttagggtaggtttggtttaacgggg

SEQ ID NO: 7955 - DNA, 619 bp, Homo sapiens
  misc_feature: GYAE6OF02G23YK.37.71.G05.1.454.CMB.1.raw
  modified_base (336)..(336): a, c, t, g, unknown or other
  misc_feature (336)..(336): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctcgtgggtctctggatgcaggtgggatattgtgatgcatcacgtccccactcctcccgtcgccccgtccacccctggacgacggcccggccctccacttcctccctgaccgtaggtcctaggtccagtacgtcccgttaccngacagtaggaatcggaacaactaacgtttagtggtactttggtactctcgcaagacgccgagggctacgtcctaccacctaactcgtacgtacttccttagttccggttactaacggtccgggtaccgttcccgggtccctaggacgttacggtcaggtcggctaggtcgaacgtcggacgacctaagtacgtaactttccaacgtacgtagaacgtcttacgaggtacgtaaggacgggttacggacggtagtagggtaaggttggtttagggtttacgggg

SEQ ID NO: 7956 - DNA, 670 bp, Homo sapiens
  misc_feature: GYAE6OF02JK1FW.37.71.G05.1.454.CMB.1.raw
  modified_base (594)..(594): a, c, t, g, unknown or other
  misc_feature (594)..(594): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgagcctccctactcagctccgtgggctgctatgctctggtctcgtggatgcgaggtgggtatagttgtagatagctataccgtccgtacccctactcctcccgtcgccccgtccacccgtaggacgccgcccgtacctcccgtactccttcctcgtaccgtacgggttctacggacgacggactcccctgtcgactacggttaaggacgtacgacctaacgtaacgtttacggtagtaagttggtaacttcgtacgacgtaaagaccgtacgacggcgtaacgtctaacctactaaccgtctagtacttacgttacgttaccgttagaccggttacccggtcccggttccgggtaccgtggtaccgtacggttacgcgttcggtacgaggtacgtagtacgtacgacgtaactacgttacttaacgcgttaaggntaacgtatccggaacgtacggaggtaacggtgtaacggtcgaagggttacggtaggtttcggggttaagttaccgg

SEQ ID NO: 7957 - DNA, 569 bp, Homo sapiens
  misc_feature: GYAE6OF02F7XB1.37.71.G05.1.454.CMB.1.raw
  modified_base (314)..(314): a, c, t, g, unknown or other
  misc_feature (314)..(314): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctcgtgggtctctggatgcaggtggggattattggtgatgcatcacgtccccactcctcccctgccccgtccaccccgtggacgacgcccggcctccatcctcctgcaggtctagtcagcnccctctgcatggaaatcggacactaacttattggtatttggtatctgacaagacgcgaggcagtcctaccactactcctgtacttctacgtttcgggttactaacggtccgggtccgttccgggtcctagtacgtcggtcacgggtggtcgaggtgactcgacgacagtacgtacttcgacgtacgtacgaagtactacgaacgtacgaggtagggtacggacggtggtaggagggttagttgggtttaacgggg

SEQ ID NO: 7958 - DNA, 776 bp, Homo sapiens
  misc_feature: GYAE6OF02HGOYM.37.71.G05.1.454.CMB.1.raw
tcagtagtgtagatcacgaccggtgctcgatttagtgtcgtcgcaagagagaggggccttagccctggattcccaaggcatttccacttggtgatcagcactgaacacaaaggactcacatggagtgggctgttctgtatttcctgtgctgtttagaaggagtcatgtgaggtacagcgtggtaggaatcggtggggggacgtcgttagggtaacaggtccgtagggtacgggtccctggacgtaccttccgtccgtaggtcgctacgttccggttacgtggtacttccgtaacccgtttccgtacgttccttttaggacctaatggacgtcgtcgggtccggcccgggtctaccggaagggggtaacgggtcgttagggaggttcgggtcctacgtactcctaagtaccgtaagttaaccgaacgtcggtaacctaaaccaattaacgtaacctacgtactaagtttacgttttaggtacggtaacgggtcccgtacgttaccaacccgtattacccgtacgaacggaacgtaaaccgaaaccgaccgaaacggtcgtacctaaccgttcgttcggtttactacggtactaaacttacggtaacgtaactaacgccgttaagaacggacccgtaccgggtaacggaccggtccgtaacttacgtaacttaacgtagttacgggacgtaacgggtacgtaagggtaccgggaacgggttcggtaacgggtcgtacggtacggtaccgttaccggtacgttaccgtacgttaaccgg

SEQ ID NO: 7959 - DNA, 882 bp, Homo sapiens
  misc_feature: GYAE6OF02GZNMZ.37.71.G05.1.454.CMB.1.raw
tcagtagtgtagatcacgaccggtgctcgatttagtgtcgtcgcaagagagaggggccttagccctggattccaaggcatttccacttggtgatcagcactgaacacaaaggactcaccatggagttgggctgttctggattttccttgttgcttgttttagaaggagtccactgtgaggtacagctggtggaattcgtggggggagtcgttggtacagccgtgggacggttccctgagtacctctccgtgtcgctacgtcgttcgtggtacttccgtaccctttccgacgttcctttttaggaactacgttaggagtccggttccggggttccccggcccggggtccgttacccgggtaaaggggggtaacggggttccggttaggggtaacgggtttcggggttcccttaccgtacgtttaccctaacgttacccgttaacggttttaacgtaaacgttacggttaaacccgtaaaaccctaaagtttaacctaaaccgtaacgtaccgtaaggtttttagttttacgggtacggttaaaccggggtccccttacgtttacccaaccctacgttccctaccgaaggaaccgtaaccgaaaccgaccgtaaaggcgtaccttctcgttacgtttctcgtacgtaattacgtacgacgtacgtccgtaggaaccggtaccggaccccggtaacggtacccggtaccggtaccgtttaaccttaaacggttttaaccgttaccgttaggttaccggtacggtaacgggttaaccggggtaacgggtaacccggggttccgggtaccgggtttcggggtacgggttacccgggttaccgttccccggggtttaaccggttacccgtttacccgttaaacccggg

SEQ ID NO: 7960 - DNA, 789 bp, Homo sapiens
  misc_feature: GYAE6OF02HE6QY.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgactaagtgcttcgtgggtctcgtggatgcgaggtgggattagttgtgtatcgactatccgtaccgttcccctaccttccctcccgtaccgtcccccgtaccctaacccccgtgggaaccggccggtccccgtcccgttacctacgttcctccgtcggtaccgtacggttacctacggtaccgaggtaccgtcccttccgtaggactaggtaacggtaaacgtacggaacctaacgttaagttacggtttaggtacgtttaggtacttacgacgtacgaaaggacgacggacggtactacgttacctaacccgtaacctaacgttaccgtagttaccgttacgttaacgggttttacggttaaccgttaccgggtcccgggttaccccggttccggggtacctacggttaaccgggtacgttcggtaacgggttcggtaacggtaccggtaggtacgtacggaacgttaacctaagggtactttaacgttaccaacgttaaggtaccggttaagtaccctcggtaaacggtacgtaacgggttaagggaacgggtacgacgggtttaggtaagggttttacggggttagggtttttaacggg

SEQ ID NO: 7961 - DNA, 659 bp, Homo sapiens
  misc_feature: GYAE6OF02H2D8R.37.71.G05.1.454.CMB.1.raw
  modified_base (297)..(297): a, c, t, g, unknown or other
  misc_feature (297)..(297): n is a, c, g, or t
  modified_base (623)..(623): a, c, t, g, unknown or other
  misc_feature (623)..(623): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtgggctgctaatgctcgtggtctctggatgcgaggtgggtattagttgtgatgcatctaccgtccccactcctcccgtccgtccccgtccaccccgtggacgacgcccggcctaccnctcctcctgcgtaggtctacgcgagaccgtccgttcctcgactagtacggaacgtacgaacctaacttaacgttacgtttaggtagtttaggttactacgttcgacgtaacggaacgccgacggacgtacgtaccctaccgaacctaaccgttcgtataccgtgttaacgtttccgggtaactaccggtccggtacccgttccgggtcctagacgttcgggtacgacggtcgacgtaggtacgtacgtacggacgctaagttaacgttcttaaccgacgtacgtaggtaacgacgttcgacggagtaggtacggtcgggtaacggngttaacgggtacgggttaggttagggttttaacggg

SEQ ID NO: 7962 - DNA, 669 bp, Homo sapiens
  misc_feature: GYAE6OF02HUWMP.37.71.G05.1.454.CMB.1.raw
tcagtagtgtagatcacgaccggtgctcgatttagtgtcgtcgcaagagagagggggtcaggctggaactgaggagcagggtgggggcacttctccctctaacactctcccctgttgaagctctttgtgatcaggactcctcagttcaccttctcacaatgaggctccctgctcagctccgtggggctgctaatgctctgggtctctggatgcaggtggggatagttgtgatgctatccacgtcccactcctccctcgccccgtcaccccgtgggacgacgcccggccctccactccgtcctgcgtacggtctagtcagacgtccctcgtgactagtaggaaaacgtcggaacctaacttaactttagttaggtatttacgggtaacttcgtaggactaaggaaaccggtccgaacggggtacacggttaccctacgaaacccgtaaccttccgtagtacttcgttacgggtttaccgggttacttaaccgggttcccgggacccggttcccggggttaccctacgggtaccgttcggttacgtacggtgggtacgtaggtacggaatcggacgtccgtaagacttacgttacacgtacgtagaagtacgtacgaagcgaacggtaggtagggacggtacgtagggacggttagttaggggtttacggg

SEQ ID NO: 7963 - DNA, 643 bp, Homo sapiens
  misc_feature: GYAE6OF02JTCV1.37.71.G05.1.454.CMB.1.raw
  modified_base (139)..(139): a, c, t, g, unknown or other
  misc_feature (139)..(139): n is a, c, g, or t
  modified_base (183)..(183): a, c, t, g, unknown or other
  misc_feature (183)..(183): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (485)..(485): a, c, t, g, unknown or other
  misc_feature (485)..(485): n is a, c, g, or t
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
tcagtagtgtagatcacgaccggtgctcgatttagtgtcgtcgcaagagagaggtgccttagccctggattccaaggcatttccacttggtgatcagcactgaacacgaaagactcaccatggagttgggctgttctgngttttccttgttgctgttttagaaggtatccactgtgaggtacngtcgtggtaggaatcgtgggggagcgttcggtacagtccgtggacgggtccctggagacctccgtcctggtcgccagttcgtcgtaggattccgaccttccgagtcctttgacctgtgagcgtcgggtcgaccggntacccgtagggaggtcgnggtacggtgggtccngctccagtcagttanacgtgtcaaaccgngttaacacgtacgcgtacttagttcgtaagaccgggtctacgttcaacncgttacnctaacggacgagtaaccgactaacggatccgttgtccttgttcgtacncgtagttagcggttaaacncggtacgnggtaacgcgtaccgcgacgtccgtacctactaagttacttaccggtcgtaccggtacgtaacggtaggtccgggtaccggtggtaccgggtcgttacgggtcgtaaccggtccgggttatacccggtaccg

SEQ ID NO: 7964 - DNA, 587 bp, Homo sapiens
  misc_feature: GYAE6OF02FSJYG.37.71.G05.1.454.CMB.1.raw
  modified_base (313)..(313): a, c, t, g, unknown or other
  misc_feature (313)..(313): n is a, c, g, or t
  modified_base (527)..(527): a, c, t, g, unknown or other
  misc_feature (527)..(527): n is a, c, g, or t
tcagtagtgtagatcacgaccggtgctcgatttagtgtcgtcgcaagagagaggggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggattattgtgatgcatcacgtcccactctccctgcccgtcaccccgtggacgagcccggcctccatctccctgccaggtctagtcagcgcctcngcatggaatggacactaacttatggtattggttatctcgacagaagtccgagggcaacgtcctaccgaacctaacctccgtagtatccgttagtttccgggttactaacggtcccggggtccgttaccccggggtcccttaggacgtacgggttcaggttcggacagggtgtacgtcgaggccaacgtgtaacttccgaactcgtagaacggtntaccgacggacaacggtaggtcggggacgtcgtaggacgggttgtttaggttttacgggg

SEQ ID NO: 7965 - DNA, 698 bp, Homo sapiens
  misc_feature: GYAE6OF02IC4DO.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctcgtgggtctctggatgcaggtggggattattggtgatgcatcacgtccccactcctaccctcgccccgtccaccccgtggacgacgcccggccttccgattcctccgtgccgtacggttactacgtcgaacgcgtccctccgtcgactagtacggaaatcggaacctaacgtaacgtttagtttagggtatttaggtacttcgtacggtacgaacgaacgccggtagggtacctaacggttacctaccctaaccgtaaacccttccgtaagtaccgtttacgttacggttttaccgggtttaaccttacggggttaccccggggtcccggtttaccccggggtacctacggtaccgttacgggttacgtacgggttggacgtaagggtcggtaacttcggaacggtctaagtaacgtactttaccgactacgtaagacgatacgagtacgtaggtaggtacggacggtacggtaggtacggttacggtttgggtttaacggg

SEQ ID NO: 7966 - DNA, 777 bp, Homo sapiens
  misc_feature: GYAE6OF02HYZIQ.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggcctccctgctcagctccgtggggctgctaatgctcgtggtctctggatgcgaggtgggtattagttgtgactgcatcgaccgtcccctacttcctcccgtaccgccccgtaccctaccccgtggacgaccggcccggtccctacctactccttccgtggaccgtacggttacctaacgtccgaaggtaccgtcccttccgtcggacaaggttaacggtaaacgtacggaaccttaaacgttaacgttttagtttacgggttaatttcgggtaaaccttacggtaggaaccgtaaacgggaaccggtacccggaagggttacctaccggttacctaaaccccgtaacctaaccgtttacccgtagtaacgtttccggtttaacggtttaccgggttaaccgtaaccgggtcccgggttcccgggttacccgggttctaacggtaacgttcgggttacacggtcggtaacgtggtacgtacgtacgcggaactacgtaggttaccttaacgacctacggtacgaagtacgttaccggaacggtaacgaacgggttagggtaacgggtacggttaccggtaagggttaacgggttagggttttacggggttaacggg

SEQ ID NO: 7967 - DNA, 756 bp, Homo sapiens
  misc_feature: GYAE6OF02JS1ST.37.71.G05.1.454.CMB.1.raw
  modified_base (623)..(623): a, c, t, g, unknown or other
  misc_feature (623)..(623): n is a, c, g, or t
  modified_base (695)..(695): a, c, t, g, unknown or other
  misc_feature (695)..(695): n is a, c, g, or t
tcagtagtgtagatcacgaccggtgctcgatttagtgtcgtcgcaagagagagggggtcaggctggaactgaggagcaggtgggggcacttctccctctaacactcctcccctgttgaagctctttgtgatcaggactcctcagttcaccttctcacaatgaggtcctcctgctcagctccgtggggctgctaatgctcgtgggtctcgtggatgacgtaggtgggtatgttggtagattcgctatccgaccgtccccacttcctccctcggaccccgttccgaacccgtggaacgccggcccggtacctacctacgtcctaccgtcggtccgtacgggtacctaacggtccgtaaacggtccgtccccgttaccgtcggacctaacggttaacgggaaacttccgggaaaccttaaccttaaaggttttacggttagggttacgtttagggtaaccgttacgtacggtaccgaaaacggtacggacccggtagggactacgttccacctacgtaactcgtagtactacttcgggtttacgtacgtacggtccggtaccggttcccggtctagtacggttcgtaccgagggttccggacggtcgtacgacgtcgtaacggtanacctacggttaccttacggacccgttaaagtcgggtaaacgccgtttacggaaacgttcgggtaaaaccggngggttaaccgggtaaggtccttaaacggggtcgggtttaaggttcgggtttttaaaacggg

SEQ ID NO: 7968 - DNA, 854 bp, Homo sapiens
  misc_feature: GYAE6OF02HMQD2.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgacggctccctgctcagctccgtgggctgctatgctcgtgggtctcgtggatgcgtaggtggggtattagttgtgatgcatcacgtcccctactccctccgtcgccccgtccacccgtggacgacggccccgcctacctacttcctccgtcggtccgtaacggttcctaacgttccgaacgccgtccccgttaccgtagaccgtaaaggttacgggaaaacgtccgggaaacctaaaccgtttaaacgttttacgttaggggtaacgttttacggtaacgttccggtaggacgtaaacggtaaccgggtaccgacgggggtactaaccggttaccctaacccgtaaacctaacccgtttaccgtacggttaaaccgtttacccgtttaacgggtttacccgggtttaccggttaacggggttccccggggttaccccgttaccccgggggtttaacccgttccgggttaaccgttaacgggttacccgttacgggtcgggttaacgggtaacggttcgggtaacccgttacgaccggtaactaaccgggtaactttaaccgttttaaccgaccggttagttaaacgggacgttaacgtacggaaccggaaggttaaccgggtacggggtttacgggaacggtttacgggaacggggtttaagggtaccggtttttagggggtttttaaaccgggg

SEQ ID NO: 7969 - DNA, 580 bp, Homo sapiens
  misc_feature: GYAE6OF02H6CET.37.71.G05.1.454.CMB.1.raw
  modified_base (364)..(364): a, c, t, g, unknown or other
  misc_feature (364)..(364): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
  modified_base (465)..(465): a, c, t, g, unknown or other
  misc_feature (465)..(465): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttgggctgttctggattttccttgttgctgttttagaggagtccatgtgaggtacagctggtggaatcgtgggggagcttggtacagcctgggacgggtccctggacgtactctccgtgtgacattcgtctggattccaccgttccgagtccttttgactatgagctgggtccgccgggctccgaggggtagggtcgtgggagtgggtctcactccatcagttacaatcggtcaaactntatacgtacgcagtattttggagtacgggcctctcaccatcctacagacgaacaaccacaagngtctctcttgtttcntcatagtcgactacgcaggacgngaccgaccgcggccgtactctataacttcgtacgtcggaccgtaggacggtcgggtaacgggtcgggtggacgttgggtcggtacgttccgggtacgtaccgttacgttaaccgg

SEQ ID NO: 7970 - DNA, 826 bp, Homo sapiens
  misc_feature: GYAE6OF02IO162.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttgggctgttctggattttccttgttgcttgttttagaaggtgtccactgtgagtacagctggtagaatcgtgggggaggtcttggtacagccgtgggacgggtccctggacgtactcctccgtgtgactagtccgtcgtaggtactttcctaccttccgtagtccttttgactactgagtcgttcggggccgcccgggtctaccggacgggggtaagggtccggtgggtaggttcgggtccgtctactacctacttacgtacgtttaacaacgttcggtaaaccaaaccgtaacttaacttaaccgtaacggactaacgttacgtttttacggtaacgggtaacgggtccccgtactttacccgtaaccctaccgttccgtaaccgtaacgtaaaccggaaaccctaaacccggtaccgaaacgtcgtacgttacctttaccgttttcgtttacgttacgtacttaagttacggttacgaccgtacgtacgacgaagggtaccggaccgaaaccggtcccggacggttacccttacgtttaacgtttaacgtttaccggttacggtaccggttaaccggtaagggtaacggggttacggggaacccggggtttcgggggtaccggtttaccgggtttacgggttcccggggttaaccgtttacccggggtttaccccgtaccgtttttaaacccccgggg

SEQ ID NO: 7971 - DNA, 705 bp, Homo sapiens
  misc_feature: GYAE6OF02GX52F.37.71.G05.1.454.CMB.1.raw
  modified_base (239)..(239): a, c, t, g, unknown or other
  misc_feature (239)..(239): n is a, c, g, or t
tcagtagtgtagatcacgaccggtgctcgatttagtgtcgtcgcaagagagagggggtcaggctggaactgaggagcaggtgggggcacttctccctctaacactctctcctgttgagctctttgtgatcaggactcctcagttcaccttctcacaatgaggcctccctgctcagcctccgtggggctgactaatgcctcgtggtctcgtggagtgcgagggtgggattgttgtgagtnctatccgaccgtcccctaccttcctcccgccgtccccgtcccacccgtggacgcgccgaccctccgtactccgtcctgccgtacggtctagtaccgacgtccgtcctccgtagacgtaagtaacggtaagtacgtaaacctaaccttaaacgtttaggtttaggtagttttcggttacgtcgtacgaacgtaacgaaaccgggtccggacgggtaccgtaacgttccccgaaacctacgttaaccgttccgagttaccttacgtttacggtttacggttacccgtaccgggtccccggggtcccgtccccgggttacctgggtaaccgtttggtaacccgagggtccggaacgttaggtcgactacgggacgtaacacggtaagtccttacgacctagtacggtacgacgtacgacggtcgaaagggttcggaggtccgaaaggtttggcgggtttagtttcgggg

SEQ ID NO: 7972 - DNA, 708 bp, Homo sapiens
  misc_feature: GYAE6OF02FO473.37.71.G05.1.454.CMB.1.raw
  modified_base (311)..(311): a, c, t, g, unknown or other
  misc_feature (311)..(311): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtggggatattgtgatgcatcacgtccccactcctccctcgccccgtaccaccccgtggacgacgccggcctccatcctcctgcaggtctagtcagcncctcgtgcagtaggaataggaccaacgtaaactttagttaggtagtttaggtacttacgttacgacgtaaggaaacggtacccggaaggggcctaacgtcctaacccgaactaaaccgtccgtagtacttcgttacggttccgggttactaacggttcccgggcccggtttcccgggggaccccttagggtaaccgtaggtttaccgtagggttacgggtaccgtaaggggtttcgggaacgtaccggtaacgggacctaaacgtaacggtttaaccttttacgaaccgtaagttacggaaacgtaacgtacgtaacggacggttaaaccgggagggttacgggtaacggtaccggtttaagggacggggttaaggttttcgggggttttttaaggg

SEQ ID NO: 7973 - DNA, 700 bp, Homo sapiens
  misc_feature: GYAE6OF02GXYH0.37.71.G05.1.454.CMB.1.raw
  modified_base (580)..(580): a, c, t, g, unknown or other
  misc_feature (580)..(580): n is a, c, g, or t
  modified_base (615)..(615): a, c, t, g, unknown or other
  misc_feature (615)..(615): n is a, c, g, or t
tcagtagtgtagatcacgaccggtgctcgatttagtgtcgtcgcaagagagaggggtcaggctggaactgaggagcaggtgggggcacttctccctctaacactcctccccgtgttgaacgtcttcttgtagactcgaggtacctcctctagttcctaccttctacgacaagtgacggtcctccctgtctacgacggtccttccggcggggtctacgtaccttaagtcggtaccttcggttcggtcctcgtcgggaatcggaccgtgggttacgggtattaggttacgtcgatcgactacgtctaccgtcccctacctcttcccgtacgccccgtctaccgtaggacgccgcccgtacctcctagttccctcggtacacgttcggaccttacgtacgaacgttcctaccgttccgagtcgttaaagaacggtaagccggaaaacttacgttaaacgtcggtttcgaacggttttgaaccttggacgttaacgaacgtaacgccgtcggtacctagcccttacgaccgtacctcgtctacgttcgttacgtacgttacgacggtcccggtcgaccggttcncgttagcgttagcgtgctgactcgtgacacgtacncgttatacgacacgttagacttaagccgtagacgtaacgggttcgaacggtttcacgttaggtaccgttggttacggttttacgg

SEQ ID NO: 7974 - DNA, 777 bp, Homo sapiens
  misc_feature: GYAE6OF02GKXB9.37.71.G05.1.454.CMB.1.raw
  modified_base (750)..(750): a, c, t, g, unknown or other
  misc_feature (750)..(750): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgagctcctgctacagctccgtgggctgctaatgctcgtggtctcgtggatgcaggtgggtattagttgtagtatgactatccgacgtccccactcctccccgtgcccccgttaccgacccgtcggcgaccggtcccggccctcctattcccctcgtccggacgtacggttaccgttacggacgtacggtccgtccgttccgtgaccgtaaggtaaaggacgttaacgggaccttaaacttaacgttacgttaggtagtttacggtacttcggtacgaacggtaacggaacggtaccgggagtacccggtaacctcccttaacccgtaacgtaacccgtttccgtaacggtttaccgttaaccgttttaccgggttttaaccggtttacggttaaccccgggtccccggggttaccccgggttacccgggtccgttaaccggttacggttacggttacgggttaccgggttgttaccggggtacgtaccgggtacgtaaccgggtactacggtaccgttaacgggttacttaccgacgttacggtaagacgtacgtacacgggtaggttacggtaggtacggtacgggtagngggttaaggtttccggtagggtttacg

SEQ ID NO: 7975 - DNA, 891 bp, Homo sapiens
  misc_feature: GYAE6OF02H97CR.37.71.G05.1.454.CMB.1.raw
tcagtagtgtagatcacgaccggtgctcgatttagtgtcgtcgcaagagagagggccttagccctggattccaaggcatttccacttggtgatcagcactgaacacaaaggactcaccatggagttgggctgttctgattttccttgttgcttgttttagaaggagtccactgtgaggtacagctggtaggaatcgtgggggagcgttggtacagccgtggacgggtccctgacgtacctctcctgtgcagtcctcgtggtatttcctaacgttttggtagtcttagttggtagtacggtacgtcgggtcccgccgtacggttccgtaccggaaggggggtaacggggtcggttaggggacgggttgggggtcggaaccccgtaaacgacgttaaccggtaagggggtacgggttaggggttacggtaaaaccgtaaaaaacgttagttacggtacgggtacttcggttaggtcgggaccggggtaccgtaactttccgaacctacgttccgtcccgaaggaacgaaccgaaaccggaaaccctaaaaaccgtcctaacgtgttaactactacgaaacgtaacgtacgggacccggtaccgtagaacggtacgtaaccggacgggtaacccaccgggtacgtttaacgggttagttttaaaccgtttaggttcgggttaacgggtaaccggtaaagggttaaacgttttaaacgtttaacggtaaacccgttttaaaccggttttaaaacggggtttttaccgggtaaacgggtttaccgggtttaaaccgggttttaaccggggttttaaagttacgggttaaccgtttacgggggttttaaccttttaaaaggtttacccgggttaacggtttaaaccccccggggggg

SEQ ID NO: 7976 - DNA, 573 bp, Homo sapiens
  misc_feature: GYAE6OF02HD3V2.37.71.G05.1.454.CMB.1.raw
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctactcagctccgtggggctgctaatgctctgggtctctggatgctagtggggatattgtgatgcatcacgtccccactcctccctcgcccgttccaccccgtggacgacgcccggtacctccatcctccgtgcaggtctagcaggacnccctctgctagtaggaatggaactacaaacttntggtattggtatctgacganaacgcgaggcagtccacactaactctagatcgttagttcggtatacgtccggtccgtccgggtcctgactggtngtgcaggtgactgacggtnaacgtacgtatttacgacgtaacgtagaagtacgtcaacggtacggaacgggttaggtagggaggtacgttacgggtaaggtacggttttggggtttaacgggttttaacg

SEQ ID NO: 7977 - DNA, 874 bp, Homo sapiens
  misc_feature: GYAE6OF02F2JYF.37.71.G05.1.454.CMB.1.raw
tcagtagtgtagatcacgaccggtgctcgatttagtgtcgtcgcaagagagagggggtcaggctggaactgaggagcaggtgggggcacttctcctctaacactctcccctgttgaagctctttgtgatcaggactcctcagttcaccttctcaacaatgaggcctccctgctcagctcgtggggctgtactaagtgctcgtcgggtctcgtggtatcggacgtaggtggggtattacgttgtagagttcggctacgtccgtaccgtacccctacgttccgtaccccgtcgtccccgttaccgaccccgtggacggtaccgcccggtccttacctacgttcctacccgtcggtaccgtacgggttaccgttacggttaccgaacggtacccgttccccgttaccggttacgtaacgtaacggttaacggtaaacgtccggtaacctaaccgtttaaacgtttaggtttacgggttacgtttacggtttacgttaccgtaggtaccgtaaggtaacgcccggtacgggtcctaaccgtaccgtaccctaaacgtttaacccgtttcggtaaacgttaccgtttacgtttaacgggtttaccccggtttaacgtaaccgggttccccgggggttccccgttaaccggggggttacccctttaaggggaacccggtttacggttaccgtacggggttaccggtaacggttaagggttccgttaccgtaacgggaccgtttaaccggtattacccggttttaacgacccgtaaccgtcggtaaacggttaccgttgtaacccggaagttaccgggtaaggacggttagggtaaccgttagggtacggtttacgggtttggtttaacggggttttacgg

SEQ ID NO: 7978 - DNA, 630 bp, Homo sapiens
  misc_feature: GYAE6OF02IS76S.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgagctccctactcagctccgtgggctgctaagtcgctcgtggtctcgtggatcgcaggtcggggtatagttcgtagattgcatacacgtccccactcctccctgccccgtccacccgtggagacgcccggtcctcctattccgtcctgactacggtctacggacagacgtcctccgtgactagtacggaaagtccggaacgtaactaacgttagttaggtacgttagtatcgtcggagaacggacgtccgagggtcacgtcaccgacgtactcctagtactacgttacggttacggtactacgtccggcccgttcccggtctagacgtacggtgacgtcggacgtaggtcgtaactcgaacgcgtaattacgtaccttacgaacttacgtacggaattaccaggtcgacggttaaacggtcgaacgggcggttaacgtaggtacggttaagggttttcgggtaagtttacg

SEQ ID NO: 7979 - DNA, 677 bp, Homo sapiens
  misc_feature: GYAE6OF02IA6HO.37.71.G05.1.454.CMB.1.raw
  modified_base (253)..(253): a, c, t, g, unknown or other
  misc_feature (253)..(253): n is a, c, g, or t
  modified_base (480)..(480): a, c, t, g, unknown or other
  misc_feature (480)..(480): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttgggctgtctggattttctgtgctgtttagagagtccatgtgaggtcagctggtggaatcgtgggggagtcttggacagccgtgggagggtccctggacgtactcgtcctggtacgctagttccgtntggtaattcaacccgtttcgacgtctttttggactatgacgtgtcgggtccgccggactccgagggtaacgggtccgtaggaggtggtctcgagtccatcctagtactaatgtacaaaactgtaactacgtacgactaggtagtttgtaggaacggtccgcttacaccctatctacgacgaacgacaaaccggaccaaggacgtaccttacgttctttacgtttacnggttctaagttacgttacgaccgtaacggtcgtacggaaccgggacgtacccggtaaccggaccgggtccgtacggttaccttaaacgtttaacgttaccgttggaccggtaggtaaacgtcgggttacggggacggttccggggtaggtccggttacgggttcggtacccgtttcgggtccgttaacgttaacccg

SEQ ID NO: 7980 - DNA, 814 bp, Homo sapiens
  misc_feature: GYAE6OF02JRBQZ.37.71.G05.1.454.CMB.1.raw
tcagtagtgtagatcacgaccggtgctcgatttagtgtcgtcgcaagagagagggccttagccctggattccaaggcatttccacttggtgatcagcactgaacacaaaggactcaccatggagtgggctgttctggattttccttgttgctgttttagaaggagtcactgtgaggtacagctggtggaatcgtgggggaggcgttggtacagccgtgggacgggtcccctagacgaccttcgtccgtgtcgcctagtccgttcgtggtaacttccaccgtttcccgaagttccgtttttagacctattcggacgtccggtcgggggtccccgacccggggtcttacccggaagggggtaacggggttctacgggggtacgttcggggttccctactaacggtccctagttcccggttaagttaccgtaaacgtttggaaccctaaaacccgatttaaccgttaaccgtaacgtccgtaaaggtttacgtttttacgggagggtaaccggggtacccttcggtttaccaacccggtattacccggttaccgaagtaccgtaaccgaaccgacgaacgtaaccgtccttacgttctttcggtttacctggttacctagttaacggtggaaaccgttacggtcccggtaaggtaccggtacccggtacccggtaacggtaccgggtacccgtcgtttacccttaaagttaaccgtttcggtacggttgaaccggtacgtacggtacgggtaccgggtcgggtacggtcgttacgggacgtacggttccgggaccggttacccttaggttaacccgg

SEQ ID NO: 7981 - DNA, 675 bp, Homo sapiens
  misc_feature: GYAE6OF02IYZ08.37.71.G05.1.454.CMB.1.raw
  modified_base (424)..(424): a, c, t, g, unknown or other
  misc_feature (424)..(424): n is a, c, g, or t
  modified_base (480)..(480): a, c, t, g, unknown or other
  misc_feature (480)..(480): n is a, c, g, or t
  modified_base (623)..(623): a, c, t, g, unknown or other
  misc_feature (623)..(623): n is a, c, g, or t
tcagtagtgtagatcacgaccggtgctcgatttagtgtcgtcgcaagagagaggggccttagccctggattccaaggcatttccacttggtgatcagcactgaacacaaaggactcaccatggagttggggctgttctggatttttccttgttgctgttttagaaggagtccactgtgaggtacagctggtggaatcgtgggggagcgttggtacagccgtgggagggtccctgagactctcctggtgcatcgtctggattcaccttccgagtctttgactatgacgtcgtcgggtccggccggcgtccgaggggaaggtcgtaggaggtgggtctacactcctagtcgtaagtactaagtcggtaaccaaaacgtctaagtaacctacggctaagttacttttaggtacggtaagggcccgtnttaccgtaacctacgtacctaccgaggaagacctaaacgacccaaaggacgtcctnttaccgttgtttctaacggctagtacgttacggacgtacggcctaggaacggaacgtcccgaaccgggaccgtacccggtcgttaacctacgttaaatttccggtacgttcgacggagtaagggttacgggcgggttccgggnggttaccgtgggttaccgtaaccgttcgggaccgttacgttacccgtacggg

SEQ ID NO: 7982 - DNA, 824 bp, Homo sapiens
  misc_feature: GYAE6OF02FK57D.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgctaatgctctgggtctcgtggatgcgaggtggggattagtgtgattgcagtcaccgtcccctacgtcctcccgtcgtccccgtaccaccccgtgggacgacggtccccggcccttacccacgtccttaccgcgaccggtacggttctacgtccgaacgccgtccctccgtgacgagtacggtaaagtcggaactaacgtaacgtttagttacggttacgttacggttacctcggaacgtaacgggaacgccggtaacgggtaccgttaaccgtcccgtaacccgtacctaacccgttccgtacggttaactttccggtttaacgggttttacccgggtttaacgttaaccccgggggtttccgggtaccccccgggttttaccggggggtaccccttacggttaaaccgggttccgggttaacggttaccggggtcggtaacgttacggggtaacgttaccggtaaccggaacggccgttaaacgtaaccgtttaacgtttaccaaaccggttacgtagggtaaccgtacggttaacgaacgggtaaccgtaaggggttacgggtaaggggtaccggtacgggttaaggggtaacgggttttacgggtttttacgggggttttaaagttttaccgg

SEQ ID NO: 7983 - DNA, 784 bp, Homo sapiens
  misc_feature: GYAE6OF02F2RD9.37.71.G05.1.454.CMB.1.raw
  modified_base (195)..(195): a, c, t, g, unknown or other
  misc_feature (195)..(195): n is a, c, g, or t
  modified_base (698)..(698): a, c, t, g, unknown or other
  misc_feature (698)..(698): n is a, c, g, or t
tcagtagtgtagatcacgaccggtgctcgatttagtgtcgtcgcaagagagaggggggtcaggctggaactgaggagcaggtgggggcacttctcctctaacactctcccctgttgaagctctttgtgatcaggactcctcagttcaccttctcacaatgaggctccctactcagctccgtggggctgcttaagngctcgtgggtctcgtggatggctaggtggggtattagttgtgagttggacagtcacgttacccccacttcctcccgtcgaccccgtaccaccccgtgggaacgccggccccggccctccacgttcctccgttggaccgtacgggttcctacggtacgaaaccgccggtaccccttccgtagtacgtaaggttaacgggaaacttacgggaaccaaacctttaagtttaggtttacgggtaagtttacgggtacttacggtgaacgtaacggaaacgtccggaggtcgaacgttaccctaccaacgtaaccctcgtaggttacctttagtttacgggtttacgggtttaccgttaaaccgggttcccgggtacccgggtttcccgggggtaccctttacggtaccggtacgggtttaccgtacgggtcggtacgttagggtaccgaggttaccgaacgggtactaacggtacgttaccgtacttaaccgggacttacgggaacnccgtaacggtacgaacgggtaaagggttcgtaggggacggtttaggaaggggttaggttcgggttttagggtttacggggtttaac

SEQ ID NO: 7984 - DNA, 671 bp, Homo sapiens
  misc_feature: GYAE6OF02FJPEW.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcaggtgggatattgtgatgcatcacgtccccactcctcccgtcgtcccgtcaccccgtggacgacgcccggtcctccactcctcctgctacggtctagtccgagacgtccctctgcctagtacggaaatcggaaccaccgtaaactttagttaggtagtttaggtactcgtacgactaaggacgccgagggtacctacggtccctaccgtaactaacccgtccgtacgtactttccgttacggtttaccggggttaactaaccggtcccggggtaccccggttcccgggggttcccttacggtaccgttacgggtttccgacggttcggtccgaaggttcggaactcggaacggttaccgacttaacggtacttaccgaacgtactaggaacgtagtacccgaaggtccgtacggaggtacggtacggtcgtagggtaggttacggttgggttttaacggg

SEQ ID NO: 7985 - DNA, 693 bp, Homo sapiens
  misc_feature: GYAE6OF02GGNOX.37.71.G05.1.454.CMB.1.raw
  modified_base (631)..(631): a, c, t, g, unknown or other
  misc_feature (631)..(631): n is a, c, g, or t
tcagtagtgtagatcacgaccggtgctcgatttagtgtcgtcgcaagagagaggggggtcaggctgggaactgaggagcaggtgggggcacttctccctctaacactctcccctgttgaagctctttgtgatcaggactcctcagttcaccttctcacaatgaggctccctactcagctccgtggggctgctaatgctctgggtctcgtggatgcaggtggggtattattgtgatgcatcaccgtccccactcctccctcgcccgtccacccgtggacgcggcccggcctccactcctccgtcgctacggtactacgtcacgtacgcctcgtcgctaagtaggtaaatcggaactaactaaacgtttagttacgggttagttaggttacgtcgttacgacgaacggaacggcccggaagggtaccgtacgttccctaccgaacccttaaccgttcctagtactttacgtttaacggtttaccgggtttaccttaaacgggtccccgggtacccgggttccccgggggttaccctaggttacccggtaacggtttcgacgggttcgggacgtacgggtggtacgtacgacggtcaacgtattacgtttaccgaacgacgtagaaatacgtanacggacgtaggtacggtggtaccggtagtagggaggttacgggtttagggtttacggttacg

SEQ ID NO: 7986 - DNA, 785 bp, Homo sapiens
  misc_feature: GYAE6OF02FPTGG.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggctccctgctcagctccgtggggctgctaatgctcgtgggtctctgatgcaggtgggatagttgtgatgcatcaccgtccccactcctcccgtcgaccccgtccgaccccgtggacggacggcccggtcctcctacttcctccgtggtccgacggttctacggtaccgacggacgtcccgttcctggactaagttacgggaaaacgttcggaaacctaacgttaaactttaggtttcgggtaacgttttacgggttaactcggttacgacggtaaacggacgggtaccggacggggtactacggttacctacccgtaaacctaaccgttccgtaacgttacgtttaccgtttacgggtttaccggggtttaacctaaccggggtcccgggttaccccggtttccgggggtaccccttgggtaaccgttcgggttaccggtacgggtacggtacgtaggggttacgtaccggttcggaacggtaccgtaacggttaacgtttacctttaccgaacgttacgtaagggtaaccgttacggaacggtaacgtaccggagggttaacgggtcgggtaccggttaggtacgggtaacgggtttacgtttaggggtttttaaccgggg

SEQ ID NO: 7987 - DNA, 650 bp, Homo sapiens
  misc_feature: GYAE6OF02FYXK7.37.71.G05.1.454.CMB.1.raw
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgactatgctcgtgggtctctggatgcaggtgggtatattgtgatgcatcacgtccccactcctccctcgccccgtcaccccgtggacgacgcccgctccatcctcctgcgngtccgttagcacggtacncctcctgntagtacggaaacgtgaacaacttaattagttcggtagttggttactgtacgactaagggaaccgcgtaacgggtctaacgttcctaaccgaaccgtaacctttcgtagtaccgttacgttacggtttccggttaactaacggtcccggggtcccggttaacccgggtcctaggtaccgttagttccgtagggtcgagtccggtaagtccgacggtacgctaacgttacgttactaccgaaccttaggactaaacgtctaacgacggaaccgttaggtaggtacgggtacgtccggaagttacgggttggttaggttttaaccgggg

SEQ ID NO: 7988 - DNA, 696 bp, Homo sapiens
  misc_feature: GYAE6OF02GTWO2.37.71.G05.1.454.CMB.1.raw
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
  modified_base (406)..(406): a, c, t, g, unknown or other
  misc_feature (406)..(406): n is a, c, g, or t
  modified_base (448)..(448): a, c, t, g, unknown or other
  misc_feature (448)..(448): n is a, c, g, or t
tcagtagtgtagatcacgaccggtgctcgatttagtgtcgtcgcaagagagagggccttagccctggattccaaggcatttccacttggtgatcagcactgaacacaaaggactcaccatggagttggggctgttctggattttcctgttgctgttttagaaggagtccactgtgaggtacagctggtggaactcgtgggggagcttggtacaggcctgggacgggtccctggacgaccttcctccgtggtgccacgccttcgtaggtaatttaaacgtgtttacgacctaactccgtggacctagtagtaaccgtcggggtacccnccgacggccgtcccggganaggtcggggctcggacgtaggtcggtactacgaacgttcgtaagcgcttccggtagtaanagagacagactcgacagcgtcgtaggacgggtccgtacactntcacgagagactactacaaagacacgctactacgtcacgactaaagtacgaacgcgtacgtacgaacggaacggaaccggtaacggaaccgtaccgggtacttaaacgttaaccgttacgtgggttacgaagggtaccggtaacggggttacgggggtaacgggttacggggggtaaccttacggggtacggggaacccggtaaccggggttaccccgttacgggttaccccggtacccgttacccgg

SEQ ID NO: 7989 - DNA, 751 bp, Homo sapiens
  misc_feature: GYAE6OF02IMY5L.37.71.G05.1.454.CMB.1.raw
  modified_base (176)..(176): a, c, t, g, unknown or other
  misc_feature (176)..(176): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggcctccctactcncgctccgtgggctgctaatgcttcgtggtctcgtaggtatgcgtagggtggggtaattagttggtgtatcgactacttcgaccgttccctactcctcccgtccggtcccctccgacccggtaggacggaccggtcccggtccctcacttccgtcctacggacgtcggttacgtacgtcgtacggtaccgcccttcgtacggactaaggtaacggtaaacgtacgaaacctaacgttaaacgtttcggtagtacgtttagtacgtcgtacggaacgtaacggtaaccggtaccggtaagggtaccctacgggttaccctaacccgtacgttaaccgtcggtagtaacttcggttaacggtttccggtaaacgttacgggtcccgggttacccggttcccggttacgtaggtaaccgttcggttacgtacgggtcggtacggtaacggtcgaactacggaccgtaactcgtaaccttactaaccgaacgttacggaacgtaacgtcgtaaacggctaacggtacggtacggttcgggagttacgggtgtaacggtttaggttcggtttaaggttacg

SEQ ID NO: 7990 - DNA, 687 bp, Homo sapiens
  misc_feature: GYAE6OF02GGEWO.37.71.G05.1.454.CMB.1.raw
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
  modified_base (633)..(633): a, c, t, g, unknown or other
  misc_feature (633)..(633): n is a, c, g, or t
  modified_base (642)..(642): a, c, t, g, unknown or other
  misc_feature (642)..(642): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcacgttccaccttctcaactaatgacggcctccctgcctcagcctccgtggggctgcttaagtgcttcgtcgggttctcgtaggatcggcgtaagggttgggtaattagtttgtagtatcggactactacgacccgtaccccaacccttcctaccccgccggtcccctaccgtaacccggtcgggaacgacccgtcccggtacccctcctacttccctcctggactacggtctacgacacggtccncctcgngtactagacgtancggtaacactaatgtagtntaagtcactcgactaggaacgcgacggtctacgtccgaacctacctaacgtacgtacgtacttacgttaccggtttacgttaacgggtaaccggttccgggtaacccggtccgggttacccgtacggtaacggttcggttaccggacggttacggcgtcggtacgtcgacgtacgactaactgtaacgtcaactacgaacgtaacgtntacggaccnggtaacgtaggtacggtcgtcgtagagggttgttagggtttacgg

SEQ ID NO: 7991 - DNA, 760 bp, Homo sapiens
  misc_feature: GYAE6OF02JFSHL.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgttttaggaaggagtccactgtgaggtacagctggtggaatctggggggagcgttggtacacgccgtgggtacggtccctggacgtacttctccgtgtcgactagttcggttctggtacttaccgtaccttcccggtagttcttttagaccgtattggagtccggtcgggtcccggcccggggccttacccggaagggggaaccggttcgtgggtaggtttcggggtcctcgacttaccagttcgtaaggttaacaaggttcggtacctaaaaccgtaattaaccgtacgtaccgatagttagttttgtaaccggagggtccctacgttaccaaccgttcctacgttccgaacggtaacgaacccgaaaccgtacctaaacgggacttccttacgttccttacggtttcctcgtaactacgttacgtacggaacctaagtcccggttgaacggtacccgggtaaccggacccgggtaacgtcccggtacgttaacccttaagtttaccgtacttcggtcgtaacggagtaaccgggttcgggaaccggggtccggttggacggttacggtacggtcccggtacgggttaccaccgtttaacccgg

SEQ ID NO: 7992 - DNA, 610 bp, Homo sapiens
  misc_feature: GYAE6OF02HGF0F.37.71.G05.1.454.CMB.1.raw
  modified_base (332)..(332): a, c, t, g, unknown or other
  misc_feature (332)..(332): n is a, c, g, or t
  modified_base (571)..(571): a, c, t, g, unknown or other
  misc_feature (571)..(571): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggcctccctgctcagctccgtggggctgctaatgctcgtgggtctctggatgcgaggtggggattagttgtgatgcatcacctccccactcctccctcgcccctccaccccgtggacgaccgccggtcctcctatcctccgtgaccgtacggtctagtcgagcgcctcgngctagtagaatacggactaactacgttagttcggtacttagtatcgtgacgaacgacgcggaggtcacgtcctaccacacgttcatacttcgttagttcggtacgtacggtcccgggtccgttacccggggtcctcggtaaccgtacgtcgaggtcggtacgtacggtgacgtacgacgcgaacgttactacgttcgaccgtagtagtaccgagtacgaacgtcggaacggttacgggnggcgtacgggtaggtacggtttaggtttggtttaacggg

SEQ ID NO: 7993 - DNA, 727 bp, Homo sapiens
  misc_feature: GYAE6OF02JFC7V.37.71.G05.1.454.CMB.1.raw
  modified_base (168)..(168): a, c, t, g, unknown or other
  misc_feature (168)..(168): n is a, c, g, or t
  modified_base (216)..(216): a, c, t, g, unknown or other
  misc_feature (216)..(216): n is a, c, g, or t
  modified_base (394)..(394): a, c, t, g, unknown or other
  misc_feature (394)..(394): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgcttgttttagaaggngtccactgtgaggtacagctgggtggaatcgtgggggagcttggtacngcctggacgggtcctgagactctccgtgtgcatcgtctggacttcaccttccgagtcttttgacatgacgcgtcgggtccgccgggctccggaaggggtaggtcgtggaggtcgggtctcatccatacgagttacaagtcggtacaaactatactactacgactagttattttacggnggaacgggtcctcgttaccgacctacgtaccgtaccaacggtaacgaaccgaaccggacctaaaggaccgtccgttacctttccggttagttttccgtcgtacttaacgtttaacgtcgggtaaactaccgggtaccttagggaacggtaaccggacccggtaacccggacgggtccccgggttccttaacggttaagtttaccgttacgttacggttacggaacgggtaacggtagggttaacccggggaccgggggttacgggtacgggttccggtttaggggtaccgggttaacccggtttcccggggttaccgtacccgtttaacccgg

SEQ ID NO: 7994 - DNA, 709 bp, Homo sapiens
  misc_feature: GYAE6OF02FOPW4.37.71.G05.1.454.CMB.1.raw
  modified_base (126)..(126): a, c, t, g, unknown or other
  misc_feature (126)..(126): n is a, c, g, or t
  modified_base (168)..(168): a, c, t, g, unknown or other
  misc_feature (168)..(168): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (586)..(586): a, c, t, g, unknown or other
  misc_feature (586)..(586): n is a, c, g, or t
tcagtagtgtagatcacgaccggtgctcgatttagtgtcgtcgcaagagagagggggtcaggctggaactgaggagcaggtgggggcacttctccctctaacactctcccctgttgagctctttgngatcaggactcctcagtcaccttctcacaatgaggcctcctnctcagctcgtggggctgctaatcgctcgtgggtctctggatcggcaggtcgggtatagtggngntgcgatcacgtccctactccgtccctgtaccccgtcaccccgtggacaccggtcccgtacctccacttcctaccgtgaccgtacggttacctacgtaccgacgtcgtacccttccgtagtccgtagtaaccgggtaaatccgggtaaccaaacttaaacggtttacgttacgggaagttttcgggaacttcggtaagaccgtaaggggtaaacccgtccgggacggtaacctagttacccctaaccgacccgtaacgtccgttacgtaattccgttaacgttaccgggttactacggtcccggtaccgttccgggtacctggaccgttcggtagtacggtcggtgtaacgtcgngtacccgaggtccgagttacgaccgtttcgaactacgtacggaacgtaactcccggaggtacccgttacggaagggttaccggcggttaaggcgggtacgggttaccttggggtttaaaccgg

SEQ ID NO: 7995 - DNA, 715 bp, Homo sapiens
  misc_feature: GYAE6OF02GEY9U.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggcctccctgctcagctccgtggggctgctaatgctcgtgggtctcgtggatgcgtaggtggggattagttgtgatgctatcaccgtccccactcctccctcgccccgtccaccccgtggacgaccgtcccggtcctcctactcctccgtcgacgtacgtcgtacgtcaacgtcgtccctcctcgcaagtaggaaacgtcgtaacctaacgttaacgttagtacgggtagtttacggtaacttcgtacgacgtaagaacggtacccgggaaggtcccgtaacgtcccgtaacccaaccgtaaacccttccgtaaggttaccttacgtttacggtttacccgggttacttaaccggttcccggggtacccggttcccgggtccctaggtacccgttacggttcgtagggtcggtacgtacggttacggacgtacgacgtactaacgtacgttaaccgttcgaaccgtacgtaaggtaacgacgtaccgaaggtaccgaagggtcggtacgggacggttacgtagggtaaggtttacgggttagggttttaacggg

SEQ ID NO: 7996 - DNA, 775 bp, Homo sapiens
  misc_feature: GYAE6OF02HEC6F.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgcttgttttagaaggtatccactgtggaggtacagcgtgggtaggaagttcgtgggggtaggtcgttgggtacagtccgtgggacgggtccctgagaccgtctccgtgtcgctattccgtctggtacttccgtacccgttccggtagttcttttagactagtgacgcgtacgggtcccggccgggcctcggaacggggtacggttcgtagggtaggtcgggtcctcgacgtccacgttaccgtaagttaacgaagttacggtaaccaaaaccttcgtaaactaccgtaaccgtactaaggttattttacgggacggtaaacgggtccccgtaccgtttacccaaccctacgtacccgttacccgaaggtaaaccgtacccgaaacccggtaccgaaacggtcgtcccttacttaccgttcgtttccgcgtaacgtactaacggtcgaacaccggttcgacggaccggtacggtaccgggaaccgtacgggaccgttactaaccgttaacgtttacgttacgtacggttacggaacggtaggtaccggtacggggtacggtaccgggttgggtacccgggttaggtccggtacgggtttaccgggtacgttaaccgttacccgg

SEQ ID NO: 7997 - DNA, 937 bp, Homo sapiens
  misc_feature: GYAE6OF02FLKDK.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactccctcccgttgtagacgtctttcgtttgtatactacgaacggtacctcctacgttacgttacccttacccttcctacaaactaacgtaggaccggtcccttacccttaccgtaccgacgtcctccgggtcgggtcgtcgtaactagtccgtcgttcggtggttccttcggtagtacgtacgacggtaggggtagggtaatttaggttggtagtatcgacttactaccggtaccccttacccctaccgttccccctcccgtcccggtaaccccttaccccccgtaccgggtagggaaccgccccgggtacccccttacccctaccgtaccgttcccctacggtacggtaccggttcgtaccgttacggaccgtaacggtccccttcccgtacgggtacacttaaaacggggttaaacggtaaaccgtaccggtaaacccttaaaaactttaggttttacggttagggtaaccgttttgttaacctcgggaaaccgacgtaaaccgggtaaccccggagttaccgggaacctttccggaaccctaaacccgtaacccgttaaccttccgtaagtttacccgttaaaggtttccggggtttaacgtaaccgttacccggggtccccgggttcccccggggttaccggttaaccacgggtttaccggtaccgttacggacggttcgtaaacggtcggtaagtacccgtaagggtaccgtacgtaaacgtttacgttaacgtacccaaggacgtttaacggctacgtacggaaccgtaggtagtacggggtaggcggtaggtaaggggacgtttagggtttaccgggttaagtttcg

SEQ ID NO: 7998 - DNA, 690 bp, Homo sapiens
  misc_feature: GYAE6OF02HB4K3.37.71.G05.1.454.CMB.1.raw
tcagtagtgtagatcacgaccggtgctcgatttagtgtcgtcgcaagagagaggggccttagccctggattccaaggcatttccacttggtgatcagcactgaacacaaaggactcaccatggagttggggctgttctggattttccttgttgcttgttttagaaggagtccactgtgaggtacagctggtgaatcgtgggggagtcttggtacagccgtgggacgggtccctgagacctctcctgtgctagtcgtctggtattcacccttcgagtctttgactatcgagcgtcgggtccggcccggtctaccgaagggggacgggttctggggtacggttagggtcctacgactcccgaatccgtaagttacaagtacggtaccaaacctatacgtacctacgctagtacgttttggaggtacgggtccgtacttccaacctctacctcgtaagtaccgaacgtaaccgaccgtaacgacgtccttacgttccgtttacgtttcctaggcccttaagtcgtacgggaacctacgtccgtaggacggaccgaccggacgaccgtcggtacttctaacgttacttaccgtgttacggcgtaagggtacgtccggggtaaccgggcgggttcggtacgttacggggttaccgtaccggtttccgggtaaccgttacgttaccttaaacccgg

SEQ ID NO: 7999 - DNA, 736 bp, Homo sapiens
  misc_feature: GYAE6OF02FVFVJ.37.71.G05.1.454.CMB.1.raw
  modified_base (167)..(167): a, c, t, g, unknown or other
  misc_feature (167)..(167): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttcctgttgcttgttttagaaggngtccactgtgaggtacagctggtaggaatcggtgggggagctttggtacagcgtggtacgggtaccgtccgtaggacgtaccttccgtcgttaggtcgactacgtcgttcgtagttacttccgtaccgttcggtagtttcgttagactggtacggacgttcgggtccggttccccggccggtaccgtacggggtaaggggtacggttacgtgggtacgggtcgtacctcgtactacgacttacgtacgtaacgtacggtagtaaaccaaacgtataacgtacgtacgagttaacgtttaggttacggaagggtaccgccgtttaccgtaccctaagtccgtccgttaacgaacggtaaccaaaccgccgaaacgtaacgaccgttcctacttccgtttacgttacgacgttaacttacggtcgtacgaccgtacgtcgttaggaccggtacgaacccgacgtaccgtaccgtacgtacttacgttacttacggtagtcggaacgtgaacgggtcggttacgggtcggttcgcgggttagggtcccgtacgggtaccggtaccttacccg

SEQ ID NO: 8000 - DNA, 598 bp, Homo sapiens
  misc_feature: GYAE6OF02HC2JE.37.71.G05.1.454.CMB.1.raw
  modified_base (504)..(504): a, c, t, g, unknown or other
  misc_feature (504)..(504): n is a, c, g, or t
  modified_base (520)..(520): a, c, t, g, unknown or other
  misc_feature (520)..(520): n is a, c, g, or t
  modified_base (555)..(555): a, c, t, g, unknown or other
  misc_feature (555)..(555): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagcttctttgtgatcaggactcctcagttcaccttctcacaatgaggctcctgctcagctccgtggggctgctatgctcgtggtctcgtggatgcgtaggtgggattagttgtgatgcactccacgtcccctacttcctcccgtccgtccctccaccccgtggacgccggcccgtcctccactcctcgtcgacgtcgtctagtcacggtcctcctcgtgtactaggtagtaacgtacgaactaacgttaacgttagtaggttacgttagtactcgagtacgaagacgcggaggtctacgtaccacgactaccttcgacgttacttcgttacggttcggtacttacgggcccgggttacccgtccgggtaccctaggtccgtagtcgnggtcgagtagtcgacncgcgactactgttactacacgtacaggtacatcgnacggtgtaggttcggacgtcgaaggtggtacggtttagttagg

SEQ ID NO: 8001 - DNA, 705 bp, Homo sapiens
  misc_feature: GYAE6OF02FGJCL.37.71.G05.1.454.CMB.1.raw
  modified_base (218)..(218): a, c, t, g, unknown or other
  misc_feature (218)..(218): n is a, c, g, or t
tcagtagtgtagatcacgaccggtgctcgatttagtgtcgtcgcaagagagagggggtcaggctggaactgaggagcaggtgggggcacttctcctctaacactctcccctgttgaagctctttgtgatcaggactcctcagttcaccttctcacaatgaggctccctactcagctcctggggctgctaatgctctgggtctctggatgcagtggggnttattggtgatgcatccgacgtcccccacttcctccctcgccccgtcctaccccgtgggaacgtacggccccgggtcccctcctacttcctcccgttaggcctacggttactaggtcaacggtacgtccccttccgtggtaacctaacgttagggtaaaacgtcgggaaccttaaactaaaccttttagttaggtaacgtttacggtacttacccgtagtacgtaaagaaccggaccggaggggacctaacgttcccaacccgtactaactcccgtagtacctttacgttacgtttaccgggttactaaccggtccgggcccgtttaccgggccctagtacggtacggttcgaggtcggataggtgtactacgtacggctaacgattacgttaccgacgtacgtagaacgcgttaacgacggtacgtaggggtcgtaacgggcgggttgtaacggtagggtaggtttacggggtttacggtttaacg

SEQ ID NO: 8002 - DNA, 814 bp, Homo sapiens
  misc_feature: GYAE6OF02HD40I.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggtattttccttgttgcttgttttagaaggtagtccactgtgaggtacagtctggtgaatcgtgggggagcttaggtacagccgtgggacggtccctgagacctctccgtgtcgcatcgtctaggtacttcctacccgttccgagttcttttagaacagttcgacgtcgtacggggtcccgcccggggtctcccggaagggggtaaggttccgtagggaggttcggggtaccttacacgtcccaagttccgtaaagtttaaccgaaaggttcggtaaccaaaaaccctagttaaacttaaccgtaacgtacgttaggttaacgtttttacggacgggaacggggtcccctacgtttaccaaccctaacttcccgtacccaggtaaaccgaacctaaaccgaccgtaaagacgttaccgtacgttaccgtttacgtttacgacgtaccgtaattacggtaagtaacccaggtcccgttaggaacgacccgtaccggaaccggtacggtcccgtacgttaactaaacgtttaacgtttacggtacggtacgtaacggggtaacgttaacgggttacggggtaaccccggggttaggggttacccggaaccgggtttacgggttaacccgggtacccgtttaacccggggggtttacccttaccggtttaaaccccggg

SEQ ID NO: 8003 - DNA, 865 bp, Homo sapiens
  misc_feature: GYAE6OF02H2LDD.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgcttgttttaagaaggagtccactgtgaggtacagctggtaggaatcggtgggggaggtcgttggtacaggccgtgggagggtcccctggacgtacctcctcctggtcgctacgtcgtcgtggtacttccacccgttccgacgttcttttcggaactagtggacggtcgttcggggtccccggcccggggtccgtacccggtaagggggtaaacggggttccgtaggggtacgggttcgggggttctaccgtacgttacccgtaattaccgtaacgtttaaaccgaaggttacgggtaaccctaaaaacccgtaacttaacttaaccgtaacgtacgtaacggttaagttttacggtacgggtaaccgggtcccgttactttacccgaacctaacttccgtaccgaaggtaacgtaaacccgaacccggaaccgaaacggtcgtacccgttacctttccgtttacggttttaccttcggttactaacgttaacggttcgggaacctaccggtaccgttaaggacccggtacggacccggaaccggtaccgggtcccggtaccttacgttaaacgtttaccgttacgttacggggtaacggaccggtaacgggtaacgggtaccgggggtaaccgggttcgggggttacgggtacgggttgggggtaccggtacccgggttttacccgggtaccggttacccgtttaaccccgg

SEQ ID NO: 8004 - DNA, 778 bp, Homo sapiens
  misc_feature: GYAE6OF02HXXUS.37.71.G05.1.454.CMB.1.raw
  modified_base (664)..(664): a, c, t, g, unknown or other
  misc_feature (664)..(664): n is a, c, g, or t
  modified_base (751)..(751): a, c, t, g, unknown or other
  misc_feature (751)..(751): n is a, c, g, or t
tcagtagtgtagatcacgaccggtgctcgatttagtgtcgtcgcaagagagagggggtcaggctggaactgaggagcagggtgggggcacttctccctctaacactcctcccctgttgaagctctttgtgatcaggactcctcagttcaccttctcacaatgaggcctcctgctcagctccgtgggctgactagtcgtctcgtggtctcgtcggatgcgtaggtgggtatagtgtgacgtcgactacgtccgtaccgtacccctaccgttccctcccgtaccgtccccgtaccccgtaccccggtaggacgtaccggcccccgtcctaccgtactcccgttccggtcgaccggtacgggttacctaggttaccaccggtaaccggttccccttcgtcggtaactagggtaacgtaacgaccggtaaccaaactttaacgtttaggtttaggttagttccgtattcgtacgaacggtaagtaacggacccggtaggacccttaccggtaacctcccgtaaaccgtaacccgttcgtaacgttaaccgttcggtttaacggttttacccgggtacggttaccggtcccgggttaccccgggttacccgggttaccacgggttaaccgtacgggtacggtacgttgggaaccgttagggtccgtaanaccggtaaccgccgtaaacgtttaacgttacgttacccacggtacttacggaaggccgttagaacgtacgacggtaggccgagggtntaacggttggttacgtttgggtaacgg

SEQ ID NO: 8005 - DNA, 753 bp, Homo sapiens
  misc_feature: GYAE6OF02IBT3C.37.71.G05.1.454.CMB.1.raw
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (700)..(700): a, c, t, g, unknown or other
  misc_feature (700)..(700): n is a, c, g, or t
tcagtagtgtagatcacgaccggtgctcgatttagtgtcgtcgcaagagagagggggtcaggctggaactgaggagcaggtgggggcacttctccctctaacactcctcccctgttagaagcttctttgtgatcaggactcctctagttcaccttctcacaatgacggcctccctactcagtcctccgtggggctgactaatgctcgtggtctcgnggntgcagggtgggtaattgttggtagagtcgactagtcctaccgtcccctaccttcctccccgttacgccccgtacctacccggtggaacgccggtccccggtccctaccgtacttccgtaccgtcggtaccgttacggttaccgtacgaccgtaacgtccggtcccttaaccgtcggactaaggtaacgggtaactcggaaccttaacgtaactttacggtagtacgttggtactcgtacgacgtagaacgcggtaaggcctacgttccaaccgtactaaccgttcgtagttacgtttacgtttacggttaccgggtttacgaccgggttccccggggtaacccgttcccggggttaacctacgggttacggttaccggtttaggaccggtaacgggttcgtaacgggttcgttacgtaccgggtacgtaccttaacgttacgtacctttaccgaagacgtagaacgtcgaacgttaacggngtaaggtcgggagtagggcttagggtacgttagggttggttttaacggttccg

SEQ ID NO: 8006 - DNA, 650 bp, Homo sapiens
  misc_feature: GYAE6OF02FI9KL.37.71.G05.1.454.CMB.1.raw
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (485)..(485): a, c, t, g, unknown or other
  misc_feature (485)..(485): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgcttgttttagaaggatccactgtgaggtacagctggtaggaatcgtgggggagtcttgggtacagcctgggacgggtccctgacgaccttcctcctgtcgcattccggtctggacttccaaccctttccgagtccttttagactagtgagcttggggtcccggccgggctacccggaggggtaacgggtctgggagtcgggtctcatcccagttccagttaaccatcggtaccaaaactntactaactacgntacgtattttggacgtaagggccctactccaactactcctacagactaacaacgacctaaggctactcttctcgtttccnactatacgtcggaacaccgtacgtggacggaccggtaccgtaccgggacggtccgtaccttacgtaacttacgttacgtagtcggagttaacggacggtccggggtaacggtcgggtcggtacgtacgggtcggtaaccggttccggtaccggtccttaacccgg

SEQ ID NO: 8007 - DNA, 661 bp, Homo sapiens
  misc_feature: GYAE6OF02F2ECS.37.71.G05.1.454.CMB.1.raw
tcagtagtgtagatcacgaccggtgctcgatttagtgtcgtcgcaagagagagggggtcaggctggaactgaggagcaggtggggggcacttctccctctaacacactcccctgttgaagctctttgtgatcaggactcctcagttcaccttctcacaatgaggctccctactcagctcctggggctgctaatgctctgggtctctggatgcagtggggatattgtgatgcatcacgtcccccactcctccctcgccccgtccaccccgtggagacggcccggcctccactcctcctgcaggtctacgtcaagcgcctcctgcagtaggaaatcggacactaacgtttagtgtagttggttatcgtgacgtaagaacgccgagggctaacggtcctaccaacctaacgttccctagtacttcgtttaacggttcgggttaccttaaccgggtccgggtaccccgtttccgggggtcccctagtaccggttagggttcccgaagggttcggacgtagggtacggtacaccggtacggactaaccgtaagttccgtttaccgaaccttaagtacgtaaacggtactacggaaggtcggaaagggtcggtaacgggtaggtaccgggtggtaaggggtattttgggggtttacggttttaacgg

SEQ ID NO: 8008 - DNA, 749 bp, Homo sapiens
  misc_feature: GYAE6OF02HKV1H.37.71.G05.1.454.CMB.1.raw
  modified_base (153)..(153): a, c, t, g, unknown or other
  misc_feature (153)..(153): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttcncacaatgagctcctgctcagctccgtgggcctgctaatgctcgtgggtctcgtgggatgtcgaggtaggggattaagttggtgtaagtgactaagtccgtaaccgtcccctaactccttcccgtcgccccgttaccaaccccgtggaacggacgcccggtccctctactccgtccgtcggccgtaggttctacgtccgagtaccgtccctccgtagctaaagtacggtaaactcggaacctaactaacgttaagttaggtaacttagggtactcgtacgaaccgaagaacgaccggacggacgacttaccctacccgaactaaacgttcccgtaagtacctttacggttaggttacgggttaccaaacgggttcccgggtacccggttccccggggttaccaggtaacccgttagggtttaccaccgggtaggtaccgtaaggttcggactaccggaggtacctaacggttaaacggttctaaccgtaaccgtacgtaaggtaaccgtaacgttacgaacccgggtagtaaccgggtaaggttacccggtaggaccgttaaggggtaacgtttagggtttggggttttaaaccggg

SEQ ID NO: 8009 - DNA, 925 bp, Homo sapiens
  misc_feature: GYAE6OF02G3AC6.37.71.G05.1.454.CMB.1.raw
tcagtagtgtagatcacgaccggtgctcgatttagtgtcgtcgcaagagagagggggtcaggctggaactgaggagcagggtgggggcacttctccctctaacactctcccctgttgaagctctttgtgatcaggactcctcagttcaccttctcacaatgagctccctactcagctccgtgggctgctaagtgtctcgtggtctcgtgatgctaggtaggggtattagttgtagattcgactactcctaccgtacccctaccgtcccttcccgtcccgtcccccgtaccctaccccggttagggacggccggaccccggtccctaccgtaccttcccgttcccgtggaccgttaacggtcgtaacggtccgtaacggtaccgtccccgttccgtacgtacggtacgtaagggtaaacgtcggtaacctaaccgtttaagtttacgggttaagtaggtttcggtaacttacgtcggaaccgtaaggacccggtacgggtacggacgtaacccggttcctaaccctaaacccgttccttaaaaaccgttcgtaaccgttttaccggtttaaccgggttttaccgggtttaaacccggttaaccgggttacccccggggtttaccccgggtttacccccgggggttacccgtttaccgggttaaacccggtttaaccgggttaccggtaaccgggtttacgggtaccggttaacgggtaccgggtacgtaccgggttacggtaaccggttaacgttaaacggtttaccgtttaacccgtaaccgttacgtacgtaaaccggtaacggttaaccgtaacggtaacgggtaagggtaaccggggttacgggtaacggggttacgggttaacgggttaacggggggttttaacgggtttttacgggggttttacgggttttaaaccgggg

SEQ ID NO: 8010 - DNA, 832 bp, Homo sapiens
  misc_feature: GYAE6OF02IN5B1.37.71.G05.1.454.CMB.1.raw
  modified_base (162)..(162): a, c, t, g, unknown or other
  misc_feature (162)..(162): n is a, c, g, or t
  modified_base (707)..(707): a, c, t, g, unknown or other
  misc_feature (707)..(707): n is a, c, g, or t
  modified_base (776)..(776): a, c, t, g, unknown or other
  misc_feature (776)..(776): n is a, c, g, or t
tcagtagtgtagatcacgaccggtgctcgatttagtgtcgtcgcaagagagagggggtcaggctggaactgaggagcaggtgggggcaacttctcccctctaacactcctcccctgttgaagctactttgtgatcaggacctcctcgtagttactaccttcncaactaagtagacggtcctccctgcctacgacgccttccggtcggggtccgtgtaaccttaagtcgtccgttccggtgggtaccttcggttggagtcggacggtagggttagggggtattaaggttcggtagtagttacggaccgtacttaccctaacccgttccccctaccgttcccccttaaccggtccccggtcccccgtaacccccgtaccccggtaggaaccggtaccccggtaccccggtacccctacccggtaacccttcccgttccgtacggtaccgttacggttaccggttaacaccggtaagtccccggtacccttccgtacgacgtaaccggtaaagtaacggtacgaactaaccgttaactttaggtagttaccggtttagtaacgttgaaccggtaagaccggtaaacggaccggacgtaccggttccttaacccggaacctaaaccgttaaacccgtcgtaacgtaaccttacggtttacggttaccggttaacgttaaccgggtcccgggtacccgttcccgggttaacncgggttaacgtcggtagtcgggacgtagtaggtactacgagtacgactagtaacgttctagaccgttanaacgtgactacgcgagtacgtaggtacgcgtacgtacggtagttcgtaggttaacg

SEQ ID NO: 8011 - DNA, 777 bp, Homo sapiens
  misc_feature: GYAE6OF02GUD15.37.71.G05.1.454.CMB.1.raw
tcagtagtgtagatcacgaccggtgctcgatttagtgtcgtcgcaagagagaggggccttagccctggattccaaggcatttccacttggtgatcagcactgaacacaaaggactcaccatggagttggggctgttctggtattttccttgttgcttagttttagaaggagtccactgtgagtacagctggtgaatggtgggggagtcttggaccagtcccgtggggtacggtccctagaacgaccttcctccgtgtacgcgtactcggtacgtggtacttcctacccgttccggtacgttcgttttacggaactagttcggaacgtccgggttacggggtccccggcccggggtaccttacccggggaaggggggtaacgggttcggtagggtacgggttagggttcctaccggtacctcggtaactactaacggtttaacagtaccggtaacctaaacctaagttaacctaaccgtaccgagtaattttacgtttggaacgggtaccggcttacctactacctacctacctaccgaagtaaccgtaaccaaccgtaaccgaacggtacgtaccttccgttcgttacttctacgtactaacgtagtacgtcgtacggtctaacggacgaccggacccggtaaccggtaccggtaccggttaccgttacctttaaacggttaaccttacgttacggtacgtacggtacgaacggtccggggtacggtcggtacggtcgggtaggtccgtacggtccggttacgtaccgtacgttacg

SEQ ID NO: 8012 - DNA, 613 bp, Homo sapiens
  misc_feature: GYAE6OF02FZ534.37.71.G05.1.454.CMB.1.raw
  modified_base (257)..(257): a, c, t, g, unknown or other
  misc_feature (257)..(257): n is a, c, g, or t
  modified_base (400)..(400): a, c, t, g, unknown or other
  misc_feature (400)..(400): n is a, c, g, or t
  modified_base (481)..(481): a, c, t, g, unknown or other
  misc_feature (481)..(481): n is a, c, g, or t
  modified_base (560)..(560): a, c, t, g, unknown or other
  misc_feature (560)..(560): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttcctgttgctgttttagaagagtccactgtgaggtacagctggtggaatcggtgggggagcttggtacagccgtggacgggtccctgacgtactctcctgtgcatcgtctggnttctacctccgtagttcttttagactatggagtcgtcggggtcccggccgggccttaccggaggggtaagggtccgtgggacgttgggtcttcatccattcgacgttaacagtcggacctaaacatactacgtacgctaagtnttttggagtacgggtctccttacgaacctgtctaccgtaagacgtaacaaccggaccaagtacgtcttacgtcttgtttcncgtacttatacgtcgacacggtccgtgaacgggcggaccgaggacccgtcgggtcctacttagttacttacgtgtacgnggtaacgtagtgggaccggtggcggtcgtgtcggtacgtcgtacgtacttacg

SEQ ID NO: 8013 - DNA, 776 bp, Homo sapiens
  misc_feature: GYAE6OF02HJHPY.37.71.G05.1.454.CMB.1.raw
  modified_base (121)..(121): a, c, t, g, unknown or other
  misc_feature (121)..(121): n is a, c, g, or t
  modified_base (199)..(199): a, c, t, g, unknown or other
  misc_feature (199)..(199): n is a, c, g, or t
  modified_base (653)..(653): a, c, t, g, unknown or other
  misc_feature (653)..(653): n is a, c, g, or t
  modified_base (724)..(724): a, c, t, g, unknown or other
  misc_feature (724)..(724): n is a, c, g, or t
tcagtagtgtagatcacgaccggtgctcgatttagtgtcgtcgcaagagagagggggtcaggctggaactgaggagcaggtgggggcacttctcccgtctaacactcctcccctgttgaancttctttgtgatcaggactcctcagttctaccttctacaacaagtgacgcctccctgctcagcctcgtgggctgctangtctcggtcggtctcgtggtatgacgtagggtgggtaatttagttggagtagtcgctacgttaccgtaccggttaccccctacttcccgttcccgtacccgtcccctaccccgaccccgtaggaccggaccgtccccgtacctccctacgtccctaccggtcgtaacggtccggttactaccggtaccacggtcccgttccgtcgtagtaccgtaaggtacgtaacgtaccggtactaaaccgtttacgtttacggttaggtacgtttacgtaacgtccgttagaacccggtaagaccggtccggaaacgtccgtttaacgccctaaccccgtaaacgttcccgttacggttacttaccgtttaacgtttaccgggggtttccgtaaaccggtttacccgggtccccgggtccggttttaacccgggtctacgttacgttcggttctagggtanccgggtttacgggctcggtagaccggtacacggttaactttacgaccgtagaaccggttgaaccttacggngacttaagggacgttgacggtacggcggaagtgggtttgttaccggtttaag

SEQ ID NO: 8014 - DNA, 757 bp, Homo sapiens
  misc_feature: GYAE6OF02GTXFK.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactcctcccctgttgaagctctttgtgatcaggacctcctcagttcaccttctcacaatgagcctccctgctcagctccgtgggctgctatgtctcgttggtctcgtggtatgtacgtagggtagggtattagtttggtagagttgctaatcgtaccgtcccctaccttcccgtcccgtccgtccccgtacctaccccggtaggacgtaccggccccgtccctacccgtacgtttcccgtccgtacgcgtacggttccgttaaccgttccgaaccgaccggttccccttaccacggtacgtaacggtaacggtaaacgttaccgggaacctaaaccgtttaagtttacgggtttgtagttacggttactacgtcgacgtaacggacgtaccggacggtactacgtcctaccaacgttaccgtctacgttaacgttaccttacgggttcggttaaccgtaccgggttccccggggtcccggttccccggtacgtacgtaacgttacgggttaccgtcgggtcgcggttacgggaccgtacgtaacgaccgggactaccgtagtttccgacctaccgttagaccgtaagaccttaggccgaaggtacggtaggtccgggtacgtcggtaaggttcggttagggtttacggttaccgg

SEQ ID NO: 8015 - DNA, 840 bp, Homo sapiens
  misc_feature: GYAE6OF02F8BG5.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctacagttctaccttctcacaatgaggcctccctgctcagctccgtggggctgctaatgctcgtgggtctcgtggagtgactagggtaggggtattacgttggtgagtagctaatccgaccgtaccccttacctcccgtccccgttcgtccccggtccaacccggttaggacggaccggtcccggaccccttcccgtactccgttacgcggtacgtacggttacttacggtaacgacggtccgtaccttaccgtacgaacgtaaggttaagggaaacggtaagaaacgtaactaaacgtttttaggtaacgggtagttttaacggtacgttacgtacgaacgggaaacggtaaccggaaccgggaggtaaccgtaccgttacccgtaccaaaccgtacccgtttaccgtaggtttacttacggttaacgggttttccgggttaagtaacccgggttccgggtccccggttacccggggtaccgttacggtaacggtcgggtttaacgtcggttacggtaggacggtttagaccggtacgaagggtacctaaccggttagttaccgttaaccgtaccgtaaacggtttacgaaaacgttcggttaaaccgacgggttaccggaacgggttaacgggtaacgggtaccggggtaacgtttaaggggtaaacgggtttgggttttaagggggtttttaacccggg

SEQ ID NO: 8016 - DNA, 773 bp, Homo sapiens
  misc_feature: GYAE6OF02IW45T.37.71.G05.1.454.CMB.1.raw
  modified_base (716)..(716): a, c, t, g, unknown or other
  misc_feature (716)..(716): n is a, c, g, or t
tcagtagtgtagatcacgaccggtgctcgatttagtgtcgtcgcaagagagagggggtcaggctggaactgaggagcaggtgggggcacttctccctctaacactcctcccctgttgaagctctttgtgatcaggacctcctcagttccaccttctcacaatgaggctccctgctcagctccgtgggctgactatgctcgtggtctcgtggatcgcaggtgggtaacttagtttgtagagtcgcctacgtccaaccgttccccctaccttcctacccgtcgcccccgtacctacccccggtaggaccggacccggtccccggtacccttaccctacgttccccgtcccgttacggaccgttaacggggtttaccttaacggaccgtaaccggtacccgtcccccgttccgttacggaaccgttaacgggtaacgggtaaaacgttacgggtaaacccttaaacgtttaaacgtttacggttttaaacgggttaagtttaccgggtaacttccgtacggaaccgtaacgaacgggcccggaaaggtaccgtacgttaccctaccgaaccgttaccgtccgtatacgttcgttacggtttcggtaccgttaccggtccgggtccgttccggtccctagggtaccgtagttcgagtcggtagtacgcggtacgacgacgacgtaactacggttacctacgtaccgtagcggtaaccgtntaccggtacaagttacggaggtacggtaggtcgtagggtagttggttaggtttaacg

SEQ ID NO: 8017 - DNA, 876 bp, Homo sapiens
  misc_feature: GYAE6OF02FQQJK.37.71.G05.1.454.CMB.1.raw
  modified_base (379)..(379): a, c, t, g, unknown or other
  misc_feature (379)..(379): n is a, c, g, or t
  modified_base (458)..(458): a, c, t, g, unknown or other
  misc_feature (458)..(458): n is a, c, g, or t
tcagtagtgtagatcacgaccggtgctcgatttagtgtcgtcgcaagagagagggggtcaggctggaactgaggagcaggtgggggcacttctcctctaacactctcccctgttgaagcttctttgtgatcaggactcctcagttcaccttctacacaatgaggctccctactcagctccgtggggctgactatgctcgtgggtctgtggatgcgtaggtggggtattagttggagtatcgactacgtacctaccgtccccgaccttcctccccgtccgtccccgtccctaccccggtaggacgaccggccccggtcctacctacgttccctcgtcgtacgtaggtaccgttacgtaccgaacgccgtcccttaccggngtaaccgttaagacgggtaaaactaccggaacctaaacgtttaacgtttagttacgggtaagtttacggtactttacgnggaaccgaacgggtaaccggtacccggtaacgggggtaccctttaacccggttccgtaaaccccctaaacgttttaacccccgcgggtttaatttaaccgttttcgggtttttaaaccgggtttaccccggggtttaacgtttaacccggggtcccccggggttaaccccgggtttccccggggttaaacctacgggggtttaaaccggtttcccgggttaggggttacccgggtaggtaacccgttaggggtaccggttaccggttaaccaacgggtaacgttaaaccgtttaacgtaccttaccgttaaacacgggttaagtaaggaccttcggaaacggttccgaagggtaggtacgggcggtaacggtttcgggtaagggtttttaacgggttccggggttttaaggttaaccg

SEQ ID NO: 8018 - DNA, 868 bp, Homo sapiens
  misc_feature: GYAE6OF02GNNHZ.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactcctcccctgttgaagctctttgtgatcaggtacctcctcagttcaccttctcacaatgagcctcctgctcagctccgtgggctgactatgtctcggtcggtctcgtggatgcgtaggtgggtattagttgtacgatcgactacgtccgacccgttacccctacttccccgtacccctaccggtccccccgtacccgtacccccggtggaaccggccccggtccccggtaccctcccttaaccgttccccgtacccgtggtaccggttaccgttaccgtaacggtaccgacgggtaacccttccccgttacgtacgtaaccgtaagggtttaacgggtaaaacgttaccgaaaaccgttaaaccgtttaaacggttttacggtttaagggtttaacgttaacgggttaccttcgggtaacgaccgggaaacggttaaccggacccgggtacgggtaacttacccgtacctaacccgttaaaccgtaccttaaccggttaacgttaaccgtttccggtttaaacgggtttcccgggttaaaccgttaccccgggggttccccgggttcccccgggttaccgggtaccttacgggtacccggttaggttccggagggttacgtacggtaggttaccgtacgtacggagtacttaacggtacgttactaaccctgtaacggtgaaaccgttcacgtaccgggaagttaacgggcggttaacggtacggtaaggttacggacgggtttttacgggttgttttaacggg

SEQ ID NO: 8019 - DNA, 571 bp, Homo sapiens
  misc_feature: GYAE6OF02F4E7U.37.71.G05.1.454.CMB.1.raw
  modified_base (317)..(318): a, c, t, g, unknown or other
  misc_feature (317)..(318): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgactaatgctctgggtctcgtggatgcaggtggggtatagttgtgatgctatactacgtcccctactcctccctacgccccgtccacccgtggagcgcccgctccatctctgcagtctagcagctcctcnncgagtagaatggaactactaattagtgtatgtactntagacagacgcgagggncgtacaccacactctagtacttacgttacgttcggtactaccggtccggtacccgttcccgggtactcgacgtacggtcaggtcgtagaggttacggacttcggagtacaagtacgtactacgtacgacgtagaacgtcgtactaggacgtacggaggtggacggttaccgtagggtacggtggtttacggtttaacggg

SEQ ID NO: 8020 - DNA, 901 bp, Homo sapiens
  misc_feature: GYAE6OF02I9CDH.37.71.G05.1.454.CMB.1.raw
  modified_base (526)..(526): a, c, t, g, unknown or other
  misc_feature (526)..(526): n is a, c, g, or t
  modified_base (826)..(826): a, c, t, g, unknown or other
  misc_feature (826)..(826): n is a, c, g, or t
tcagtagtgtagatcacgaccggtgctcgatttagtgtcgtcgcaagagagagggggtcaggctggaactgagagcaggtgggggcacttctccctctaacactctccccctgttgaacgcttcgtttgtcgactcacggtctccctccagttccacctttcctccaactaagtgaacggtccttacccctacctcgcgtctccgtggggtcctagcttaacttcgtccttcggtagggttcctggtacggtagtcggaccggtagggtagggtaactttagttcgaggtacgtcggactacgttaccgacccgtccccgtaaccttcccttaccccgttccggaccccgggttaccccttaccccggttacggaaccggtccggccccccggtacttaccacccgttctcccggttacgacgttcggtcccttaagcgaaccggtctcccgtcttcgacttaggaacgttaggaccgtaaccaaccgttagttttaagtcggttaacgtttaggtcctttaacgnggtaccgaaacggtaccgccggttacggacctaacggtttccgaaccctttaaacggtccttacgtacgtttaaaccggggttcttttaaccgggtttaccgggttaaacccggttccgggttaaccccgggttaccccgggttccccgggggttaccttaaaggttaccccggtagggtttaacccggtcgggtttacgacggttaccggggttaccgtaacgtaacggtcggttaaactccggttaaacttaacggttcgacttaccgggtaatacccggttacgacggtaaacccgnggttaaacggggccggttaaggttaccggacggtttaagggtcgggtttaaccggttggggttttaggtttaacc

SEQ ID NO: 8021 - DNA, 716 bp, Homo sapiens
  misc_feature: GYAE6OF02H5Y0F.37.71.G05.1.454.CMB.1.raw
tcagtagtgtagatcacgaccggtgctcgatttagtgtcgtcgcaagagagagggggtcaggctggaactgaggagcaggtgggggcacttctccctctaacactctcccctgttgaagctctttgtgatcaggactcctcagttcaccttctcacaatgaggctccctgctcagctccgtggggctgactaatgcttcgtgggtctcgtggatggctagggtgggtattagttggtagagtgctatccaccgtacccctacttccctcccgtccgccccgtacccgccccgtaggacgaccggccccggtccctccgacttccgtcccgtgccgtacggttcctaggtaccacggtccgtcccctcgttcgactaggtaacggaacgtacggaacctaacgttaactttagttagggtaacgtttaggtacttcgagtaccgaaagtaacggccggtaggcctaacggttcccacctaactaaccctcgttagtacgttctttacggtttcgggttacttacgggtccgggtcccgttcccgggtacctggtacgttcggtacgcgggttacgcgagggttcgacgtcgaacggctaaccggtacttaacgtttccgaactacggtaccggtaataccggttacgacgggtaacgtaagggtccgggtaagggttcgagggttacgggtaggttacgggttttagggttttacgg

SEQ ID NO: 8022 - DNA, 816 bp, Homo sapiens
  misc_feature: GYAE6OF02HRIQK.37.71.G05.1.454.CMB.1.raw
tcagtagtgtagatcacgaccggtgctcgatttagtgtcgtcgcaagagagaggggccttagccctggattccaaggcatttccacttggtgatcagcactgaacacaaaggactcaccatggagttggggctgttctggtattttccttgttgcttgttttagaaggagtccactgtgaggtacagcgtggtaggaatcggtgggggagtcgttgggtacacgccgtgggtacgggtccctggacgactctcctgtcgctagtcgtcgtaggtacttcacccttccgagttcttttgactgtgagtctcggggtcccgtccgggacctaccggagggtaacgggtcgtggggtacggtcgggttctaccgtactccctaagtccgtaacgttaactaacgttacggtaaccaaaacccgtattaacgtaaccgttaaccgactaacggttttaagttttacgggtaacgggaacggggtccccgtttacccttaccgtaacccgttacgttacccgttacccgaaggtaaaacccgtacccgaaaacccggtaccccgaaaaggtaccgtaccctttacccgtttacttttaaccggttttcgtaccgtaccttaaggttaaccggttaccgggaaccgtacggtcccgttaaggacggtaaccgggacccggtaacgggacccgggtccgttacttaaccgttaataaccgtttacgtggtacgaggtacggtacggttcggggacgggtcgggttacggcgggttacggtacggtacccggttccgggttacgtacccggttacctaacccgg

SEQ ID NO: 8023 - DNA, 776 bp, Homo sapiens
  misc_feature: GYAE6OF02JOQU0.37.71.G05.1.454.CMB.1.raw
  modified_base (125)..(125): a, c, t, g, unknown or other
  misc_feature (125)..(125): n is a, c, g, or t
tcagtagtgtagatcacgaccggtgctcgatttagtgtcgtcgcaagagagaggggtcaggctggactgaggagcaggtgggggcacttctccctctaacactctcccctgttgaagctctttgngatcagactcctctagttcaccttctcaacaatggtacggtcctccctgcctacgacgtctccggtggggtactgtctaaagttcgtcttcgttgggttctgtcgggactggacgtaggtagggtattagttggtagtagtcacttagacctacccttccctaaccgttccttcccgtacgtcccccgtaccgtaccccgtagggacgttaccggccccgtccttaccgtcgttcctcccggcgtccgtacgttactaggtaccgagtccgtccgttacgcgacgtacgtaaggtaacgtctaacgtaattacgtaggttttacgaagtttacggtacttggtacgaacgtaaagtaccggtaccggtaagtaccgtacgtacccgtacctaacttacccgttgtaccgtaactttacgttaaccggttcttaaccgggttaaccggtccccgggtaacggttacccggttaaccggtaccgtacggttacgtaacggtgggttacctcgggttacgtacggttaacgacgtaccggtacgttaacgtacgtttaaccgttacgtacttaccggagttaacccggataaccgtacggtgttaacggaagttccggtaggttcgtaaggtttcgtaaggttacgggtttacg

SEQ ID NO: 8024 - DNA, 820 bp, Homo sapiens
  misc_feature: GYAE6OF02IVBHC.37.71.G05.1.454.CMB.1.raw
  modified_base (136)..(136): a, c, t, g, unknown or other
  misc_feature (136)..(136): n is a, c, g, or t
  modified_base (264)..(264): a, c, t, g, unknown or other
  misc_feature (264)..(264): n is a, c, g, or t
tcagtagtgtagatcacgaccggtgctcgatttagtgtcgtcgcaagagagagggccttagccctggattccaaggcatttccacttggtgatcagcactgaacacgaaagactcaccatggagttgggctgttcnggtattttcctgttagcttagtttagaggagtccatgtgagtcagtcgtggtagaatcggtggggacgtacgtttggaccacggtccgtgggtacggtcccgtaggacgtacctccgttccgtaggtnaccgtcgtcggttcgtaggtacttaccgtacccgttacgacgtttaccgttttcgaactcggtactcgggtttaccggtaccggggttccccggccgggttacccgtacccgggtaagggggttaaccggttacgttcggggtaacggtttcgggtactaccgttaccgtaccgttaagtcgttaaacgttacggtaactaccggtaaaccgtaaaactcgttaactaacggacccgtagtaacgtttttaggtacggttaaacggaccgggttccaacccgtttaacgactaaccgtaccgtaaccgaacggttaacgaaacccgaacgtaccgtaacggtccttaccgtacgtttcttaacgttccgtagtaaccgtgtttaacgaccggtactccggaacgtagaacccggtggacccgtacgaccggggtcctaccttacgttaaagttcgttaccgtggtaaccgtaggtacggtacggtccgggtaaggttcgtaacggtgtaccggtttcgaaccggttacgggtaaccctttccgaaggtttaccccg

SEQ ID NO: 8025 - DNA, 647 bp, Homo sapiens
  misc_feature: GYAE6OF02HNK7R.37.71.G05.1.454.CMB.1.raw
  modified_base (180)..(180): a, c, t, g, unknown or other
  misc_feature (180)..(180): n is a, c, g, or t
  modified_base (323)..(323): a, c, t, g, unknown or other
  misc_feature (323)..(323): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttccttgttgctgtttagaggatccatgtgaggtacngctggtggaatcgtgggggagcttggtacagcctgggaggtccctgagctctccttgtcgcatcgtctggtattcaccgttcgagtccttttgacatgagctgggtccgccggctccgaggggaaggtctgggagtgggttcnctagtccgatcaagttacaatggtaccaaactagtaactaacacgtacagtattttggacgtaacggcctctaccactactctaccgagtacgaaccaacgacctaaaggactacttcctacgttacgtttcgtacgtactaacgttacgtacgggtaaccaacggtcctttaggaacggtacggaacccgtaaccggacggtaccggtacttacggtaactttattaccggtagttggaccggtaaggtacggtacggggaaccggtcgggttacgggcttacggggtgtaacccggtttcgggtacccgtactttaacccgg

SEQ ID NO: 8026 - DNA, 830 bp, Homo sapiens
  misc_feature: GYAE6OF02IYWXC.37.71.G05.1.454.CMB.1.raw
  modified_base (188)..(188): a, c, t, g, unknown or other
  misc_feature (188)..(188): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (508)..(508): a, c, t, g, unknown or other
  misc_feature (508)..(508): n is a, c, g, or t
tcagtagtgtagatcacgaccggtgctcgatttagtgtcgtcgcaagagagagggggtcaggctggaactgaggagcagggtgggggcacttctccctctaacactcctcccctgttgaagcttctttgtgatcgaggtctcctctagttcctaccttctacaacaatcgacggtcctccctgctacngtcctccggtgggctgacttagtcgtcgttcgtggtctcgtgatgacgtagggtgggtattagttgtacgtancgtntacgtccgtacctccccttactcccgttcccaccggtcccggtacccaccccggtaggaccggtcccggtccccgtaccttccgtccttccgtccgaaggtcggttaccggttactaccgtcgaacgcccgtccttaccgcgtacggtaacggacggttaaaccgtacggaacttaaccggttaaactttgggttaacggttagttacgtacgttacgacggacttaaaagggccgaaccggngtactaaccgtcctaaccgactactacgtgtacgttacgttaggtacgttccgtaacggtccggttaccggtcccgggtactacggtacgttacggttacgaacgggttcgtacggttagggtacctacgaaccggtacggttaaccgtcggttaacgtttaaccgtacgtttaaacccggtacgtttaaaacccggttaggtaaccccggttaaggggacccggtaacgggtaacccgggtttaagggggaacccgtttaaggggttacccggtaacgggggtttaaggttttacccgggggtttaggtttttaaccgggg

SEQ ID NO: 8027 - DNA, 622 bp, Homo sapiens
  misc_feature: GYAE6OF02JE73C.37.71.G05.1.454.CMB.1.raw
  modified_base (172)..(172): a, c, t, g, unknown or other
  misc_feature (172)..(172): n is a, c, g, or t
  modified_base (359)..(359): a, c, t, g, unknown or other
  misc_feature (359)..(359): n is a, c, g, or t
  modified_base (411)..(411): a, c, t, g, unknown or other
  misc_feature (411)..(411): n is a, c, g, or t
  modified_base (453)..(453): a, c, t, g, unknown or other
  misc_feature (453)..(453): n is a, c, g, or t
  modified_base (572)..(572): a, c, t, g, unknown or other
  misc_feature (572)..(572): n is a, c, g, or t
  modified_base (586)..(586): a, c, t, g, unknown or other
  misc_feature (586)..(586): n is a, c, g, or t
  modified_base (605)..(605): a, c, t, g, unknown or other
  misc_feature (605)..(605): n is a, c, g, or t
tcagtagtgtagatcacgaccggtgctcgatttagtgtcgtcgcaagagagaggggtcaggctggaactgagagcaggtgggggcacttctccctctaacactctccctgttgaagctctttgtgattcaggactctcagttcaccttctcacaagtgaggctcctgctcancctcgtggggtctgctaatgtctcgttacgggtctacgtggactcggacgtagggtgggtacttagttgtgatcgctacgtcaccgtacccctacttccgtacctcgacccctcgtccccgtaggacggcgccgtcctaccgtactcttaccgagtacgtacgttacgacgtcgctaccgtccctcngtacagtaggaatacgaacgtacttacttagttacggagttacgtacgtacngtacgaaccgaaggccgtaggctagtcctaccgacttaaccnttcgtacttcgttacggttcgtacgtacgcggtccgttaccgttcgtcgtacggtatcggtactaggtcggtacgtagttaggccgtacggctaccgaaggttactagtaactcgtaancggtaatcgtaacngaacgagtcggagtaccgngaggtacgttggttcgg

SEQ ID NO: 8028 - DNA, 918 bp, Homo sapiens
  misc_feature: GYAE6OF02GVP5W.37.71.G05.1.454.CMB.1.raw
  modified_base (213)..(213): a, c, t, g, unknown or other
  misc_feature (213)..(213): n is a, c, g, or t
tcagtagtgtagatcacgaccggtgctcgatttagtgtcgtcgcaagagagagggccttagccctggattccaaggcatttccacttggtgatcagcactgaacacaaaggactcaccatggagttggggctgttctggattttccttgttgcttgttttagaaggagtccactgtgagtacagcgtggtgaatcgtggggagtcttggtacngccgtaggacggtcctgagtacctcgtccgtgtcgactagttcgttcgtaggtacttaccgaccctttaccgaacggttctttttacgaaccgtatggacgtccggttcggggtcccggtcccggggtccttacccggaaggggggtaacggggttccgttaagggggtccgggttacggggttccgttaccgacgttacccgtaacgttaccgtaacggtttaaccgttaaaggttaccgggtaaacccaaaaccgttaatttaaccgtaaaccgttaaccgacgttaagttttacgttttacggtaagggtaaaccggggtcccctttacttacccgtaccccgttaacttacccgttaacccgaacggtaaaccgtaaacccgaaaccccgggtaaacccgaaaaggtacccgttacctttaccgtttaccggtttttaccgtttttaccggcgtttaaccgtaacgtttaaggttaaccgggacctaacgttacccggtcggtaaaccgggaccgttaccccgggaccggaaccggttccggtaacccttaacgtttaaacgttaacgttacgttagggtaccgtacgggtaacggttcggtaacggggtaccgggtacggggtaccggttacgggttacgggttacggtaccccggtttaccgggtaccgtttaacccggtttaccgtttaaaaccccgg

SEQ ID NO: 8029 - DNA, 844 bp, Homo sapiens
  misc_feature: GYAE6OF02G32O9.37.71.G05.1.454.CMB.1.raw
tcagtagtgtagatcacgaccggtgctcgatttagtgtcgtcgcaagagagaggtgccttagccctggattccaaggcatttccacttggtgatcagcactgaacacaaaggactcaccatggagttggggctgttctggattttcctgttgctgtttagaaggagtccatgtgaggtacagctggtgaatcgtggggagcttggtacagcctggaggtccctgagacctcgtacctgtcgcatccgtctaggtacttccgtaccgttaccggagttcctttttggaacctagtcggagtcggttacggggtccccgcccggggtacctcccggaaggggtaacgggttccgtaggggtaagggttccggggtaccttcgaacgttcccaagttacgtaacggtttaaccgaaacgttcggtaaccaaaaacccgtagttaaacgttaaccctaaccggacctaaaggtttacgtttttaggtacgggaacggtaccccgtcctttaaccgaacccgtacgttacccgtaaccgaacggaaccgtaaaccgaaccggtaacccgtaaacgggtacctccgttaccgttaccgttacgtttacctaacggtacttaaacccgttaggtaaccggtaccgaaccggttccgtaacggtaacgaccggtacccggtaaccggccgttacccgggtacctttaaccgttaaacgtttaccgttaacgttcgggtaccgacgggtaacggtaacgggttaccgggggtaacccgggcggggttaacggtccggttacgggggttaccgtaacccggggtttaccggttacccggttaccttaacccggg

SEQ ID NO: 8030 - DNA, 987 bp, Homo sapiens
  misc_feature: GYAE6OF02GYTFN.37.71.G05.1.454.CMB.1.raw
  modified_base (174)..(174): a, c, t, g, unknown or other
  misc_feature (174)..(174): n is a, c, g, or t
tcagtagtgtagatcacgaccggtgctcgatttagtgtcgtcgcaagagagaggtgccttagccctggattccaaggcatttccacttggtgatcagcactgaacacaaaggactcaccatggaggttgggctgttctaggtatttttcctgttgcttagttttaagaacggtntaccatggtacgacggtacacgtcgtaggtacggaagttcggtaggggggtacgtcgtttaggtaacgacggtcccgtgggtaccgggttcccctaggtacggtaccttccgttccgttaaggtcgtacgtacgttaccggtgttacgggtacttacccgtaaccggttccgtagtttaccgtttacgacgtacggtagtacgggtacggttccggggtacccggccgggttaccgtacccgggaagggggttacggggtccggttacggggtacgggttcgggttacctacgtaccgttaccgtaacgttaccgttaacggtttaacgtaaccggttacggtaaaccctaaaacgttaacgttaaaccttaaccggtaaccgttacgtttaaggtttacgttttaacgggtaaccgggtaacggggtcccttaaccttaacccgtacgttaaccgtaccgtaacccgtaggaaccgtaaaccgaaaccggtaaccgaaacggtaccgtacgttaccgtttacggttccttttcggtaaccgtaccgttaacgtacggtaccgtaaccggtacgttacccggtaggaaccggtacccggtacccggtaaacccggtccggttacccgggtaaccgtttaacgttaaacgttttaccgttaaccggggttacgttaccgggtaaaccgggtaaccgggttaccggggtaaacggggttacccgggggtacgggtttacggggtaccggtttaccgggggttacgggttaccccgggttaccgggtttaccgggtttacccctttaaacccgggg

SEQ ID NO: 8031 - DNA, 512 bp, Homo sapiens
  misc_feature: GYAE6OF01BQKGY.9.71.G05.1.454.CMB.1.raw
  modified_base (451)..(451): a, c, t, g, unknown or other
  misc_feature (451)..(451): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctcaagtctggcaacacgcctccctgacaatctctgggctccagtctgacgacgaggctgattattactgcagctcatatgcagttggttccttctttcaagtntagttcggcggagggccaggtctggccgtctgacgtcacgacccaaggcctcggtcccccg

SEQ ID NO: 8032 - DNA, 562 bp, Homo sapiens
  misc_feature: GYAE6OF01C177H.9.71.G05.1.454.CMB.1.raw
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaaagcccccacactcttaatttatgaggtcactaagcggccctcaggggttctggtcgcttctctgcctccaagtctggcaacgacgcctccctgacatctcgtggctccagtcngacgacgagctgattatacngcagctnatatgctagtttcggtccttctttacaagtattacgttccgggacggtaagggaccctaagggccttacggaaccccggttccttaggacgttaccgtaaccggccccgaaaacgggtcccgttccggtacccccccccgg

SEQ ID NO: 8033 - DNA, 547 bp, Homo sapiens
  misc_feature: GYAE6OF01CP8SH.9.71.G05.1.454.CMB.1.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacaggtcctgggccctgtctgccctgactcagcctgcctccgtgtctgggtctcctggacagtcgatcaccatctcctgcactggacccaccactgatattggcattataaccttgtctcctggtatcaacaacgccagacaaagccccacactcttaatttatgaggtcactaagcgccctcagggttctggtcgcttctctgcctccaagtctcggcaacacggcctccctgacaatctctgggctccagtctgacgacgagctgattatactgcagctcatatgctagtttcggttcctctttacaagtattaggttccggcgggacgggacctagggccttacgggtacccgttccgtagtacgttaccgaacgaccccgaaacggccgttcccggtacccccccgg

SEQ ID NO: 8034 - DNA, 550 bp, Homo sapiens
  misc_feature: GYAE6OF01BH4PW.9.71.G05.1.454.CMB.1.raw
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcagggtttctggtcgcttctctgcctcaagtctggcaacgacggcctcctgacaatctctgggctccagtctgacgacgaggctgtattatactgcagctcatatgctagtttcggttccttcgtttacaagtattacgttcgggacggtacgggacccgagggtcctacggacccgttctaggtaacgtccacggaccccgtaaaggcccgtccggtacccccccgg

SEQ ID NO: 8035 - DNA, 530 bp, Homo sapiens
  misc_feature: GYAE6OF01D36V7.9.71.G05.1.454.CMB.1.raw
  modified_base (361)..(361): a, c, t, g, unknown or other
  misc_feature (361)..(361): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctgtatcaacaacgccagacaaacgcccccacactcttaattatgagtcactaagcgccctcgtagggtttctggtcgcttctctgcctcaagtctggcaacncgcctcctgacaatctctggcctccagtctgacgacgaggctgtattattactgcagctcatatgctaggtttcgttccttctttacaagtattagttcgggcggtagggacccgtaggctcggtacccgtcgtgacgtcaacgtcccgaaggtccgtccgtccccccg

SEQ ID NO: 8036 - DNA, 543 bp, Homo sapiens
  misc_feature: GYAE6OF01A921N.9.71.G05.1.454.CMB.1.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattatgaggtcactaagcggccctcagggtttctggtcgcttctctgcctcaagtctggcaacacggcctcctgacaatctctggctccagtctgacgacgaggctgattattactgcagctcatatgctagttcggttccttctttacaagtattagttccgggacggtacgggacccgaggtcgtcgacccggttccgtggtacgtccacggtaccccaaacgggccttccggtcccccccgg

SEQ ID NO: 8037 - DNA, 559 bp, Homo sapiens
  misc_feature: GYAE6OF01C7XNF.9.71.G05.1.454.CMB.1.raw
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgatcaccatctcctgcactggaccccacactgatattggcattataaccttgtctctgtatcaacacgccagacaaacgccccacactacttaattatgagtcactaagcgcctcaggggttctggtcgtcttctctgcctcaagtctcggcaacgacgccctcctagacatctcgtggctcagtctgacgagaggntgtaattattacngcagtctcgatatgactagtttcggtccctttctttacgaagtagttaacggttccgggacgggtacgggtaacccgagggtccttacgggacccgttacgtcggacgttaccgacgaccccgtaagggtcccgtcccggtaccccccgg

SEQ ID NO: 8038 - DNA, 596 bp, Homo sapiens
  misc_feature: GYAE6OF01EJZOJ.9.71.G05.1.454.CMB.1.raw
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattgggcattataaccttgtctcctggtatcaacaacgccagacaaacgccccacactacttaatttatgagtcactaagcgccctgagggtttctggtcgtcttctctcgctccaagtctcgcaacacggcctcctgacaatctcgtcgggcctccgagtctgacgacgaggcctagtacttattactgtccagtctacgattagtgtactaggttttccgttccctttacttttacgaaacgttattaccggttacgggtccggggaaacgggtaccgtaacgggtccttaccgggtcccgttacccgtggtaacggtccgaacggaccccgaagggtcccttccccgggtacccccccg

SEQ ID NO: 8039 - DNA, 508 bp, Homo sapiens
  misc_feature: GYAE6OF01C0KVB.9.71.G05.1.454.CMB.1.raw
  modified_base (411)..(411): a, c, t, g, unknown or other
  misc_feature (411)..(411): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaacgccccacactcttaatttatgaggtcactaagcggccctcagggtttctggtcgcttctctgcctcaagtctggcaacacgctcctgacatctctgggctccagtctgacgacgagctgattattacngcagctcatatgctagttggttcctctttcagtatagttcggcggagggccaggtctcgtaccgtcctgacgtccagcccaaggcctcggtcccccg

SEQ ID NO: 8040 - DNA, 554 bp, Homo sapiens
  misc_feature: GYAE6OF01DWJHZ.9.71.G05.1.454.CMB.1.raw
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaagccccacactcttaatttatgaggtcactaagcgccctgagggtttctggtcgcttctctgcctcaagtctggcaacacggcctccctgacaatctctgggctccagtctgacgacgaggctgatttattactgcagctctatatgactagtttcgttccttctttacaagtacttagtttcgggacgggtagggtaccgacgggtactcggtacccggttccttaggaacgttcaacggtccccgaaaggtcccgttccggtcccccccgg

SEQ ID NO: 8041 - DNA, 607 bp, Homo sapiens
  misc_feature: GYAE6OF01DOL1B.9.71.G05.1.454.CMB.1.raw
  modified_base (274)..(274): a, c, t, g, unknown or other
  misc_feature (274)..(274): n is a, c, g, or t
  modified_base (323)..(323): a, c, t, g, unknown or other
  misc_feature (323)..(323): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatagtggactattagtaaccttgtctctgtatcaacacnccagacaacgccccacactacttatttatgagtacactaacgccgtccngtacggttcgtcgtcgtcgttctctcgtcctacctacgtacgtcgtacgaacaccgtccgtaccctacgtacctactacctccgtacgtccgtacctacgtcgttacgacgacggacgtcgtagtacgttacttacgtacgtcactcgtacctatactagtcgtaggtttaccgttcttacttactagtacgttacgttagggtaccgggtaggacccggacgtcggtaccgtccgtccgtacggtacgtacgaccgtaccgaccggtcgtcccgtacccccgg

SEQ ID NO: 8042 - DNA, 542 bp, Homo sapiens
  misc_feature: GYAE6OF01EUU7B.9.71.G05.1.454.CMB.1.raw
  modified_base (227)..(227): a, c, t, g, unknown or other
  misc_feature (227)..(227): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (432)..(432): a, c, t, g, unknown or other
  misc_feature (432)..(432): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttggagttatgacttgtctcctggtaccaacagcacccaggcaaacgcccccaaactcatcatttangaggtcactaagcgccctcagggtttctattcgcttctctggctcaagtctgacacncgctccngacatctctggctcagctgagacgaggctgtattattactgtctgctcatatgctagatggtanacctcgttcccggttggttacgttccgggacgggtagggaacccgtaagggtccgtaacccggtaccgttaacggttccaaggacccccgtaagggcccttacccccggg

SEQ ID NO: 8043 - DNA, 837 bp, Homo sapiens
  misc_feature: GYAE6OF01EHOSV.9.71.G05.1.454.CMB.1.raw
  modified_base (409)..(409): a, c, t, g, unknown or other
  misc_feature (409)..(409): n is a, c, g, or t
tcagtgatacgtctcacgaccggtgctcgatttagtgtcgtcgcaagagagaggggggtcaccaagacggcgagtccgacgtctcgggtaccgtcttccgaccatggcctgggctctagctagctcctcaccctctcgacgttcgagtacacagggttccgttcgggtcccttgtctcgccgtaggactccagtcctgtccttccgtgtcgtgggtcgtccgtgggaccggaggtccgtagtccgaccgggtacttccttacctcgtcctaccgttgggaccccaccacgtcgacgttaattcgggacctatttaactaaccttgttcctttccgtcggttactacctaaccgtaaccgcccaaggacctaaaccggcccccgaacgtaccgttacgttaagttttagngtacggtacactaagtccggtcccttcgtaggggtttctgggttcgtcgtttccgtcgttcgtccctacccgtaacggtccgttacgggaccgtaaacggtacccgggcccttaccccgttggaaacctacgttacccgttccggacggggttaccctaaccgtaaccggttaccgttaacgaaacccgtaccggtagggtaccttaggttaacctttaccgtaacgttcggaccgtaacgtaccgttacgtaacgtaagtccggttacggtacggttttccggttaccctttacgttttaacgtaagttaacgtttacggttaccgggcgggttaaaccggtaccggtacggtaccgttacggaacccgttcgtacggtacggttccggaccggtaccgtaacgggtcccgtcccggtaccccccgg

SEQ ID NO: 8044 - DNA, 529 bp, Homo sapiens
  misc_feature: GYAE6OF01BWT6F.9.71.G05.1.454.CMB.1.raw
  modified_base (418)..(418): a, c, t, g, unknown or other
  misc_feature (418)..(418): n is a, c, g, or t
  modified_base (477)..(477): a, c, t, g, unknown or other
  misc_feature (477)..(477): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggcattataaccttgtctcctggtatcaacacgccagacaaacgccccacactcttaatttatgagtcactaacgcggccctcgtagggtttctggtcgcttctctgcctcaagtctggcaacacggcctcctgacaactctctcggctccgagtctgacgacgagctgacttatacngcagctcatatgctagtttcggttccttcgtttcaagtactagttcggcggagggaccnggtctacggcctccgtgacgtccgacgaccccaggtcccgtcggtacccccg

SEQ ID NO: 8045 - DNA, 526 bp, Homo sapiens
  misc_feature: GYAE6OF01A6O8X.9.71.G05.1.454.CMB.1.raw
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (420)..(420): a, c, t, g, unknown or other
  misc_feature (420)..(420): n is a, c, g, or t
  modified_base (445)..(445): a, c, t, g, unknown or other
  misc_feature (445)..(445): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgccagacaaagcccccanactcttaattatgaggtcactaagcgccctcgagggtttctggtcncttctctgcctcagtctggcaacncgctccngacatctctcggctcngtctgacgacgaggctagtattatactgcagctcatntgtctaggtttcgttccttctttanaagtactagttcggcggtaacggaccgtacggctcggaccgtccgtagacgtccacgacccgaaggtcctcggtccccccg

SEQ ID NO: 8046 - DNA, 528 bp, Homo sapiens
  misc_feature: GYAE6OF01CZPS5.9.71.G05.1.454.CMB.1.raw
  modified_base (366)..(366): a, c, t, g, unknown or other
  misc_feature (366)..(366): n is a, c, g, or t
  modified_base (518)..(518): a, c, t, g, unknown or other
  misc_feature (518)..(518): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccaagacaaacgcccccacactcttaatttatgaggtcactaagcgccctcaggggtttctggtcgcttctctgcctccaagtctggcaacncggcctccctgacaattctcgtgggctccagtctgacgacgagctgattattactgcagctcatatgctagtttcgtttccttctttacaagtaattcgttcggcggtagggaccctaggcctagacccgtctagcgtcacggccaaggccncggtcccccg

SEQ ID NO: 8047 - DNA, 652 bp, Homo sapiens
  misc_feature: GYAE6OF01BCG7I.9.71.G05.1.454.CMB.1.raw
  modified_base (198)..(198): a, c, t, g, unknown or other
  misc_feature (198)..(198): n is a, c, g, or t
  modified_base (309)..(309): a, c, t, g, unknown or other
  misc_feature (309)..(309): n is a, c, g, or t
tcagtgatacgtctcacgaccggtgctcgatttagtgtcgtcgcaagagagagggggggtcgacgaagaggcagcgctctcgggacgtctccaccatggcctgggctctgctgctcctcaccctcctcactcaggacacagggtcctgggccctgtctgccctgactcagcctgcctcgtgtctgggtctcctggacnggtcgatcaccatctcctgcactcggaccccacactgattagttgggactattataaccttgtctcctggtatacaacacgaccagacaacgcccacactcttaacttagngtacgtcactaacgcgccctcgagggtttctggtcgtcttactcgtcgtcctacctaacgttcgtcggacaaccgcggccccgttcctaggtaaccaatttccgtaccgtgggtcctccgtaacgttcgtaagaccggaaccgtaacgtcgttacgtagtttactttacgcgtccaggttctactaagttctacggtcttaacggttccgttttccttcgtttaacaaaccggtgtttaagtttcccggggaggttaaccgggaaaccctgggacccggttcggaacccgtttcgtaggtacgtaccggaccgaccggaacggtccctccggttcccccccgg

SEQ ID NO: 8048 - DNA, 602 bp, Homo sapiens
  misc_feature: GYAE6OF01AQCCN.9.71.G05.1.454.CMB.1.raw
  modified_base (330)..(330): a, c, t, g, unknown or other
  misc_feature (330)..(330): n is a, c, g, or t
  modified_base (589)..(590): a, c, t, g, unknown or other
  misc_feature (589)..(590): n is a, c, g, or t
  modified_base (592)..(593): a, c, t, g, unknown or other
  misc_feature (592)..(593): n is a, c, g, or t
  modified_base (595)..(600): a, c, t, g, unknown or other
  misc_feature (595)..(600): n is a, c, g, or t
  modified_base (602)..(602): a, c, t, g, unknown or other
  misc_feature (602)..(602): n is a, c, g, or t
tcagtgatacgtctcacgaccggtgctcgatttagtgtcgtcgcaagagagagggggccctttctgccctgactcagcctgcctccgtgtctgggtctcctggacagtcgatcaccatctcctgcactggacccaccactgatattgggcattataaccttgtctcctggtatcaacaacgcccagacaaagccccacactcttaatttatgaggtcactaagcggccctcaggggtttctggtcgcttctctgcctccaagtctggcaacacggcctccctgacatctctgggctccagtctgacgacgaggctgattatctgcagctnatatgctagttcggttcctctttcaagtattacgtttccggggacggacgggacccagggccgttacggacccgttccgtacgggtccaacggacccctaaacgggtccttcccggtacccccccgttcgggttaccctaccgttcccgttccgtttaccccctaccccgttccctacctacggtaccgttagttccctacgtcgggacggccgggtccgtacgggccgaaacgggccgaccgtaagttacggctacgnncnncnnnnnngn

SEQ ID NO: 8049 - DNA, 792 bp, Homo sapiens
  misc_feature: GYAE6OF01CXENY.9.71.G05.1.454.CMB.1.raw
  modified_base (508)..(508): a, c, t, g, unknown or other
  misc_feature (508)..(508): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctccaccctcctcactcaggacacgagggtccgtcggccctgtctcgtccctgacctcacgcctcgtcccgtccgtcgtccgtcgggttcctccgtggactacgtcgactccacctacttcctcctcgacctaccgtccggaacccctacctacgttagtaacgttacggttcgggaccttaatttaaccttaacccttttggttacccgttccgtttacgggtaaccttaacccgaaaaacccgtaacccggaaccccaaaccggaaaccaaaaccccgaccccccaaacctacctttaactttaagtttacgacggtaacggttacctaacggtaaccggccccgtcccgttacgggttacggggtttccttcgggttccgtcccgttttcncgttccgtaccccgttacgtaacgttcgtacggaacctaacccgtccggtccctacccgtacgaacctacgttccgtcggttacggccctaccgtacgtccgtacggaaccggtacggaacggtcttaacgttaagttacgttactcgtactacgtctactattacgtggtcttacgtttcgttaccttcttaacgtatacgttacggtacggacggtacggacgtacggtcgtacggccgttacgtacgacgtcacccgtacgaacgtccgtccccgtcccgg

SEQ ID NO: 8050 - DNA, 697 bp, Homo sapiens
  misc_feature: GYAE6OF01CID4A.9.71.G05.1.454.CMB.1.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (496)..(496): a, c, t, g, unknown or other
  misc_feature (496)..(496): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatagttggacatttataccttgtctcctggtatcaacaccgccaagaccaagccccanacttacttaattanagacgtcaactaagccgacctcgtagggtttcctgggtctctttctctgccctaccgtaagtcgtaggacctaacgaccggtccctccgtagacctaagtccctggtcggaccttaccgacgtaccgttacggaccggtaacgggacggtcttacggtaactttaacgtttaccgtggtaccacgtaccttnaacttacgtcggactttaacgggttttcggttaccttttaaccttagttaaagtaccggtttaaacggttccggggaaccgggtaaccggggtaccgtaaccggggtaccgttaccgggttaaccccgtccgtttaagggaacccgtttcgaaaccccggaccccggtaaacggtccccggttaccccggtacccccccgg

SEQ ID NO: 8051 - DNA, 684 bp, Homo sapiens
  misc_feature: GYAE6OF01BOJIQ.9.71.G05.1.454.CMB.1.raw
  modified_base (518)..(518): a, c, t, g, unknown or other
  misc_feature (518)..(518): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcacgcctgcctccgtgtcgtgggtctcctggacagtcgactccaccattcctcctgcacgtcggaccccaccactgactagttggctaatttactaaccttgtcctccgttggtactaccaaaccaaccgcccgaagaaccaaaccgaccccactaccttactttaattagtacgtaggtaccaacgtaacgccgtcccgtacggttacgggttctacgggttctccgttctcgtcgcctactagtcgtcgacaaccgccgtccctccgtacgactaacgttcgtacgtcggtcctaccgacgttcgtacgacgacggagtcgttagtactttagtacgtacgcgacgtcctanacgttacgtacggtacgtttacggtttccgttttccgtttactttaacgtaacggtacgttaacggttcccgggaggggttaaccgggaccgtacgggtcccgtacggtccgttaccgtagggacctccggtaccggaccggtaccgcccgttcccgggtaccccg

SEQ ID NO: 8052 - DNA, 693 bp, Homo sapiens
  misc_feature: GYAE6OF01BZYS0.9.71.G05.1.454.CMB.1.raw
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcgatcaccatctcctgcactcggaccccaccactgatagtggctattataacttgtctcctgtatcaacacgccagacaaacgccccacactcttaattatgtagtcactaagccggccctcgtaggggttctcggtctcttcctctcgtccctcctaagtcctacggacctaaccgacccggtccctcccgtacgaacctaacgttccgttccgtcgggtccctccgtacgtccgtacggaaccgaacggacggtccttaggtaatttacgttacgtcgaccgtagtcctacgtaatacgtcggtacgttacggtttccggtttacctttacgtttaccgtaaacggttagttaccgggttaccggggaccggggtaacgggtacccggtacgggtccctaaccggggttaccccgttccgttaacgggtacgttacccggaaccggtaaccccgtacggggtcccgttcccccgggttacccccccggg

SEQ ID NO: 8053 - DNA, 645 bp, Homo sapiens
  misc_feature: GYAE6OF01BSD0C.9.71.G05.1.454.CMB.1.raw
  modified_base (316)..(316): a, c, t, g, unknown or other
  misc_feature (316)..(316): n is a, c, g, or t
  modified_base (448)..(448): a, c, t, g, unknown or other
  misc_feature (448)..(448): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctctcactcaggacacagggtcctgggccctgtctgccctgactcagcctgcctccgtgtctgggtctccgtggacagtcgatcactatccgtcctgcacgtcggaccccacctactgtaatagttgggactaattactaaccttgtcctctgtactacaacacgccagaccaacgccccatactacttaattngacgtacacgtaagtcgacctcgtacggttctcggtctcttctctcgcctaccagtcgtcgaccaacgaccggtccctacctacgactacttccgtcgtcggtacctccgtagtccgagaccgacggacgtntagtacttatacgcgacacgtctgtaatcgtacgtacgttagggtttcccgtttacctttattaacgacgtacgtttccgtacggggtaccgggtaacggggtacctacgggtcgttaccggtccccggttagtaccgggtaccgtaaccggtacccggtacccggtaacggtcccccggttcccgtacccccccgg

SEQ ID NO: 8054 - DNA, 616 bp, Homo sapiens
  misc_feature: GYAE6OF01CABU5.9.71.G05.1.454.CMB.1.raw
  modified_base (194)..(194): a, c, t, g, unknown or other
  misc_feature (194)..(194): n is a, c, g, or t
  modified_base (297)..(297): a, c, t, g, unknown or other
  misc_feature (297)..(297): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctcgtgtctgggtctctggacngtcgatcaccatcctcctgccacgtcggaccccacactgactagtggactattataaccttgtctcctgtactacaacacgaccaagacaaaccgccccaacnctacttaattatgagtacataacgccgtccgtgtagggttctggtcgtcttctctcgtccctccgtaagtccgtacgggaccaacgacccggtccctcccgtacgtaactaacttcgtaccggtcggtcctcctacgtctacggaacgacgaggtcgttaactactttaactgtcgtactaacgtctacatgtagtctacggtttcgttaccttagtttacgtagtacgttacggtcgggcgggaaccgggtaccgacggtcctacggtccgtaccgtagtacgtcgaccggtaccgaaccggtcgtacccggtccccg

SEQ ID NO: 8055 - DNA, 726 bp, Homo sapiens
  misc_feature: GYAE6OF01CVZO5.9.71.G05.1.454.CMB.1.raw
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacgagggtcctggccctgtctcgccctgactcacgcctcgcctcgtgtcgtcgggtcctccgtgacacgtcgactaccacctctcctcctacgcctaccgtaccggacccctactacgtagtagttacggtcggtacttaatttaacttaacccgttcgttccgttccgttaggttacctaaccgaaaaccgacccggacccaacgaacccaaaccgaccccctaactaccttaacgtttaattacgtacgtacggtacaacgtaacgccgtaccgttacgtcgggttcgtcggttcgtcttctactcgtcctaccgtagtccgtcgaaccgtacgtcccgtccctccgtataccctacttccgtacggtccggcttaccgtacgtcgtacggacgtacgtacggtactagttacttacgtacgcgtactacgtctacgtaatacgtcgtcgtttaggtttccgttaccttacgttaacgtaggtacgtttaaccggtcgggttacgggaccggtaccggtacggtccgtaccggttccgtacgtacggtccttacccggacgtacccggacgtcccgtccccgtaccccgg

SEQ ID NO: 8056 - DNA, 589 bp, Homo sapiens
  misc_feature: GYAE6OF01AU5LT.9.71.G05.1.454.CMB.1.raw
  modified_base (296)..(296): a, c, t, g, unknown or other
  misc_feature (296)..(296): n is a, c, g, or t
  modified_base (453)..(453): a, c, t, g, unknown or other
  misc_feature (453)..(453): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacgagggtcctgggccctgtctgccctgactcagcctgcctccgtgtctgggtctccgtggacagtcgatcaccatctcctgccactcggaccccaccactgatagttcggactattataaccttgtctctgtatcaacacgccagacaacgcccccanactacttaattatgagtcactacgcgtcctcgtagggttctggtctcttctctcgtccctcgacgtctggacaacgtccgccctccgcgactactcctcgtcgggtcctacctgtcgtcgaccgacgaggtctagtactttatacgtagctacgctntaagtactgacttacgggttcgttccctttatttacgaacgttacggttacgtcgggtacgggaccgggtacctaggggtcctacggtcccgttcgtgacgtccgacgtacccggaacgtcgtcccgtacccccgg

SEQ ID NO: 8057 - DNA, 775 bp, Homo sapiens
  misc_feature: GYAE6OF01CFSEW.9.71.G05.1.454.CMB.1.raw
  modified_base (762)..(762): a, c, t, g, unknown or other
  misc_feature (762)..(762): n is a, c, g, or t
  modified_base (764)..(764): a, c, t, g, unknown or other
  misc_feature (764)..(764): n is a, c, g, or t
  modified_base (766)..(766): a, c, t, g, unknown or other
  misc_feature (766)..(766): n is a, c, g, or t
  modified_base (768)..(769): a, c, t, g, unknown or other
  misc_feature (768)..(769): n is a, c, g, or t
  modified_base (771)..(772): a, c, t, g, unknown or other
  misc_feature (771)..(772): n is a, c, g, or t
  modified_base (774)..(774): a, c, t, g, unknown or other
  misc_feature (774)..(774): n is a, c, g, or t
tcagtgatacgtctcacgaccggtgctcgatttagtgtcgtcgcaagagagaggggggccctgtctgccctgactcagcctgcctccgtgtctgggtctcctggacagtcgatcaccatctcctgcactcggacccaccactgatagttgggctattaactaaccttgtctcctggtatacaacaaccgccagaacaaacgccccacactacttaatttatgacggtacactaacgccggccctcgtacggggtttcgtcggtcgtcttctctcgcctccaagtcgtcggaccaacgaccggtccctcctacgaacaacttctcgtcggcctcctacgtcgtacggacggtacggacggtctacgtaatttaacttacgtacgacgtacgtcgtactattacgtggtaccgttacggtttccggttttacctttaccgtttaacgtaaacgtaacgtttaacgggtttaccgggggaaccggggtaaccggggtaaccggtacggggtccggttacgggtaaccccggtttccggtaagggtaaccggttaccgaaacccgggtaccccgggtaaacgggttccccgtccccggggtacccccggtttaccgggttcccctaaccgtttcccggttttaccccgtacccccgtaacccgttccgtacgtaaccggtaaccgttccttacggtaccgtcgggtacggggcccggtcggtacgggaccgaaacggggccacggtacgtaacggctacgcgtacncncncnncnngng

SEQ ID NO: 8058 - DNA, 605 bp, Homo sapiens
  misc_feature: GYAE6OF01D5EIE.9.71.G05.1.454.CMB.1.raw
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
tcagtgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctcgccctgactcagcctgcctccgtgtcgtgggtctctggacngtcgatcaccatctcctgcncgtcgacccactactgatagtcggcattataccttntctctgtatacaacacgccanacaacncccacactnttattngtagtacacaacgcgtcctgtacggttgtcgtcgtccttctctcgcctacagtcgtcggaccacgtaccgccctcctagactactccgtcgtcggctccacgttctaggaccgtacggacgggtacttgtaacttttactaccgttcgctacgtctactattacgtacgtcgtttacggtttcgtttaccctttacttactaggttaccgttacggttcggggaacgggtaccggaccggtacggtccgtcggtaccgtcgtagtaccgcgtaccgacccgtacggtcccgtccccggtaccccgg

SEQ ID NO: 8059 - DNA, 786 bp, Homo sapiens
  misc_feature: GYAE6OF01BWS0H.9.71.G05.1.454.CMB.1.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (370)..(370): a, c, t, g, unknown or other
  misc_feature (370)..(370): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctacactcaggacacgagggtcctgggccctgtctcgcccctgacctcacgcctcgcctccgtgtcgtggtctccgtgacngtacgnccacatctcctgcactcgacccacatgatagtggactattataccttgtcctctgtactacgaacaaccgccaanaaccaaacgcccccaactcttactttaattacgtggtacggtacaacgtaacgcccggtaccgttacggtcggggttttaccngggttccgtccttcttaccgtcgtacctacccaaggttcccgtaggaacctacggaccccggtccctttaccccgtaggaaacctaacgttccgttcggtacccgggaccctttaccgacgtcccgttaccgggaaacgccgggtaccggttactaggtaaacctttttagacccgtttcgggaactaccgttaccttacgtaacttaccggtacgttacggtttaacgttttccgggttttaccccttggttttaacaaaccgtttcggttaccgggtaccgggtaccgggggtaacccgacgggttacccggtacccgttaaccgggttaccccgggacgtttcggtaaacccggtttaccgggaacccctacccgggtaacccgtttccccgcccccggttaaaccccccggg

SEQ ID NO: 8060 - DNA, 713 bp, Homo sapiens
  misc_feature: GYAE6OF01A05WE.9.71.G05.1.454.CMB.1.raw
  modified_base (187)..(187): a, c, t, g, unknown or other
  misc_feature (187)..(187): n is a, c, g, or t
  modified_base (264)..(264): a, c, t, g, unknown or other
  misc_feature (264)..(264): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacgagggtcctgggccctgtcctgccctgactcagtcctgacccttcggngtacgtgggtacctcgtaggacctaggtcgaatccaccgtattcctcgtgaccgtacgttcggaccccaccgacgtntagttagtcggacttacgttactacgttgtactccgtaggttacacgaactacgcctaagaacctaaccgcccctatactttcttaacttagtacgacgttacacgtaacgcggtacctacgggtaggttcgtcgtacgtcttcctacgtctaccgntacgtccgngaccaacgccggtccctcggtaaccgttatacgtcgttcgacgtacgtcttacgtacggaacgttacggaacgtcgttacttaacgtttaacgttccgagtaaccgtcggtactacctaacgttcgtacgtaccggtttacgttacccgtttcgttaactacgtaaccgttagttacgggtcggaaccggtacggtacgtaaccggtcgttacccggtaccggttaccgtagtacccggtaacttcccggaaccggttccgtacccggtccgttaaaccccgg

SEQ ID NO: 8061 - DNA, 496 bp, Homo sapiens
  misc_feature: GYAE6OF02GAS09.9.71.G05.1.454.CMB.1.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
tcagtgatacgtctcacgaccggtgctcgatttagtgtcgtcgcaagagagaggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagccccanactcttaatttangaggtcactaagcggcctcaggggtttctggtcgcttctctgcctcaagtctggcaacacggcctccctgacaatctctgggctccagtctgacgacgaggctgattatactgcagctcatatgcagttgttcctnttcaagatatcggcgaggaccaggctgaccgttcngacgtcacgcccaaggcctgcccccg

SEQ ID NO: 8062 - DNA, 514 bp, Homo sapiens
  misc_feature: GYAE6OF02F73H5.9.71.G05.1.454.CMB.1.raw
  modified_base (290)..(290): a, c, t, g, unknown or other
  misc_feature (290)..(290): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaatttatgaggtcactaagcggccctcaggggtttctggtcgcttctctgcctccaagtctggcaacacggcctccctgacaatctctgggctccagtctgacgacgaggctgattatactgcagctcatatgcagtttggttcctctttcaagtatagttcggcggaggaccaggctggaccgtcctgacgtcacgcccaaggtcctcgtccccccg

SEQ ID NO: 8063 - DNA, 516 bp, Homo sapiens
  misc_feature: GYAE6OF02HFZAV.9.71.G05.1.454.CMB.1.raw
  modified_base (330)..(330): a, c, t, g, unknown or other
  misc_feature (330)..(330): n is a, c, g, or t
  modified_base (395)..(395): a, c, t, g, unknown or other
  misc_feature (395)..(395): n is a, c, g, or t
  modified_base (437)..(437): a, c, t, g, unknown or other
  misc_feature (437)..(437): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacacgccagacaaagccccacactcttaatttatgagtcactaagcggccctcgaggggtttcnggtcgcttctctgcctcagtctggcaacacgcctcctgacatctctgggctcagtctgacgacgnggctgattattactgcagctcattatgctagttcgttccttntttacagtatagttcggaggacgggtaccgaggtctcggaccgtctaggacgtcgacgacccgtaggcctccgtccccg

SEQ ID NO: 8064 - DNA, 511 bp, Homo sapiens
  misc_feature: GYAE6OF02F37AA.9.71.G05.1.454.CMB.1.raw
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (464)..(464): a, c, t, g, unknown or other
  misc_feature (464)..(464): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacgcccagacaaagcccccacactcttaattatgaggtcactaagcggccctcgagggtttctggtcgcttctctgcctccaagtctggcaacacgcctccctgacaatctctggctcagtctgacgacgaggctgattatactgcagctcatangctagttcgttcctnttacaagtatagttcggcgaggaccnggtcctggacccgtcgtgacgtcacgcccgaaggtcctcgtcccccg

SEQ ID NO: 8065 - DNA, 526 bp, Homo sapiens
  misc_feature: GYAE6OF02IC2CE.9.71.G05.1.454.CMB.1.raw
  modified_base (367)..(367): a, c, t, g, unknown or other
  misc_feature (367)..(367): n is a, c, g, or t
  modified_base (426)..(426): a, c, t, g, unknown or other
  misc_feature (426)..(426): n is a, c, g, or t
  modified_base (466)..(466): a, c, t, g, unknown or other
  misc_feature (466)..(466): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgagtcactaagcggccctcagggtttctggtcgcttctctgcctcagtctgcacatgcctccngacatctcgtgggcctccagtctgacgacgaggctgtaatttatactgcagctacatangtctagtttcgttccttctttacaagtattagttccgggnggtacgggaccgtaggctcggacccgttccgtggacgtccacgcccgtacggcctcccgg

SEQ ID NO: 8066 - DNA, 522 bp, Homo sapiens
  misc_feature: GYAE6OF02GV2ZK.9.71.G05.1.454.CMB.1.raw
  modified_base (423)..(423): a, c, t, g, unknown or other
  misc_feature (423)..(423): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattatgagtcactaagcggccctctaggggtttctggtcgcttctctgcctcaagtctggcaacacgcctcctgacaatctcgtggctcagtctgacgacgaggctagattattactgcagctanatatgctagtttcggtcctctttcaagtatagttcggcggaggaccgaggtctgacccgtccgtagacgtcgacgacccgaaggtcctacgtccccccg

SEQ ID NO: 8067 - DNA, 556 bp, Homo sapiens
  misc_feature: GYAE6OF02HZ3Z7.9.71.G05.1.454.CMB.1.raw
  modified_base (306)..(306): a, c, t, g, unknown or other
  misc_feature (306)..(306): n is a, c, g, or t
  modified_base (454)..(454): a, c, t, g, unknown or other
  misc_feature (454)..(454): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggcattataaccttgtctcctggtatcaacaacgcccagaacaaacgccccacactcttaattangagtcactaagcggccctcgtagggtttctggtcgcttctctgcctccaagtctggcaacaccggcctccctgacaatctcgtggcctccagtctgacgacgaggctgtattattactgacagctacatatcgctagtttcgttcctntttacaaagtattagttcgggacggacgggaccgagggtcctacggtacccgttcgtaggtacgtccgaacggaccccgaagggtccctccggtaccccccg

SEQ ID NO: 8068 - DNA, 511 bp, Homo sapiens
  misc_feature: GYAE6OF02GCPHY.9.71.G05.1.454.CMB.1.raw
  modified_base (245)..(245): a, c, t, g, unknown or other
  misc_feature (245)..(245): n is a, c, g, or t
  modified_base (470)..(470): a, c, t, g, unknown or other
  misc_feature (470)..(470): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattanaaccttgtctcctggtatcaacaacgcccagacaaagcccccacactcttaatttatgaggtcactaagcggcctcaggggtttctggtcgcttctctgcctccaagtctggcaacacggcctccctgacaatctctgggctccagtctgacgacgaggctgattatactgcagctcatatgctatttggttccttctttacaagtatagttcggcggaggaccnggctggaccgttctgacgtcacgcccaaggcctgtcccccg

SEQ ID NO: 8069 - DNA, 515 bp, Homo sapiens
  misc_feature: GYAE6OF02F19UU.9.71.G05.1.454.CMB.1.raw
  modified_base (245)..(245): a, c, t, g, unknown or other
  misc_feature (245)..(245): n is a, c, g, or t
  modified_base (393)..(393): a, c, t, g, unknown or other
  misc_feature (393)..(393): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattggcattanaaccttgtctcctggtatcaacaacgcccagacaacgccccacactcttaatttatgaggtcactaagcgcctcagggttctgtcgcttctctgcctccaagtctggcacacggcctcctgacaatctctggctcagtctgaccgagngctgacttattactgcacgtcactatatgctagtttcgttccttctttacaagattagttccggcggagggaccctaggcctgtaccgtctgcgtacacgtcccaaggtcctccgtcccccg

SEQ ID NO: 8070 - DNA, 516 bp, Homo sapiens
  misc_feature: GYAE6OF02FJSMI.9.71.G05.1.454.CMB.1.raw
  modified_base (247)..(247): a, c, t, g, unknown or other
  misc_feature (247)..(247): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (411)..(411): a, c, t, g, unknown or other
  misc_feature (411)..(411): n is a, c, g, or t
  modified_base (449)..(449): a, c, t, g, unknown or other
  misc_feature (449)..(449): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcatttanaaccttgtctcctggtatcaacaacgcccagacaaagcccccanactctaatttangaggtcactaagcggccctcaggggtttctggtcgcttctctgcctcaagtctggcaacacggcctccctgacaatctctgggctccagtctgacgacgagctgattntactgcagctcatatgcagttggttcctctttcaagtntattcggcgaggaccgaaggctcggaccgtccgtaggtcctagcccaagggcctacgcccccgtcgg

SEQ ID NO: 8071 - DNA, 523 bp, Homo sapiens
  misc_feature: GYAE6OF02FUL77.9.71.G05.1.454.CMB.1.raw
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcgcctcgaggggtttctggtcgcttctctgcctccaagtctggcaacacggcctccctgacaatctctgggctccagtctgacgacgagctgattattactgcagctcattatgctagtttcggttccttctttacaagtattacttcgggcggagggaccagggcttgacccgttctgagtcacgcccaaggcctacgtcccccg

SEQ ID NO: 8072 - DNA, 551 bp, Homo sapiens
  misc_feature: GYAE6OF02GFKNE.9.71.G05.1.454.CMB.1.raw
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatattgggcattataaccttgtctcctggtatcaacaacnccagacaaacgccccanactcttaattangagtcactaagcgccctcaggggtttctggtcgcttctcngcctcaagtctggcaacgacgcctccctgaccaatctcgtggctccagtctgacgacgaggctgattatactgcagctacatatcgactaggtttcgttaccttctttacaaagtattacgttcgggacgggacgggaccgtagggcttacggaacccggttctaggacgttcgaacgaccccgtaaggtcccgtcccgtaccccccgg

SEQ ID NO: 8073 - DNA, 536 bp, Homo sapiens
  misc_feature: GYAE6OF02H9ONO.9.71.G05.1.454.CMB.1.raw
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
  modified_base (448)..(448): a, c, t, g, unknown or other
  misc_feature (448)..(448): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacacgcccagacaaacgccccacactcttaattatgagtcactaagccggtccctcgtagggtttctggtcgcttctctgcctccaagtctgacacgaccgcctccctgacaatctcgtggcctccagtctgacgacgaggctgattattacngcngctcatatgctagtttcgttccttntttacaagttattagttcggcggtaggacctggcctggacccgttccgtaggacgtcgaaccgcccgaaggtccctaccgtccccccg

SEQ ID NO: 8074 - DNA, 579 bp, Homo sapiens
  misc_feature: GYAE6OF02ICNM3.9.71.G05.1.454.CMB.1.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgatcaccatctcctgcactggacccaccactgatattgggcattataaccttgtctctggtatcaacaacgccagacaaacgccccacactcttaattatgagtcactaagcgcctnagggtttcnggtcgctttctctgtcctcctaagtctggaccaacgaccgtcctccgtgactactctcgtcggcctcagtctgacgacgngctgtaatttacttacgtgctagctanattatgtctaggtttcgttccttacgttacaagtacgttacgttcgggacgggtaaccgggtaccgacgggtacctacgggtaaccccgttccgtaggtacgttaccgaccggtaccccggaaggttccccgtccgtcccccccgg

SEQ ID NO: 8075 - DNA, 711 bp, Homo sapiens
  misc_feature: GYAE6OF02H9PWI.9.71.G05.1.454.CMB.1.raw
  modified_base (202)..(202): a, c, t, g, unknown or other
  misc_feature (202)..(202): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
tcagtgatacgtctcacgaccggtgctcgatttagtgtcgtcgcaagagagaggggggggtcgacgaagaggcagcgctctcgggacgtctccaccatggcctgggctctgctgctcctcaccctcctcactcaggacacagggtcctgggccctgtctgccctgactcagcctgcctccgtgtcctgggtctccgtggacngtcgatcaccatctctgcactcggacccacactgatagttgggctattataaccttgtctcctggtatcaacaacgccagacaaacgccccanactcttaatttangagtcactaacgcggccctgtacgggtttcnggtcgtcttctctcgccctacaacgttctacggacctaaaccgaccggtccccttccccgtagaacctaacgttccttccgtcgggtccttccgtaacgtccgtagaaccggaaccgggtaacggtccgtagttaactttaactttaccgtagtcccgtaagtcctaccttaattacgttacgtaccgttaagggttttccggtttaccctttcgttttaaccgtaaagttaactttacggtttaccggggaccgggtaacgggggtaccccgtaaaggggtccttaccggtaacccggtttccggtacggttacgtacccggtaaccggaccccggtaaacgggtcccgttacccggttaccccccccggg

SEQ ID NO: 8076 - DNA, 620 bp, Homo sapiens
  misc_feature: GYAE6OF02IQD1D.9.71.G05.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcaccaggcaaacgccccaaactcatcatttangaggtcactaacgcggccctcgtagggtttctattcgtcttctctcggctacaagtctcgaacaacacggccctccgtnacatctctcgggctaccgnggtctcggaggacggagcttagtatttacttacgtgtacctgtctctattacgtgtaccgagtagttacgggtcgaaccgtaccgttcccgggttaggttacggtttcccggggacggggtaaccggggtaaccgtaaaccggggttaccgtaaccccgggttaccgtaccggggttacccgtaaccggaccccgtaaccgggtcccttacccccgggg

SEQ ID NO: 8077 - DNA, 561 bp, Homo sapiens
  misc_feature: GYAE6OF02F7E0K.9.71.G05.1.454.CMB.1.raw
  modified_base (291)..(291): a, c, t, g, unknown or other
  misc_feature (291)..(291): n is a, c, g, or t
  modified_base (400)..(400): a, c, t, g, unknown or other
  misc_feature (400)..(400): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaacgcccccanactcttaattatgaggtcactaagcggccctcgagggtttctggtcgtcttctctcgcctccaagtctggcaacaccggccctccctgacaatctcgtggcctcagtcngacgacgagctgattattactgcagctcatatgctaggtttcgttccttactttacaagttattacgttccgggacggtacgggacctagggtccttacggtaccccgttccgtacgacggtccaacggaccccgtaagggtccctacccggtccccccgg

SEQ ID NO: 8078 - DNA, 571 bp, Homo sapiens
  misc_feature: GYAE6OF02HVBX6.9.71.G05.1.454.CMB.1.raw
  modified_base (543)..(543): a, c, t, g, unknown or other
  misc_feature (543)..(543): n is a, c, g, or t
  modified_base (561)..(561): a, c, t, g, unknown or other
  misc_feature (561)..(561): n is a, c, g, or t
  modified_base (570)..(571): a, c, t, g, unknown or other
  misc_feature (570)..(571): n is a, c, g, or t
tcagtgatacgtctcacgaccggtgctcgatttagtgtcgtcgcaagagagaggggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattatgagtcataagcggccctcaggggtttctggtcgcttctctggctccaagtctgacaacacggcctccctgacaatctctgggctccaggctggaggacgagctgattattactgctgctcatatgcagatgtgacaccttccgtggttacttcgggcggagggaccgaaggtcgaccgtcgtaggtcacgaccgaaggtcctcggccccgtcggtccaccttcgtccgttacccgaccctccctcgaacgtaccgttactaccgtacgtacggacgggtccggggtccgtacgggaccgtaacggggccgtacccggtaagttaacgggaccncgtcgacgacgacgacgngtcgcgcgnn

SEQ ID NO: 8079 - DNA, 538 bp, Homo sapiens
  misc_feature: GYAE6OF02GNBOW.9.71.G05.1.454.CMB.1.raw
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagccggccctcgaggggtttctggtcgcttctctgcctcaagtctggcaacacgcctccctgacaatctcgtgggctccagtctgacgacgagctgattatactgcagctanatntgcagccaccacatgtcttacgggagtcgggaccacggtccgacccgttaccgtacggtaccaccggtaccccaacgggaccccaacccccgacttacggtctaaccccg

SEQ ID NO: 8080 - DNA, 579 bp, Homo sapiens
  misc_feature: GYAE6OF02IC2B5.9.71.G05.1.454.CMB.1.raw
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccaccactgatattgggcattataaccttgtctctggtatcaacaacgcccagacaaacgcccccanactcttaaatttangacgtcactaagcgcctcagggtttctggtcgcttctctgcctcaagtctggcaacacggcctaccctgacaatctctgggctccgagtctgacgacgaggctcgattacttactgacagtctactatacgtgccgagtttcggttacccttcttttaccgaaagtacttacgttccgggtacgggtacggggtaccgtacgggtcgttacggtaacccggttcctaggtacggtccgtaaccggaccccgtaaggtccgttaccggcccccccgg

SEQ ID NO: 8081 - DNA, 618 bp, Homo sapiens
  misc_feature: GYAE6OF02F975C.9.71.G05.1.454.CMB.1.raw
  modified_base (292)..(292): a, c, t, g, unknown or other
  misc_feature (292)..(292): n is a, c, g, or t
  modified_base (375)..(375): a, c, t, g, unknown or other
  misc_feature (375)..(375): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccanactcttaattatgaggtcactaagcggccctcaggggtttctggtcgcttctctcgcctccaagtctggcaacacggcctccngacaatctctgggctcagtctgacgacgaggctagatttactactgcacgtctacattatcgacgttacggtttacggtttccctttacgttttacaaaggttacttaccggtttccggggacgggacggggtaacccgtacgggtaccgttaccgggtaaccccggtttcccttacgggtaccggttccgtaaccgggtacccccgtaaacgggtcccgttaccccgggttaccccccccgg

SEQ ID NO: 8082 - DNA, 600 bp, Homo sapiens
  misc_feature: GYAE6OF02GJW31.9.71.G05.1.454.CMB.1.raw
  modified_base (328)..(328): a, c, t, g, unknown or other
  misc_feature (328)..(328): n is a, c, g, or t
  modified_base (432)..(432): a, c, t, g, unknown or other
  misc_feature (432)..(432): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccacactgatatggcattataaccttgtctcctggtatcaacacgccagacaaacgcccccacactacttaatttatgaggtcactaagcgcctcgtagggtttcnggtcgcttctctgcctcaagtctagcaacaccgcctccctgaccaatcctacgtggcctccgagttccgtagaccgtacggacgtcgttacgggttacttacgngtccagtcgttcaagttgtcgacgttacgtttcgggtttacccttcgttttaccgaaagtactttaggttccgggacggtacgggacccgaacggttcgtacgtacccggttcctacggtagtaccgacgggttacccgaacggtccgtacccgtcccccgttaccgg

SEQ ID NO: 8083 - DNA, 510 bp, Homo sapiens
  misc_feature: GYAE6OF02JFZDH.9.71.G05.1.454.CMB.1.raw
  modified_base (486)..(486): a, c, t, g, unknown or other
  misc_feature (486)..(486): n is a, c, g, or t
  modified_base (496)..(510): a, c, t, g, unknown or other
  misc_feature (496)..(510): n is a, c, g, or t
tcagtgatacgtctcacgaccggtgctcgatttagtgtcgtcgcaagagagagggggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaattatgaggtcactaagcggccctcaggggtttctggtcgcttctctgcctcaagtctggcaacacggcctccctgacaatctctgggctccagtctgacgacgaggctgattattactgcagctcatatgcaggccacccacaatcgttcgttacggaagtcggggaccacggtcaccgtccgtaggtcacgcccaacggcccaacccactcgtcacttctcgttcccaccctcctcagtactactccacgtcgacggcgggtctcggacaagggccnccgatacggnnnnnnnnnnnnnnn

SEQ ID NO: 8084 - DNA, 568 bp, Homo sapiens
  misc_feature: GYAE6OF02GXHXD.9.71.G05.1.454.CMB.1.raw
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctggtatcaacacgcccagacaaacgcccccanactcttaattatgagtcactaagcggccctcagggtttctggtcncttctctcgctccaagtctggcaacacgcctcctgacaatctctggctccagtctggacacgagctgacttatacngcagctcattancgtctagtttcggttccttactttacgaaagttattagttccgggacgggtacgggaaccgtaggtaccgttcggtaacccggttccgttaggaaccgttaccgaaccggaccccggtaaggtcccgttacccggtaccccccgg

SEQ ID NO: 8085 - DNA, 726 bp, Homo sapiens
  misc_feature: GYAE6OF02JL4OC.9.71.G05.1.454.CMB.1.raw
  modified_base (311)..(311): a, c, t, g, unknown or other
  misc_feature (311)..(311): n is a, c, g, or t
tcagtgatacgtctcacgaccggtgctcgatttagtgtcgtcgcaagagagagggggggtcgacgaagaggcagcgctctcggacgtcgtccaccatggcctgggctcgtgctgctcctcaccctcctccactcaggacacaggtcctgggccctgtctgccctgactcagcctgcctccgtgtctgggtctcctggacagtcgactcaccatctcctgcactcggaccctaccactcgatacttgggcattataaccttgtctctgtatcgaacacgcccagacaaacgccccaacactcttaactttangaggtcaacgtaagccggccctacgacgggtttctaggttccgcgtttcctacgtcgtcccttccaacgttcgtcgcgtaaacacccggtcctcccttacgacctaactctaccgtacggtcctccgtaacgttcgttaccgacgtaaccggtaggtacccgtaggtacttttaacgtttaccgtttacgaaccgtcggttacctaaccgttattaaacgttcgtacgttaaaccgggtttttcggttacccgttttaccttttaaccggttaaacgttaacgttacggttttaccggggccgggttaacggggtaacccgcggggttaaccgttaccggtaaacccggtttccgttacggtaccggtacggttaaccggcccgtaaacgggttcccgtacccgttccccccggg

SEQ ID NO: 8086 - DNA, 712 bp, Homo sapiens
  misc_feature: GYAE6OF02G2D1I.9.71.G05.1.454.CMB.1.raw
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatcctcctgcacgtcggacccaccactgatagttggactattaacttaaccttctctccgtggtactacaacaaccgccagaacaaaccgcccccaacacttactttaatttactagacggtactaacgtaacggccggtccctacgtacggggtttctcggtcgtcgttcctcgtctcctaccaagttccgtacggaccaacgtacccggtcccttcccgtacgaacctaacttccgtaccgttcgggcccttaccgtacgttcgtacggaccgtacgggacggtcttaggttaactttacgttacgtcggtacacgtacctactaagtacttcgtacgttacggttttccgtttcctttaccgtttaacgaaacgttacgtttaccggttcggggtaccgggtaacgggtaccggtaacgggtccgttaccggtaacccgttcgtacggtaaccggtaccgtaaccggtaacccggacggtcccgtccccggtacccccgg

SEQ ID NO: 8087 - DNA, 549 bp, Homo sapiens
  misc_feature: GYAE6OF02GAS8Y.9.71.G05.1.454.CMB.1.raw
  modified_base (374)..(374): a, c, t, g, unknown or other
  misc_feature (374)..(374): n is a, c, g, or t
  modified_base (505)..(505): a, c, t, g, unknown or other
  misc_feature (505)..(505): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (534)..(549): a, c, t, g, unknown or other
  misc_feature (534)..(549): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgattagttgggctatttagtaacctttgtcttcctggtacttacaacaaccgcccagaaccaaacgacccccacaccttactttaatttatggacggtcaacgtaagcggccctcgtagggtttctggtcgcttctctcncctcactctggcaacgaccggccttccctgactcacgacccgaaggcctacgcccccgtggtcctaccgtcctacgttcccccacccttccgtacacgtaaccttctccctacgtcgacgggccggtacgngggacgacggtccgactagtagcngnacnnnnnnnnnnnnnnnn

SEQ ID NO: 8088 - DNA, 663 bp, Homo sapiens
  misc_feature: GYAE6OF02G5P0Y.9.71.G05.1.454.CMB.1.raw
  modified_base (297)..(297): a, c, t, g, unknown or other
  misc_feature (297)..(297): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattggcattataaccttgtctcctgtatcaacacgccagacaacgccccacactacttaattangagtcactaagcggcccgtgggtattctgctcgtcttctcgtggcctcaacgtccgtacaaccgtaccggtccctccctagaacctaacttccgtacgtcgggtcctaccgaagaccgtaggaacgggaccgaggtccttactaaatttaactttacgttgttcgccttacgaattaacttaacggtaagggttagttaaacgggtttagggtttcggggttacggttccggggacgggtaacgggtaacctaaggtccgttacgggtacccggttccggttaacgggtaccgtaaccgtaccccggtaaggtaccccgttccggtaccccccggtacgggtacccttaccgttcccgttccccgg

SEQ ID NO: 8089 - DNA, 541 bp, Homo sapiens
  misc_feature: GYAE6OF02GLYGG.9.71.G05.1.454.CMB.1.raw
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
  modified_base (486)..(486): a, c, t, g, unknown or other
  misc_feature (486)..(486): n is a, c, g, or t
tcagtgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggcattataaccttgtctcctggtatcaacaacgcccagacaaacgccccacactcttaatttatgaggtcccataagcggccctcgagggtttctggtcgtcttctctgcctcaagtctgcacacgcctcctgacactctctggctcngtctgacgacgaggctgtattattactgcngactcatatgactgtttcggttccttgttttacaagtacttagttccgggacgggtacggaccgnggtcctaggtacccgtcgtggacgtcgacgacccgaaggtccgtcccgtcccccg

SEQ ID NO: 8090 - DNA, 703 bp, Homo sapiens
  misc_feature: GYAE6OF02JSK65.9.71.G05.1.454.CMB.1.raw
  modified_base (538)..(538): a, c, t, g, unknown or other
  misc_feature (538)..(538): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctcgtgtctggtctcgtggacagtcgatcaccattcctcctgcactcggacccactactgactgttcgggctattacgtaacttcgtcctcgtggtactaccgaacaaccgtcccaagaccaaacgcccccacactacttaatttacaggtacgtacacgttaacgccggtacccttcgtacgggtttccgtcggtcgtcgtttccgtctacggtccctacctaacggttcgtacggccaaaccgtaccggtcccttacccgtcggaacctaacgttccgtacgtccggtaccgttccgtacggtccgttacgaccggaacggcggtaccttagtaactttcgtaactcgcgaacgtctacgntacgtcgtaccgtggttcgtttccttacttacggttaaactcgtttacgttcgggaccggtacggggttaacccggccttacggggcccctttacggtaccgggtagttaccccggtaccggtaccccggaaccggtcccggtttccccgcccccgtttcccggg

SEQ ID NO: 8091 - DNA, 643 bp, Homo sapiens
  misc_feature: GYAE6OF02H9MLX.9.71.G05.1.454.CMB.1.raw
  modified_base (237)..(237): a, c, t, g, unknown or other
  misc_feature (237)..(237): n is a, c, g, or t
  modified_base (474)..(474): a, c, t, g, unknown or other
  misc_feature (474)..(474): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctcgccctgactcagcctgcctccgtgtcgtgggtcctccgtggacagtcgatccacatctctgcacgtcgacccacacgtnatagtggctattataccttgtctcgtgtactacaacacgccaagaccaaccgcccctacacttactttaattacagtagtacaacgtaacggccgtcccttaggtcgggtttactcgggttcctctttccgtaccgtccgtacccttacgtaacgttcgtacggaacctaaccgacccggtccctaccctagtaacacgttcgtacgtcggacctcgtatcgacgacgtacggcgtntattaattacgttctagctacgctaacgtattagtcgtacgtttacggtttcgttacccttacgttaacgaaagttacgttacggtccgggacggacggttaccgaacggttccgtacggtacctcgtaggacgttccgaacgtacccgacggtccgtcccgtaccccg

SEQ ID NO: 8092 - DNA, 572 bp, Homo sapiens
  misc_feature: GYAE6OF02GLR75.9.71.G05.1.454.CMB.1.raw
  modified_base (385)..(385): a, c, t, g, unknown or other
  misc_feature (385)..(385): n is a, c, g, or t
  modified_base (456)..(456): a, c, t, g, unknown or other
  misc_feature (456)..(456): n is a, c, g, or t
  modified_base (487)..(487): a, c, t, g, unknown or other
  misc_feature (487)..(487): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctctggacagtcgatcaccatctcctgcactcggacccacactgatagttgggcattactaaccttgtctcctggtactcaaccaacgcccaagaaccaaacgcccccaacacttacttaatttactgacggtcaacgtaacgccggtccctgtacgggtttctcggttctcttctctcgtcctcaagtctcggcaacncgcctcctgactaactctcgtcggctccgtagtctgacgacgaggctagtaattatactcgacacgtctanaatcgtagtctagtttcgttccttacgttanaacgtattacgttcggacggacggtaccgaggtctacggtaccgtcgtacgacgtaccgacgcccgaagtccgtaccgtccccgg

SEQ ID NO: 8093 - DNA, 755 bp, Homo sapiens
  misc_feature: GYAE6OF02G1TNH.9.71.G05.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (318)..(318): a, c, t, g, unknown or other
  misc_feature (318)..(318): n is a, c, g, or t
  modified_base (639)..(639): a, c, t, g, unknown or other
  misc_feature (639)..(639): n is a, c, g, or t
tcagtgatacgtctcacgaccggtgctcgatttagtgtcgtcgcaagagagaggggggggtcacgaagaggcagcgctctcgggacgtctccaccatggcctgggctctgctgctcctcaccctcctcactcaggacacagggtcctgggccctggtctgccctgactcagtcctccctccgcgtccgggtctccgtaggccaggttccggtcacctagtctcctgaccagtcggaaaccnggctagtgactagtttgggataccttttaanaaacttatcggttcctccgttacgggtaaccaacgacgccaacccngggtaacaaaaccgttacccccaaaattccatttacggtaattttacgagggtataaccgtaaataaccggtcggccctttcggtccgggggttccccctggtaacgtccgtacctttccgttcggtcggtaacctacccgtaagttcccgtcggtaaaccgaaacccggtccgcccccgttttacccggaccggtaaccggttccttcggtccgggtaccgttccgacggtcccgttacggacgtttaacggcggtaacggggtccttaaggtacgttttaaacgtttaaccgagtcgtaaacggtcttaccgaaggttntacgggacctaggaccctaccgaactacgttccgtacgtttacgggacgtacggacccgtacgtcgtacccgtacgtaggttaccacgtacccgaagccccgaccctagcttaccg

SEQ ID NO: 8094 - DNA, 768 bp, Homo sapiens
  misc_feature: GYAE6OF02IC1E2.9.71.G05.1.454.CMB.1.raw
  modified_base (762)..(762): a, c, t, g, unknown or other
  misc_feature (762)..(762): n is a, c, g, or t
  modified_base (766)..(766): a, c, t, g, unknown or other
  misc_feature (766)..(766): n is a, c, g, or t
tcagtgatacgtctcacgaccggtgctcgatttagtgtcgtcgcaagagagagggggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagccggccctcgtaggggtttctggtcgcttctctcgcctccaagtctggcacacgcctccctgacaatctcgtggctccagtctgacgacggacggctgtatttaacttacgtgcgagtcctacgatacgtgcgttagttttcgggttttaccctttcttttacgtaacgtatttaaacggtttcccggggaccgggtaacgggggtaacccgtaggggtaccgttacggtaaccgtaaccgggttacccgttagggtaaccggttaccgtaaccgggtaaccccggtaaacgggtccccgttaccccgggtccccccccgtttacccgggggttaccccttaaccccggtttaccccgttttcccccggtttaccccccgttaccccccgtttccccttaacccggtaaccggttaaccgtttaccgttacccggttaacccgtacgggtaaccggggtcccggggtaccggtaccgggacccggtaaccggggtaccggtaccgtaacggttaacgccgacgtcgtcgctaccgancacngc

SEQ ID NO: 8095 - DNA, 578 bp, Homo sapiens
  misc_feature: GYAE6OF02FQ4G7.9.71.G05.1.454.CMB.1.raw
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (400)..(400): a, c, t, g, unknown or other
  misc_feature (400)..(400): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctcgtgtctggtctcgtgacngtcatcacatctcctgcactcggacccacactgatagttggactattataccttgtctctagtactacaacacgccagacaaccgcccanacttnttaattatgagtcacgtaacgccgtcctgtacgggtttctcggtcgtcttctctcgcctccagtcgtggacacgcgtcctccgtgacctatcgtcgtgtcctcgctcgngaccgacggacggctagtactttactacgtgacntctnaatntcgacgttagtttccggttctttacttaacgtaacgttacgttagggtccgggtacggaaccgggcgtacggtcctaccggttaaccgtcgtagtacggtacgaccggtacccgaaggtccctacccggtcccccg

SEQ ID NO: 8096 - DNA, 603 bp, Homo sapiens
  misc_feature: GYAE6OF02JJHW7.9.71.G05.1.454.CMB.1.raw
  modified_base (275)..(275): a, c, t, g, unknown or other
  misc_feature (275)..(275): n is a, c, g, or t
  modified_base (578)..(578): a, c, t, g, unknown or other
  misc_feature (578)..(578): n is a, c, g, or t
tcagtgatacgtctcacgaccggtgctcgatttagtgtcgtcgcaagagagaggggggggggtcacaagaggcagcgctctcgggacgtctccaccatggcctgggctctgctgctccctccaccctcctcactcaggacacagggtccgtgggccctgtcgtgccctgactcagcctgcctccgtgtctgggtctcctggacagtcgatcaccatctcctgcactggacccaccactgatatggctattataacttgtctcctgtatcaacacnccagacaacgcccccacactacttaattatgagtacacaacgccgcctcgtagggtttctggtcgtcttctctcgtccctaccaacgtctcggaccaacgaccggtcccttccctcgtaacctaactccgttccggtcgggtccctccgtaacgttccgtacggaccgtaacgggaggtcccttagttaacttttaacgttactcggacctacgtactactactacgtgcgtttacggttcgtttccttatttacgatattcggtggaccggtaggaccgtaggctcggtacctgtagcgacncggaccgtacgccgtaccctcccgg

SEQ ID NO: 8097 - DNA, 583 bp, Homo sapiens
  misc_feature: GYAE6OF02F21LM.9.71.G05.1.454.CMB.1.raw
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatattggcattatacctgtctctgtatcaacacgcccagacaagccccacnctctaattangaggtcactagcgccctcgtagggttctggtcgcttctctcgctccaagtctcggcaacacggccctccctgacctaatcctcgtacgggcctaccgagtctgaccgacgacggctcgtatttaattactacgctagccttcaacttagtacgacgacggaccacccgtaacaacttggtccgttacgggaagtccggggaaccgacggtacctacccggttccgtaacggttccgaacggtacccccgaacggtacccccgaaccccctacgtaccgtacccgtacccg

SEQ ID NO: 8098 - DNA, 613 bp, Homo sapiens
  misc_feature: GYAE6OF02GTDZJ.9.71.G05.1.454.CMB.1.raw
  modified_base (299)..(299): a, c, t, g, unknown or other
  misc_feature (299)..(299): n is a, c, g, or t
  modified_base (547)..(547): a, c, t, g, unknown or other
  misc_feature (547)..(547): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatcctctgcactggacccaccactgatagttgggcattataccttgtctctgtatcaacacgccagacaacgccccacactacttaattangaggtcaactaacggcggcccctgacgggtttctcggtcgtcttctctcgcctaccaagtctacggacaacgacggccccttcctagtacctaatcctcgtacgggcctacagttctcgtaccggaacgtagggtcttagaatttaacttacgttggacctagtcctacgtaacttagtacgccgtttaggtttcggtttacctttacgttacaaacggtaacttacgttcgggacggagggtacccngggtccttacggtacccgttcgtaagtacgttccgacggtacccaacgggtccctaccgtcccccg

SEQ ID NO: 8099 - DNA, 639 bp, Homo sapiens
  misc_feature: GYAE6OF02JF8LY.9.71.G05.1.454.CMB.1.raw
  modified_base (348)..(348): a, c, t, g, unknown or other
  misc_feature (348)..(348): n is a, c, g, or t
tcagtgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctcctgcactcggacccaccactgactagtggctattactaaccttgtctcctggtactcaacacgccagacaacgccccacactcttaattatgacgtcactaacgcgccctcgtagggtttcgtggtcgtcttcnctcgcctctagtctgcaacgcgcctcctgactactctcgtcggcctcctacgtcacggacgtacggacgtctagtacttacgttactcgctagtactctaacgttctacgtacgttacgggttttacggtttccctttacgtttaccgtaaagttacgtttacgggttaccgggacgggggtaaccggtaccggtaccggggtaccgttacgggtacccggtccgttaagggtacccgtaccggaccggttaaccccgaacccgggtcccggtacccccgttacccccggg

SEQ ID NO: 8100 - DNA, 650 bp, Homo sapiens
  misc_feature: GYAE6OF02IHPLF.9.71.G05.1.454.CMB.1.raw
  modified_base (321)..(321): a, c, t, g, unknown or other
  misc_feature (321)..(321): n is a, c, g, or t
tcagtgatacgtctcacgaccggtgctcgatttagtgtcgtcgcaagagagagggggggtcacaagaggcagcgctctcgggacgtctccaccatggcctgggctctgctgctcctcaccctcctcactcaggacacagggtcctgggccctgtctcgccctgactcagcctcgtcctccgtgtcgtgggtcctccgtggacagtcgatccaactctctcctgccactcggacccacactaggtactagttcgggctagttactaaccttgtcctcgtcgtatccaactacgccagaacaacgcccacacttcttaattangtacgacacgtacgccgtcctcggtacggttctcggtcgtcttctctcgtccctacgtacgtctcgacaaccgcggtcctccgagacgtactcgtcgtcggtctacgtagtcgtagccggacgtacgtctagtacttacttacgtgccgagttccaactacgttacgtcgtacgttaccgtttgttaccttcgtttaaccaaggttaccgtttacgggtaccggggtacgggtaaccggtacggtaccgggtaccttaccgggtaaccggttcgaccggttaccgacgggtacccgtaacggcccgtacccggttaccccgttcccggg

SEQ ID NO: 8101 - DNA, 635 bp, Homo sapiens
  misc_feature: GYAE6OF02FSCYV.9.71.G05.1.454.CMB.1.raw
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactcggacccaccactgatagttgggcattataaccttgtctcctgtatcaacaacgccagacaacgccccacactacttaattatgagtcactaacgccgcctgtagggttctggtcgtcttctctgcctccaagtctcggacaacgaccgtccctcccgtagacctaactcgtccgtcgggtcctcgtacgttactcgaaccgacggacggtctaggttaactttacgtacgttacgacgtacgtctactaattagtacgtcgttacggtttccgtttaccttttcgtttacgtaaagttacgttacgttaccgggtacgggtacggtaacccggtacggaccgttacgggtacccgttccgttaggacggttaccgaccggaccccggtacggtacccgttcccgtacccccgg

SEQ ID NO: 8102 - DNA, 750 bp, Homo sapiens
  misc_feature: GYAE6OF02JPHI5.9.71.G05.1.454.CMB.1.raw
  modified_base (570)..(570): a, c, t, g, unknown or other
  misc_feature (570)..(570): n is a, c, g, or t
tcagtgatacgtctcacgaccggtgctcgatttagtgtcgtcgcaagagagaggggggtcgacgaagaggcagcgctctcgggacgtctccaccatggcctgggctctgctgctcctcaccctcctcactcaggacacagggtcctgggccctgtctgccctgactcagcctgcctcgtgtcctgggtctccgtggacagtcgatcaccgtatcctccgttgcctacctcggaaccccacctactgattagtcgggactacgttacttaaccttcgtccttccgtggttactccaaacgaaccgcccccaaggaaccaaaacgtcccccaacctacttacctttaaagtttatacggaggttaccaaccggtacggtccggcccttaggtcggggtttcctcggtcgttcttacctcttccggccttaccgtaagttccgtacgggaccaacgggtcccggtccctcccgtacggactaactccgtacgtcgggtacctcggcttaccgtcgaaccgtacggcgtccgtataatttacggtttacacgtccgtgtaccttagacttaacncgggtaccgttaggttttccggttaccctttcgtttaaccggaaaagttcgttaccggggtacggtaccggggttaacgggaccgtcggggttacgtaacccggtcccgtacccgttttaggaacgggcccttaaccgggtaaccccgggaagttccccccgggtaacgttcccccccgg

SEQ ID NO: 8103 - DNA, 636 bp, Homo sapiens
  misc_feature: GYAE6OF02FM8MS.9.71.G05.1.454.CMB.1.raw
  modified_base (296)..(296): a, c, t, g, unknown or other
  misc_feature (296)..(296): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgacctcagcctgcctcgtgtctgggtctcctgacagtcgatcaccatcctctgctactggacccaccactgatagttgggcaattactaaccttgtctcctggtactacaacaacgccagacaaacgccccanactacttaattatgaggtacaagtaacgccgcctcgaacgggtttctggtcgtcttcgtctcgcctaccaagtcgtcggacaaaccgaccggtccctcccgtagtaaccatctcgtacgggccttcgagtctggacgacgagtctagtacttactactgacctacgtctacaattacgtacgtcttaggtttcggttaccctttactttaacgtaaacggtcttaaaggttccgggaaccgggtaacggtaccgtaacgggttctaaccgggttaaccccgttcgtagggtaactaccggaccggtaaccccgtaacggggtacctcccgtacccccggg

SEQ ID NO: 8104 - DNA, 666 bp, Homo sapiens
  misc_feature: GYAE6OF02JD8CK.9.71.G05.1.454.CMB.1.raw
  modified_base (520)..(520): a, c, t, g, unknown or other
  misc_feature (520)..(520): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatcctcctgcactcggaccccaccactgattagttggctattaactaaccttgtctcctggtactacaacaccgccagacaaacgccccacactcttaattatgacggtcactaagccgccctgtacgggtttctggtctcttctctcgcctaccaagtcgtacggtacaaccgtaccggtccctacccgtacgtaacctaacgttcctccggttcgggcccttaccgacgtttccgacggtaccggtacggacgggtacttacgtaagttttaacttaccgtgaccgttacgtacctactaacgttaacncggttacgttacggtttccgtttcccttactttacgtaaacgttcgttacgtttaccgggcgggttaacgggaccggtacggaccgttcggtacccgttcgtacgacgttcgaaccgtccggtaacgtccgttaccccgtccccgg

SEQ ID NO: 8105 - DNA, 575 bp, Homo sapiens
  misc_feature: GYAE6OF02I0B0B.9.71.G05.1.454.CMB.1.raw
  modified_base (199)..(199): a, c, t, g, unknown or other
  misc_feature (199)..(199): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
  modified_base (491)..(491): a, c, t, g, unknown or other
  misc_feature (491)..(491): n is a, c, g, or t
  modified_base (540)..(540): a, c, t, g, unknown or other
  misc_feature (540)..(540): n is a, c, g, or t
tcagtgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctccgtgacngtcatcaccatctcctgccactcggaccccacctacgtgattacgttagggcctaattactaaccgtttgtaccttcctggtactacgaacaaccgtccaagaccaaaacgtcccccacgtactacttttaattactcgaacggtcactaacgcgccctgaggtttcngtcgtcttctctcncctcagtcngcaacgcgtccnctgacatcgcgtggcctcatcganacgtacgngctagaactttagtactcganacgtctctaagtntcgcgttacggttcgttcctttntaacgtactaaagtcgtccgaggtaacggtcgaaggtcacggttacccngtcgtacgacgtccgaccgacgtccgcctccccgg

SEQ ID NO: 8106 - DNA, 593 bp, Homo sapiens
  misc_feature: GYAE6OF02GM7WN.9.71.G05.1.454.CMB.1.raw
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
  modified_base (464)..(464): a, c, t, g, unknown or other
  misc_feature (464)..(464): n is a, c, g, or t
  modified_base (533)..(533): a, c, t, g, unknown or other
  misc_feature (533)..(533): n is a, c, g, or t
  modified_base (563)..(563): a, c, t, g, unknown or other
  misc_feature (563)..(563): n is a, c, g, or t
tcagtgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctcctggacagtcgatcaccatctcctgcactcggacccaccactgacttagtgggctattactaaccttgtctcctgtactacaacacgccagacaacncccanactnttaatangagtcactacgcgcctgtaggttctgtctcttctctcncctcagtctcggcaacnccgtcctccgtgtacgtcgacgacccgaagccgttccgacccccgtcggtacctaccgttccttaccgtaccccctaccccgtctaccgaacgtaccttacnccgtaccgtaggaccgggtcgggtacccgttcgggaaccgtaaacgggcccgtaacgtacgtacggtancgtctacgagcgacgtcgacgtacacgttntacgtacgtacgtacgacgtacgtactacg

SEQ ID NO: 8107 - DNA, 745 bp, Homo sapiens
  misc_feature: GYAE6OF02IBNNW.9.71.G05.1.454.CMB.1.raw
  modified_base (521)..(521): a, c, t, g, unknown or other
  misc_feature (521)..(521): n is a, c, g, or t
  modified_base (539)..(539): a, c, t, g, unknown or other
  misc_feature (539)..(539): n is a, c, g, or t
  modified_base (565)..(565): a, c, t, g, unknown or other
  misc_feature (565)..(565): n is a, c, g, or t
tcagtgatacgtctcacgaccggtgctcgatttagtgtcgtcgcaagagagaggggggggtcgacgaagaggcagcgctctcgggacgtctccaccatggcctgggctctgctgctcctcaccctcctcactcaggacacagggtcctcgggccctggtcctcgccctgactcacgcctgcctccgtgtccgtgggtctccgtggacctgtcgactcaccactctcctcgccacgtcgacccaccactgactagtcggactattactaaccttcgtcctccgttgtactaccaaaccgaccgacccaacgaaccgaaaccctcccccaactaccttaacttttaagtttagcggttaacgtacgaacgttaacggcccgtacccgtacgggttaccgggtttcgtacgggttcctcttacctccgtacgtccctaccgtaacgtcgtacggaacctaccgtaccgtaccctcctacgaactactcgtacgcggtacctcgtactcgtagaccgaggtacgnttaactcttaaacgttcngtaccgacgtctaacgtataggtccncgttttaaccggttcgtttccccgtttataccggttaaaacgttacgtttaccggggttacggggacccgggttaggggtaacccctggggttaaccccgtcggttaacccgtccggtaagtccggtaacccgggaccctaacccgggtacccgtcccggttacccccggttacccccgg

SEQ ID NO: 8108 - DNA, 750 bp, Homo sapiens
  misc_feature: GYAE6OF02FK628.9.71.G05.1.454.CMB.1.raw
tcagtgatacgtctcacgaccggtgctcgatttagtgtcgtcgcaagagagaggggggggggtcacaagaggcagcgctctcgggacgtctccaccatggcctgggctctgctgctcctcaccctcctcactcaggacacagggtcctgggccctgtctgccctgactcagcctgcctccgtgtctgggtctctggacagtcgatcaccatcctcctgccactcggaccccaccactgatagttggctattactaaccttgtcctccgtgtactacaaccaacgacccaagaccaaccgcccccactaccttactttaatttagtagacggtacaacgtaacgccgtcccgtcgtacggggtttctcggttccgtcttcgtctaaacgtcctaccgtacgtcgtacggaccaaccgtacccggtccccttcccgtacggaacttaaccgttaccgttcgtacgggtccctccgtacgtccgtacggtacggaacggtcggtacgtaggttaactttaagttaccgtcggtacctacggtcctacgtattagtacggtacgttaggtttcgggtaccgttaacccgttacccgttcccgggtttaagggttacccgttaccgggggacgggtaaccgggtaaccggtaacgggttacccggtaaccccggttaaccggttaaccggtacccgaaccggtaccccggaacgggttccccgtaccccggttcccccgggttacgttaaccccg

SEQ ID NO: 8109 - DNA, 737 bp, Homo sapiens
  misc_feature: GYAE6OF02IX75D.9.71.G05.1.454.CMB.1.raw
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctcgccctgactcagcctcgcctccgtgtcgtggtctctggactagtcgactcacctactctctcgcactcggaccccacacgtgtatagtggtactattataccttcgtcttccgtggtactacaaacgtaaccgaccctacggaaacctaaccgaccccccactaaccttactttaaactttaacgttaggaaccggtaacgtaacgtaacggtcccgggtaccccttacggtaacggggttttcgtccggttaccggttcctttccgtcgttcctccgttaccgtaaacggtcgtacggtacctaaccgtaaccgggtccctaccgtactaacgtacttaccgtcgtccgggtacctaccgtacgttcgtacgggtaaaccgtaccggtaggtaccgttaacgttacgtttaaactttacgtacgcttaacggtccttactaattccgtagtcggttaacgtttcggttcttaaccgttacgtaacgttacgtacgttacgcgggaacggtccgtacggaccgtcggtacccgtcgtacgtacgtaccacgacccggtacggtccgtacccgtcccgg

SEQ ID NO: 8110 - DNA, 524 bp, Homo sapiens
  misc_feature: GYAE6OF02F3QWT.9.71.G05.1.454.CMB.1.raw
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (446)..(446): a, c, t, g, unknown or other
  misc_feature (446)..(446): n is a, c, g, or t
tcagtgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcacatctctgcactgacccacactgatatggcattataaccttgtctcctggatcaacacgccagacaacgccccacactcttaattactgaggtcacgtaacgcggccctcgacgggtttctggtcncttctctgcctcagtctgcaacncgcctccngcaanctcnggtcncntcngacgagagctgatttatactncngctactatagtcgctagtttcggttccttcgttacaagtnttagtccgggaggtacgggtacgacggtctccggtccgtccgtgtaccgtcgacgtacccgacgtcctcccgtccccg

SEQ ID NO: 8111 - DNA, 758 bp, Homo sapiens
  misc_feature: GYAE6OF02GNTEC.9.71.G05.1.454.CMB.1.raw
  modified_base (216)..(216): a, c, t, g, unknown or other
  misc_feature (216)..(216): n is a, c, g, or t
  modified_base (402)..(402): a, c, t, g, unknown or other
  misc_feature (402)..(402): n is a, c, g, or t
  modified_base (523)..(523): a, c, t, g, unknown or other
  misc_feature (523)..(523): n is a, c, g, or t
tcagtgatacgtctcacgaccggtgctcgatttagtgtcgtcgcaagagagagggggggggtcacaagaggcagcgctctcggaacgtctccaccatggcctgggctctgctgctcctcaccctcctcactcgagggcacgagggtcctggacccagtctgccctgactcaacctgcctccgtgtctcgggtctccgtggactagtcgactcaccntctccgtgcactggaaccagctagtcgactattacggtattaactatcggtcttccgtggttaaccaaacaaccgtaccccgacaaacgaccccctaaactcttcgtactttatgatcgtctaagttctccggccctgtaggtacgtttctgtacttcgtcgttctcgtcgtactcctaagttccnggtaccaccggtaccggtccctccgtacgtacctacgttcgtcgtccgggtacctacgtcggtaccgttcggaaaccggtccgggaaacggtcccgttaagtacgtttagtttacccggtntacccgtaaaggtaccttaaaacgggaaaaacgttaaaccgtccggttacccgtttccggtttacggggtttacccggggtttttacgggggaacccggggtacgttaaaccggggtcggtaacccggtagttacccggtaggaacccggtaaccccggagggttcccctaccgggtcccccgtacgggtccgttacccttcccgtttacccgggttcccctacccgttaccccg

SEQ ID NO: 8112 - DNA, 716 bp, Homo sapiens
  misc_feature: GYAE6OF02F1UG7.9.71.G05.1.454.CMB.1.raw
  modified_base (285)..(285): a, c, t, g, unknown or other
  misc_feature (285)..(285): n is a, c, g, or t
tcagtgatacgtctcacgaccggtgctcgatttagtgtcgtcgcaagagagagggggggggtcacaaagaggcagcgctctcgggacgtctccaccatggcctgggctctgctgctcctcaccctctcactcaggacacgaggtcctggccctgtctgaccctgactcagcctcgcctcgtgtcgtggtctccgtggactacgtcgatccacctatcctcctgcctacgtacggaccccacctactagattacgtaggctagttactaaccttgtctctagtacncaaccacgaccagaccaaccgccctacaccttataacttatacgacgtctaacgacgaccgaccgttcggtagggtttcgtcggttccgtcttaccgttctaccgtccctcctaacggttctaaccggtcaaccgtccggtaccctacgtcaacctaacgttcgtcgcgtccgtacctggtacttcgacggacgtcggtaacttcttaattacgtacgtacggtcctaacgccgtttaacttcgtaagttcgtaaccgtcggtttttaaccgttcgttaccctttaaagaacggtttacttaccggggtacggttaccgggaaacggttacccgtacggggtaaccttacccggtacccgggtttacgttaccggagttaccccggaccgtaaccccggtaccggttcccggtacccccggttacccccgg

SEQ ID NO: 8113 - DNA, 792 bp, Homo sapiens
  misc_feature: GYAE6OF02HJJOZ.9.71.G05.1.454.CMB.1.raw
  modified_base (152)..(152): a, c, t, g, unknown or other
  misc_feature (152)..(152): n is a, c, g, or t
  modified_base (215)..(215): a, c, t, g, unknown or other
  misc_feature (215)..(215): n is a, c, g, or t
  modified_base (787)..(787): a, c, t, g, unknown or other
  misc_feature (787)..(787): n is a, c, g, or t
tcagtgatacgtctcacgaccggtgctcgatttagtgtcgtcgcaagagagagggggccctgtctgccctgactcagcctgcctccgtgtctgggtctcctggacagtcgatcaccatctcctgcactcggacccaccactgatagttgggntattataacttgtctcctggtatcaacaacgccagacaaacgccccacactacttaatttacngacggtacacgtaacggccggtacctcgtaggggtttcgtcggtcgtacttctctcgacctccgtaacgttctacggacaaccgaccggtcccttaccctgtaaccaattcctcgtcgggacctccgagtcgtacggaacgacggtacggtactagtaactttaacttcgttacggactacgtacttaccgtaattacgtacgtacgttagggttttcccgttttacgtttacgttttaacgaaacgttaacgtttaccgggtttaccggggaccgggggaaacgggttaacccgggtcgggtaccggttaacccggtacccggtttacccggtaggtaaccgttaccggaaccgggtacccggtaacgggcccgttaaccccggtccccgtttccggtaccgttacccgttcccgtttaccccgtttcccccctaacccgtttcccgtacgtaacccggtttaacgtaccgttacccgttaacgcggggtaccggtaccgggtcggtacggaccgggtaaccgggctaccgtaagttacggcgacgttcgacgttacgactacggtacgtnatcga

SEQ ID NO: 8114 - DNA, 736 bp, Homo sapiens
  misc_feature: GYAE6OF02HJHVU.9.71.G05.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (596)..(596): a, c, t, g, unknown or other
  misc_feature (596)..(596): n is a, c, g, or t
tcagtgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtcgtgggtctcctggacagtcgatcacatctctcncactcggacccnccactgatattcgggactattacttaacgttgtccttcgtggtaactcaactaaccgccaacgacaaaaccgccccaacgtacctaccgtttaatttacgtcggtaacgtccgaacgtaacggtccggacccgttaccggtaacggggttttacctcgggttaccgttcttccgtttcgtaccggttccctaccgtaacgtttccgtacgggtacctaaaacggtccccgggtacccttacccgtaacggtaaccttaacgttacccgttaccgttcgggtacccgtttacccgtacggttaacccgtacgggtaacccggaaccgggtaacgtccgtagttaactttacgtaacgttcgacgtactacncgtaaactgtacgtctacggtttcgttccttacgtttacgaaagttctacgttacgggaccggaagggtcgcgggtacctcgggaccctcggtacgtcgttaccgaccgtacccgtacggtaccgtcccgtaaccccggg

SEQ ID NO: 8115 - DNA, 624 bp, Homo sapiens
  misc_feature: GYAE6OF01AUOJ6.10.87.H10.1.454.CMB.1.raw
tcagcatagtagtgcacgaccggtgctcgatttagcagtactgcgttgggtttgggggaggagcccagcactagaagtcggcggtgtttccattcggtgatcagcagtgaacacaaaggactcaccatggagtttgggctgagctgggttttcctggtggctcttttaggaggtgattcatggagaaatagagagactgagtgtgcccagtgtcaagtgcagctggtggagtcgtgggggagcgtggtccaggccgtgggggtccctgagactctcctgtgcacgcctcgtggattcgtacttcgaatgtcgtggcatgcgacgtcgggtccgccgacggcctaccgaaacggaggggcgtgggaggtgggtggcgtagtttctttcgtagtttagaagtaagaaaaggtattaagttagtacgcgtaccgtcgtaggaacgggccgtatacgacgactactcctacgagacgactaccttaccgaacggtacccgtacggtacgttacgtcgtacgactaacgtcgaaccgacgtaccgtaaggaagtaacggtacggaacggaaccgtacggtacttaacgttacgttaacgttaggttacggtcggtaacggtaaacccgg

SEQ ID NO: 8116 - DNA, 1000 bp, Homo sapiens
  misc_feature: GYAE6OF01CYSQE.10.87.H10.1.454.CMB.1.raw
tcagcatagtagtgcacgaccggtgctcgatttagcagtactgcggttgggtttgggggaggagcccagcactagaagtcggcggtgttccattcggtgatcagcagtgaacacaaaggactcaccatggagtttggctgagtcttgggttttcctggtggcttcgtttttagggaggttgatttcgagtggaagaaatagagagtactgagtgtcgaccagtgtacaagtgcagtcgtggtggagtcggtgggggacgtcggtcggtccgacggtccggtcggggggttcccgttaggacggaccttccgtccgttcggtacgccgtaccggtccgttacgtacgggttactttaccggtaaccgtttacggtaaacgtttcggttacgttcgggtacgtacggttcggtaccgtaccggttccggggtaccccgaccggtaaccgggtacccgttaacccgggaaacggggtaaacgggggtaccggttagggggtaacggggttcggggtacgggtaccgtttaacggtttttacccggttttacgttaagggttttaaggtaaaaggtttaaaaacgggtaaaaaaaggggttaacttttaaacggtttaacgggttaacccgggttaaccccggttaaaccccgggtttaaccggggtaacggggttaaaaccgggggtacccgtttaaacggttaccgtaacggtacccgttaaaccggttacccgtaaccggtaacggtaacccgttaaccgtttaacccggtttaacccgggaaccgggttacccggttaaggggtttaaccgttaaccgttccggtaagtaaccccgttaaagtaccggtaaaccccgtaacgggttaccggtaaacgggaaacggttaaacgggtaaccgggaaacggttacccggaaccggggttaaccttaaacgggttttacgttaaaaccggtttcgggtttaacggtaccgggtaaacccggttaaaccccccgg

SEQ ID NO: 8117 - DNA, 699 bp, Homo sapiens
  misc_feature: GYAE6OF01E5AKU.10.87.H10.1.454.CMB.1.raw
tcagcatagtagtgcacgaccggtgctcgatttagcagtactgcgttgggtttgggggaggagcccagcactagaagtcggcggtgtttccattcggtgatcagcagtgaacacaaaggactcaccatggagtttgggctgagctgggttttcctggtggctcttttaggaggtgattcatggagaaatagagagactgagtgtgcccagtgtcaagtgcagctggtggagtcgtgggggagcgtggtccaggccgtgggggtccctgacgtactctccgtgtgcagcctcgtgtacttcgacttcgaaatgtctggcagtcgctacgtcgggtcccgccgacggcctaccgaaacgggaggggcgtggggaggtggggtcggcgtagtttctttacgtattttaggaagtaaaggtaaaaaacgggtattaagttagtacggtaccgtaacccgttccgggtaggaaacggggaccctagttaccgacggtcctaactccgtaccgaagtacgtaaccttacgtttacccgaacggtacccgtaacgggttacgttaacgtccgtagtaacctaaaacgtccggaaacccacggtacccgtaagggaacggtaacgggttaggaacgggtaacccggtacggtaccttaagttcggttaaacttacggtttcgggtacggaacccggttaaacccggg

SEQ ID NO: 8118 - DNA, 766 bp, Homo sapiens
  misc_feature: GYAE6OF01DOJNE.10.87.H10.1.454.CMB.1.raw
  modified_base (336)..(336): a, c, t, g, unknown or other
  misc_feature (336)..(336): n is a, c, g, or t
tcagcatagtagtgcacgaccggtgctcgatttagcagtactgcgttgggtttgggggaggagcccagcactagaagtcggcggtgtttccattcggtgatcagcagtgaacacaaaggactcaccatggagtttgggctgagctgggttttcctggtggctcgttttaggaggtgattcatggagaaatgagagactgagtgtgcccagtgtcaagtgcagcgtggtggagtcgtggggggagcgtggtccaggccgtcgggggtccctggagacctctccgtgtcgcacgcctcgtggattccgacgttacgaaattcgtcgtaggcctagtcncgacgttcgggtcccgaccgtacggcctaccgaacggtaacgggggcgttacgggtagggtcgggggtggtccgttacgttttccgtttacgtagttttacggtaaagtaaaagggtaaaaaaacggggttaattaaagttttaacgtacgggtacccggttaaccccgttaccggggttaggtaaaccgggggtacccgttaacttaccggacggtacctacgttcccgtaccgtaacggtacgtaaccttacgtttaacccggaaggtccccggtaacgggtttagttacgtacccgtaggtaacctaacgttacgaacccgaggtcccgtaagggaacggttaacggtagggtaacggtaacccgaaccgggttactacggttacgtttaacgttagttacgggtacgtaccgggttaaaaccccgg

SEQ ID NO: 8119 - DNA, 851 bp, Homo sapiens
  misc_feature: GYAE6OF01BHNNR.10.87.H10.1.454.CMB.1.raw
  modified_base (158)..(158): a, c, t, g, unknown or other
  misc_feature (158)..(158): n is a, c, g, or t
tcagcatagtagtgcacgaccggtgctcgatttagcagtactgcggttgggtttgggggaggagcccagcactagaagtcggcggtgtttccattcggtgatcagcagtgaacacaaaggctcaccatgggagtttgggctgagtcgttgggtttccnggtcggtcttcgttttagggaggtgattcgagtggaagaaataggagagactggagtgtcgcctaggtcgacgaagtgcaggtcgtggggtaggacggtcgggtaggggggaggtcggttacggtccgacgggtccgggttcggggggtccctaggtacggtccctcgtacgtcggtacgccgacgtccgttacggtaggttaccgttaccgtaacgtttacgtaacgttcggtcgtcggtacgtagtcggtaccgtcgggtcccgggtcccaccggtacggtacccgtaaccggggaaacgggtacgggggtccgtaggggtacggggttcggggtacggtaccggtttagtttacccgtttagtaacgtttaaggaaaaggttaaaacgggtaaaaagggttaacttagttaacggtcggttaaccccggtaacccgggttacggttaacggggaacccggttaccggtacgtttaacgacccgtccgttaacgtcccggtaaaccgtaggtaacccggttataacccggtccggtaaaccggaccgggttacggttacgtaacttcggaacgaaccgtaactccggaccgtacgtacgtaaggggaaacggtacgtcgggaaaccggtcggaccgttaggttaagtcggttacttagggttacccggacgggttaacccttaaccccggg

SEQ ID NO: 8120 - DNA, 515 bp, Homo sapiens
  misc_feature: GYAE6OF02GFY14.10.87.H10.1.454.CMB.1.raw
  modified_base (392)..(392): a, c, t, g, unknown or other
  misc_feature (392)..(392): n is a, c, g, or t
tcagcatagtagtgcacgaccggtgctcgatttagcagtactgcgttgggtttgggggaggagcccagcactagaagtcggcggtgtttccattcggtgatcagcagtgaacacaaaggactcaccatggagtttgggctgagctgggttttcctggtggctcttttaggaggtgattcatggagaaatagagagactgagtgtgcccagtgtcaagtgcagctggtggagtctgggggaggcgtggtccagccgtggggggtccctgagactctcctgtgcagcctctggattcgacttcgaaatgtctggcatgcactgggtccgccaggcctccaacgaaggggctggagtggggtggcagttcttcatttgatagaaaagggatatangcgactcgtgaagggccgattcagcatctcagacgactagtttccaaggccacggtgtatcgtgacaaatgaccagcctagagaagtgacggacacggctatgtactagttgtagcgtaacgg

SEQ ID NO: 8121 - DNA, 130 bp, Homo sapiens
  misc_feature: GYAE6OF02INFTP.10.87.H10.1.454.CMB.1.raw
  modified_base (130)..(130): a, c, t, g, unknown or other
  misc_feature (130)..(130): n is a, c, g, or t
tcagcatagtagtgcacgaccggtgctcgatttagcagtactgcgttgggtttgggcacagcggccctgggctgcctggtcaaggactacttcccactactatgctgagcgggctggcaaggcgcatagn

SEQ ID NO: 8122 - DNA, 575 bp, Homo sapiens
  misc_feature: GYAE6OF02I8O7H.10.87.H10.1.454.CMB.1.raw
  modified_base (333)..(333): a, c, t, g, unknown or other
  misc_feature (333)..(333): n is a, c, g, or t
tcagcatagtagtgcacgaccggtgctcgatttagcagtactgcgttgggtttgggggaggagcccagcactagaagtcggcggtgtttccattcggtgatcagcagtgaacacaaaggactcaccatggagtttgggctgagctgggttttcctggtggctcttttaggaggtgattcatggagaaatagagagactgagtgtgcccagtgtcaagtgcagctggtggagtcgtgggggaggcgtggtccaggccgtgggggtccctgagactctcctgtgcagcctctggattcggacttcgaaatgtctggcatgctacgtcgggtcccnccgaggctccaaacggaaggggctgggagtggggtcggcgtagttctttctatttgaatagaaaaagggtatagttatcgacgtaccgtcgaggaacgggccattacgagactaatccacagagtaccatttaccgaaggtccacggtgtatctacgacaaactgaacccagacccgtagaaggtaaggtcgaacggtaccacggtacttagtgtacctagttcgtaggtacggtaacccgg

SEQ ID NO: 8123 - DNA, 784 bp, Homo sapiens
  misc_feature: GYAE6OF02GJUB5.10.87.H10.1.454.CMB.1.raw
tcagcatagtagtgcacgaccggtgctcgatttagcagtactgcgttggggtttgggggaggagcccagcactagaagtcggcggtgtttccattcggtgatcagcagtgaacacaaaggactcaccatggagtttgggctgagcgttggttttcctggtgcttcgttttaggaggtgattcagtggaagaaatagagagactgagtgtcgcccagtgtacaagtcgcagcgtgggtggacggtcgggtgggggaggtccggtcggtccgacggccgggttcgggggtccctggacgtacctccgttccgttggcgaccgtcgtccttcggtaggtcgtttacgtaccgttaacgtaagttcgtcgtcggtcagtcgcgtaccggtcggcccgacgcgtacctaccggaagggacgggcgtagggtaggtgggtcgtacttacggtttcttagtagtttagaaagtaaaggtaaaaaggtactttagtacgtaccgtaaccggtaccgtaacgggtcgggtaaaccgggtccctaacttacccgaaccgttacgttacccggtaaccccggaacgggtaacccaaaccgtaaccccgaaagtaacccgttcgtacgttacccgggttaactttacggaaaccgttaaacgaacccgtaacccgtaacccgtcggaccggtacccgggaacggaccggtaaccggtccccggttaaagtaacgttacgtacggtacggcgtaaaccgtaaccggttaacccgttacccggttaccgtttaccggg

SEQ ID NO: 8124 - DNA, 773 bp, Homo sapiens
  misc_feature: GYAE6OF02HJ6YC.10.87.H10.1.454.CMB.1.raw
tcagcatagtagtgcacgaccggtgctcgatttagcagtactgcgttgggtttgggggaggagcccagcactagaagtcggcgtgtttccattcggtgatcagcagtgaacaacaaaggactcaccatggagtttggctgagtcttggttttcctggtcggtcttacttttagggaggtgtattcagtggaagaaataggagagactagacgtggtcgcccagtgtacgaagtgcaggcgtgggtacggtaggtccgggtggggggtacggcggttacggttccgacggtccgggttcgggggtccctaggacgtacgtcctccgtgtcgtcgtacgtcctcgtggtacttacggtacctttaacgaacttcgtacggtcggtctacgttcgccgtacgggtccggtacccggaccggtacggtaccccgtacccggaaaacgggtaccgggggttagtacggggtacggggttcgggtacggcggtttacggtttctttacgtacgtttagtaaacggtaaaaggtaaaaaggtacgtttaataaggtaccggtacgttacccgtacggtaacggtacgggtacctacttaacgggactcctaacgtaccgtacgaagtacctaaacgtaccgttaacgaccgtacgtacggttcttaacgtcgtactaaaccgtactaccggtactaccgtacgtagtaaccgggtaagcggtaaacgcggtacgtacttaacgtacggtaactttaggtacgtacggtaccggttaaccg

SEQ ID NO: 8125 - DNA, 935 bp, Homo sapiens
  misc_feature: GYAE6OF02IU590.10.87.H10.1.454.CMB.1.raw
  modified_base (155)..(155): a, c, t, g, unknown or other
  misc_feature (155)..(155): n is a, c, g, or t
  modified_base (221)..(221): a, c, t, g, unknown or other
  misc_feature (221)..(221): n is a, c, g, or t
tcagcatagtagtgcacgaccggtgctcgatttagcagtactgcgttgggtttgggggaggagcccagcactagaagtcggcggtgtttccattcggtgatcagcagtgaacacaaaggactcaccatggagtttgggctgagctgggttttccnggtggctcgttttaggaggtgattcatggaagaatagagagactgagtgtgcccagtgtacaagtncagtcgtggtggagtcggtgggggaggtcggtggtccgacgggcccgggttcgggggggtccctggaacgtaccttccgttcccgtggtacgccgtacggtcccttcggtacggtacgtttccgtaacctttacggtaaaattcggtcgtacggctagtcgaccgtacggttaccggggtcccaccggtaacggtacccgttaaccgggaaaccggggtaacgggggtaccggttacgggggtaggggtttcgggggtaccgtacggtttacggtttttaccgttttacgttaacgtttttaggaaaaaggttaaaacgggttaaaaaaacgggttaatttaaacggtttaacggtaccggtaaccccgggtttaaacccggttcccggggttaaaacggggtaaaccggggtacccgttaaccgtttaccgggtaacggtacccgttaaaccttccccggttaaccgggaacggttaaaccgttaaccggtttaacccgtttaaaccggtaaccgggtaacccggttaacggtttaacggttaccgtaaccggttaacgtaaaacctaacggtacccgtaaccgaccggtacccgttaaggggtaacggtaaacgggtacggtaaacgggtaacccggttacggtttaacccgttaaggttacgttttaaaccggttacgtttacgggtaacggtacccggtttaaaccccgg

SEQ ID NO: 8126 - DNA, 514 bp, Homo sapiens
  misc_feature: GYAE6OF01ER62I.25.22.B11.1.454.CMB.1.raw
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaatcatcatttatgatgtcagtcatcggccctntggagtttcnggtcgcttctctggctccaagtctggcaactcggcctcctgaccatctcgggctccaggctgaggacgaggctacttattattgctatttcattaacagagacaccaacagtctggtgttcggcggagggaccaagttcgaccgtccgtcggtcagcccaaggcctcgcccctgtcactctcgtcccc

SEQ ID NO: 8127 - DNA, 171 bp, Homo sapiens
  misc_feature: GYAE6OF01AQX5P.25.22.B11.1.454.CMB.1.raw
  modified_base (170)..(171): a, c, t, g, unknown or other
  misc_feature (170)..(171): n is a, c, g, or t
tcagactgtacagtcacgaccggtgctcgatttagacgacagctcagggcccatcggtcttcccctggcgccctgctccaggagcacctccgagagcacagcggccctgggctgcctggtcaaggactacttccactgtacagtctgagcgggctggcaaggcgcatagnn

SEQ ID NO: 8128 - DNA, 537 bp, Homo sapiens
  misc_feature: GYAE6OF01BM31V.25.22.B11.1.454.CMB.1.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagcccgtgactatttgggtgctttaataactatgtctcctggtcccaacaacaccaggcaacggccccaaactcatcatttatgatgtcagtcatccggccctctggtagtttctggtcgtcttctctggctcagtctggcactcgcctcctgacatctcgggctcgaggctgaggacgagctattattattgctatttcattacagtacgacaccaactagtctggtgtcggacggaggacctaggttcgaccgttcgtcggtcacgcccgaaggctccggtccccttcggacctaccgtccgttccgttacccc

SEQ ID NO: 8129 - DNA, 539 bp, Homo sapiens
  misc_feature: GYAE6OF01CGUGN.25.22.B11.1.454.CMB.1.raw
  modified_base (432)..(432): a, c, t, g, unknown or other
  misc_feature (432)..(432): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtcccaacaacacccaggcaaggcccccaaactcatcatttatgatgtcagtcatcggccctctggagtttctggtcgcttctctggctccaagtctggcaactcgcctcctgaccatcgtcgggctccgagctggacggacgaggtcttacttattattgactattcaatacaganaccaaccaactagtcgtggtgttcggacggacggacgtagtcgaccgtcgtcggtcacgcccgaaggcctccgcccccgttcggtacctacgtccgtcgttcccccg

SEQ ID NO: 8130 - DNA, 521 bp, Homo sapiens
  misc_feature: GYAE6OF01ENSNH.25.22.B11.1.454.CMB.1.raw
  modified_base (236)..(236): a, c, t, g, unknown or other
  misc_feature (236)..(236): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (434)..(434): a, c, t, g, unknown or other
  misc_feature (434)..(434): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctccttcactggaaccagccgtgacattggtncttataactatgtctctggtcccaacaacaccagcaaggccccaaatcatcatttangatgtcagtcatcggcctntggatttctggtcgcttctctggctcaagtctggcaactcggcctccctgaccatctcggggctccaggctgaggacgaggctaacttattattgctagtttcattacagacgacaaccaanagtctgggtcgttcggcggaggaccagttcgacccgtctcggtcagcccgaagcctcgcccccgtggccatcctcgtcccctacccg

SEQ ID NO: 8131 - DNA, 1008 bp, Homo sapiens
  misc_feature: GYAE6OF01EFZBJ.25.22.B11.1.454.CMB.1.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtgtctttaataacttagttcgttccttcccttcgggttaccccaaaacaaacccaaccccgaagggaccaaaaccgggacccccccaaaaaccttccaacttcctaatttttaactgtaacttggttaccaacggttccaacgttcccgggccccctttcgttcggggttacgtttttccgtcggggttccgtccttttccgttccgtttcggggtccctttacccgtaaaggtttcccgttacggggtaccctaaaccggtttccccggggtacccctttcccccggttacggtaaccccgttaacgtttcccgggttcccggggggtacccctttccccggaacggggtcccgtttagggaacggggtaccggaacgggttacccgtttaacgtttttaacgttttaacgtttcggtacctttaacgttttttaccgaaacgttttaacccgaacgggttaaaccggaaaccctaaaccccgtaaaaccggttaacgggtttacccggttttaaccgggggtttacgggtttaccccggggggtaaccgggggttaaacccgggggtaaacccgttaaaccggggttttaccggtaaaccccccggggtttacccgggttacccggggttttaacccggaaccccgggtacccccccggtaaaacgggggttcccccgtttaacccccggggtcccccccccggtttacccggggttaccccttaacccccggttttcccggtttccccgggttttaaccccccccccgg

SEQ ID NO: 8132 - DNA, 509 bp, Homo sapiens
  misc_feature: GYAE6OF01DRPJ7.25.22.B11.1.454.CMB.1.raw
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaactcatcatttatgatgtcagtcatcggccctctggatttctggtcgcttctctggctccaagtctggcaactcggcctcctgaccatctcgggctccgaggctgaggacgaggctacttattattgctatttcatacagagaacacaacagtctggtgttcggcgagggaccagttcgaccgtcgtcggtcagcccaaggctcgcccctgtcactctcgtcccc

SEQ ID NO: 8133 - DNA, 546 bp, Homo sapiens
  misc_feature: GYAE6OF01CO4JI.25.22.B11.1.454.CMB.1.raw
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
  modified_base (440)..(440): a, c, t, g, unknown or other
  misc_feature (440)..(440): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctctgcactggaaccagccgtgacattggtnctttaataactatgtctctggtccaanaacaccagcaacgccccaaatcatcatttatgatgtcagtcatccggcctcgtggtacgtttctcgggtctctttctcgtggtctccaagtctggctaacgtcggcctccctgaccagtcgtcgggctccgaggctggacggtacgaggtcctattattattgctatttcatacaganacaacacagtctaggtcgttcggacgggacggactaagttcgaaccgtctcgggtcacggtcccaaggtcctcgtcccccgtggtaccacttctccggttcccccg

SEQ ID NO: 8134 - DNA, 593 bp, Homo sapiens
  misc_feature: GYAE6OF01DDV4H.25.22.B11.1.454.CMB.1.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
  modified_base (294)..(294): a, c, t, g, unknown or other
  misc_feature (294)..(294): n is a, c, g, or t
  modified_base (370)..(370): a, c, t, g, unknown or other
  misc_feature (370)..(370): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcggtcaccntctcctgcactggaaccngccgtgacagttggtgcttataactntgtctctggtcccaacaacaccagacacgccccaaatcatcatttangatgtcagtcatccggcctcgtggtagtttcgtggtcgtcttctctggctcagtctggcacgtcgcctcctgaccntcgtcgggctcgaggtctgaggtacgacggtactacttattacttgtactactttacatacagacgtacaaccaacgtcgttacgtgggttcgtttccgggcgggaacgggtacctaaggttcggaacccgtttccgtacgggtaccgaacggtccccgaacgggtccctaccgggtccccccgttacggtacccctaccgttccgttcccgtttaccccccg

SEQ ID NO: 8135 - DNA, 690 bp, Homo sapiens
  misc_feature: GYAE6OF01EU12Y.25.22.B11.1.454.CMB.1.raw
  modified_base (125)..(125): a, c, t, g, unknown or other
  misc_feature (125)..(125): n is a, c, g, or t
  modified_base (128)..(128): a, c, t, g, unknown or other
  misc_feature (128)..(128): n is a, c, g, or t
  modified_base (131)..(131): a, c, t, g, unknown or other
  misc_feature (131)..(131): n is a, c, g, or t
  modified_base (135)..(135): a, c, t, g, unknown or other
  misc_feature (135)..(135): n is a, c, g, or t
  modified_base (232)..(232): a, c, t, g, unknown or other
  misc_feature (232)..(232): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (327)..(327): a, c, t, g, unknown or other
  misc_feature (327)..(327): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactnagntcnggcnggggccaggctaggcctgactacgagctgcctcgtgtctggactctggacagtcggtcaccatctcctgcactggaaccagccgtgacatttggganctttataactatgtctcctggtacccaacaacacccaggcaaggccccccaaatcaatcatttagngatgtnagcagtccgcctgtggtcttcgnggtctcttctcgtgacctacgtagtcgtacgactacgtccgcccttccgtacgacctagtccgggtccgggccttaccggacggtcgtagggaacgggtaaccggacggttacctttaaactttaagtttagttacgtactttaactttacaacgttaacacgtaacgaaccaaaccctaacgtacgttacggttagggttccgggttaccggggaaccgggtaacgggtaacgttaaacgggtttacccgaacccggttccggttacggggtacccaacccgggtaacccggacgggtccccgttaccccggtccccccggtttacggtacccgtccgtttaccccgtccccgttacccccg

SEQ ID NO: 8136 - DNA, 519 bp, Homo sapiens
  misc_feature: GYAE6OF01DIWX2.25.22.B11.1.454.CMB.1.raw
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
tcagactgtacagtcacgaccggtgctcgatttagacgacagctcaggggggggtctcaggaggcagcgctctcgggacgtctccaccatggcctggctctgctgttcctcaccctcctcactcagggcacagggtcctgggcccagtctgccctgactcagcctgcctccgtgtctgggctcctggacagtcggtcaccatctcctgcacgtggaaccagccgtgacattggntcttaataactatgtctcctggtcccaacaacaccaggacaacggccccaaatcatcatttangatgtcagtcatcggcctcgtggtagtttcgtcggtcgtcttctctggctccgaagtctggaccaacgtcggccctccgtacgtacatccgtcgggcctcgacggctaggacggtacgaagtctaacttatattgctattacatacaganacacangtgngtgtcgngaggactagtgacgctcgtncgtccacgcnccgccctcncgtactgtcgtccccg

SEQ ID NO: 8137 - DNA, 186 bp, Homo sapiens
  misc_feature: GYAE6OF01C5UEA.25.22.B11.1.454.CMB.1.raw
  modified_base (172)..(186): a, c, t, g, unknown or other
  misc_feature (172)..(186): n is a, c, g, or t
tcagactgtacagtcacgaccggtgctcgatttagacgacagctcagggcccatcggtcttccccctggcgccctgctccaggagcacctccgagacgcacagcggccctgggctgcctggtcaaggactacttccactgtacagtctgagcgggctggcaaggcgcatagnnnnnnnnnnnnnnn

SEQ ID NO: 8138 - DNA, 744 bp, Homo sapiens
  misc_feature: GYAE6OF01DZG5M.25.22.B11.1.454.CMB.1.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (293)..(293): a, c, t, g, unknown or other
  misc_feature (293)..(293): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacgagggtcctgggcccagtctgcctgactcagcctgcctccgtgtctggactctggacagtcgtcaccntctcctgcactggaaccagccgtagactattcggtncttaataactntgtctcctgtccaacacaccgagcacgaccccaatcatcatttangtatgtcagtcactcggaccctcgtggtactttcgtggtcgtcctttctcgtcggacttccgtaaacgtcgttcgggacctaacgttccgggcccttcccgttacggaccctacggttccggtccggggtctacccggtaacgggtcgtacgggaacggtaaccggaacgggttccttaacgttttaatttaacgttggtacccttaagttttacctaacgtttaacgaacggaacgtaaccctaacccgaaacgtacggtttacccgttaggggttaccggtttaccggggaaccgggtaacgggaacccgttaaacggtttaccggtaaccccggtttcccggttaccgggttaccgaacccggtaccccggtaaacgggttcccgtaccccgggtacccccgttaccgggttaaccctccgtttcccggttccccggtttaccccccg

SEQ ID NO: 8139 - DNA, 554 bp, Homo sapiens
  misc_feature: GYAE6OF01CLAB1.25.22.B11.1.454.CMB.1.raw
  modified_base (139)..(139): a, c, t, g, unknown or other
  misc_feature (139)..(139): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (415)..(415): a, c, t, g, unknown or other
  misc_feature (415)..(415): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcaggcacagggtccngggcccaggtctggccctgactcgagcctgcctccgtgtctgggactcctggacagtcggtcaccatctcctgcactggaaccngccgtgacattggncttataactatgtctctggtaccaacaaccaccaggcaacggaccccaaatcatcatttatgatgcagtcatcggcctgtgtattctggtctcttctctgctcagtctgactacgtcgcctacctgacctatcgtcgggctcgacggctaggaggacgaggaccttattacttaagtnactatttcatacaagacaacacaactacgtgttggttacgtacggcggaagggaacctaggtcgtaccgtccgtacggtacacggcccgaagtcctaccggtccccgttacggtcctaccgtccgttccgttcccccgg

SEQ ID NO: 8140 - DNA, 579 bp, Homo sapiens
  misc_feature: GYAE6OF01B0QX7.25.22.B11.1.454.CMB.1.raw
  modified_base (221)..(221): a, c, t, g, unknown or other
  misc_feature (221)..(221): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacagttggtgctttaataactatgtctcctcggtacccaacaacacccaggccaacggaccccctaaacttactctatttatgacggccaactaaggccggccctcgaggtacgtttctaatcgtcttctctggctcaagtctggcagcacggcctcctgacaactctcgtgggcctccgaggtctaggacggacgaggctagtatttatactgtctactctatagtacgacactactacaactaactcccgtcttaccggacctcgggaccgtggtaccaccggtccgtcgggtcaccggcccaacggccccaaacccgtactcgtacctaccgttccgttccgtcccccg

SEQ ID NO: 8141 - DNA, 621 bp, Homo sapiens
  misc_feature: GYAE6OF01EQ1H9.25.22.B11.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (326)..(326): a, c, t, g, unknown or other
  misc_feature (326)..(326): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactagttggtncttaataactatcgtctcctcggtacccaacaaccacccaggcaaacggcccccaaactcatcatttatgatgtcagtcatccgcctntggtactttctggtcgcttctcgtgctcgagtctcggacacgtccgcctccctgacctagtccgtacgggcctccgaggtctaggacggacgaggtcttaattattagttcgcttatttcaattacgagaacgaccaaccgtaacgtgttaccgtagggttacgttccgggacgggtaacgggtaactaacggttccgtaacccggttcccgtacggttacgacccgtcccggaaacggtcccctacccggtcccccgttcggtaccctaccgttcccgttcccggttccccccg

SEQ ID NO: 8142 - DNA, 775 bp, Homo sapiens
  misc_feature: GYAE6OF01DYURK.25.22.B11.1.454.CMB.1.raw
  modified_base (368)..(368): a, c, t, g, unknown or other
  misc_feature (368)..(368): n is a, c, g, or t
tcagactgtacagtcacgaccggtgctcgatttagacgacagctcagggaccctccaggcttgacgaagcctcccccagagttcccaggagtttccattcggtgatcagcactgaacacagaggactcaccatggagtttggctgagcttgggttttccttgttgctcttttaagaggtgtccagtgtcaggtgcagctggtggagtcgtgggggagcgtggtccagccgtgggaacgtccctgacgactctccgtgtgcaacatcgtggattccgccttcagttaactttggctactccacgttcgggtcccgccgacggcctaccgaggccgaaagggactaggaggtgggtgttacgtttttagngggctagtgagtgggactaggtagaataaacggccttaagtcgacgtaacggtacccgttcccgggtacgaaccggggtcccgtaccgtttccgtacccttacttcccgtacccgtaaacggaaccggaacccgaaaccggaacccgaaaacggtaaaccggttaacccgggttttacccttttaacggaaacctaaaagttaacgtaaaaacggtcccgtaacgggaacccgggaacccccgggaaacgggaacccgtaaccgggtaccgtttaaacggtacggtttaacgtttaaccgttaggtacggtaaccggtaacggaaccggtacccggtaaaggtacgggtaaaggtacgggtacgggaccggttagggtccggggtccggtacggggttaacccgggg

SEQ ID NO: 8143 - DNA, 604 bp, Homo sapiens
  misc_feature: GYAE6OF01D1O7B.25.22.B11.1.454.CMB.1.raw
  modified_base (177)..(177): a, c, t, g, unknown or other
  misc_feature (177)..(177): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (395)..(395): a, c, t, g, unknown or other
  misc_feature (395)..(395): n is a, c, g, or t
  modified_base (444)..(444): a, c, t, g, unknown or other
  misc_feature (444)..(444): n is a, c, g, or t
tcagactgtacagtcacgaccggtgctcgatttagacgacagctcgaggggggggttcgtcaggaggcagcgctcgtcgggacgtctccaccatggcctgggctctgctgttcctcaccctcctcactcaggcacacgggtcctggcccagtctgccctgactcagcctgcctcgtntctggactcctggacacgtcgtcaccactctcctgcacgtgaaccngccgtgactattggncttaataactatacgtctcgtacgtaccaacaacaccgaggtaccaacggaccccaaactccagtactactttatcgtactcgtacagtcatccggtcctcgtcggtcttcgtcgtcgtcttctctcgctcagtcgtgactacgcgcctcctcgccnctcgtcggctcgagcgtacgacgtacgagtcttaacgttattctacgtntacttcataacacgtacaacgaacctagtacgttcgtagggtcgttcgggacggtacggtaaccgtaggtccgtaccgttccgtccggttacaccggtacccgaacgggtcctacccggtcccccgttaggaccccgtacgttccgtccgttaccccccg

SEQ ID NO: 8144 - DNA, 583 bp, Homo sapiens
  misc_feature: GYAE6OF01CSRZE.25.22.B11.1.454.CMB.1.raw
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttanactatgtctcctggtcccaacaacacccaggcaacggccccaaactcatcatttatgatgtcagtcatcggccctctggattctggtcgcttctctggctccaagtctggctaactcgcctccctgaccatccgtcgggccttccgacggtctggaacggacgacggtacttactttattatttagctatttcactacagacgacaaccaacagttcgtggtcgttcggcgggtaacggacctaaaggttcgaacccgttccgtccggtaccacggtccccgaaacggtccgtaccggtccccccgttacggttccctaccgttcccgtccggtttccccccg

SEQ ID NO: 8145 - DNA, 604 bp, Homo sapiens
  misc_feature: GYAE6OF01BDB1T.25.22.B11.1.454.CMB.1.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacaccaggcaacggcccccaaactcatcatttangatgtcagtcatcggccctntggtagtttctggtcgtcttctcgtggctccgaagtctggccaaccgtccggccctccgtgaccctagtccgtcggggcctccgagggctggaggacgaggcttaacttattagttcgactatttcaattacaggaacgaccaaccaaacgtagttacgtgggttcggttccgggacgggacgggtaaccgtaacggttccgacccggttcccgttcggtacgacggtccccgaagggtccctaccgtcccccgtacggtcctaccgttcgttcccggttcccccg

SEQ ID NO: 8146 - DNA, 570 bp, Homo sapiens
  misc_feature: GYAE6OF01DF5TJ.25.22.B11.1.454.CMB.1.raw
  modified_base (231)..(231): a, c, t, g, unknown or other
  misc_feature (231)..(231): n is a, c, g, or t
  modified_base (281)..(281): a, c, t, g, unknown or other
  misc_feature (281)..(281): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (445)..(445): a, c, t, g, unknown or other
  misc_feature (445)..(445): n is a, c, g, or t
  modified_base (461)..(461): a, c, t, g, unknown or other
  misc_feature (461)..(461): n is a, c, g, or t
  modified_base (503)..(503): a, c, t, g, unknown or other
  misc_feature (503)..(503): n is a, c, g, or t
  modified_base (532)..(532): a, c, t, g, unknown or other
  misc_feature (532)..(532): n is a, c, g, or t
  modified_base (550)..(550): a, c, t, g, unknown or other
  misc_feature (550)..(550): n is a, c, g, or t
  modified_base (561)..(561): a, c, t, g, unknown or other
  misc_feature (561)..(561): n is a, c, g, or t
tcagactgtacagtcacgaccggtgctcgatttagacgacagctcagggaccctccaggcttgacgaagccctcccccagagttcccaggagtttccattcggtgatcagcactgaacacagaggactcaccatggagtttgggctgagctgggttttcctgttgctcttgtaaaaggtgtccattgtcagtgcagtggtggcagtgtggggagggctcgtcaagcgtggngggtccgtcgagactctcctacgtgaagtctctggtattctaccatcaangtaactaccttagttggtccgtggacgtccgccgaggaccgccgacgggaaggggctggagtggattctattagtntagtaagtggtacggtaanggtactataagtatcgagactcgtaccgacgggcgtctcacgactcgccgacggacaccgacaactaanactactacttcgtganagtagaaccacgtccgagtccgacgacgacgcggtctacgtntcggtgcgtaggtaggttgggttatgtgngtgaccgtgtaggttacnccccttacccncgttaaacg

SEQ ID NO: 8147 - DNA, 735 bp, Homo sapiens
  misc_feature: GYAE6OF01CUQV5.25.22.B11.1.454.CMB.1.raw
  modified_base (238)..(238): a, c, t, g, unknown or other
  misc_feature (238)..(238): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctggcccagtctgccctgactcagcctgcctccgtgtctgggacctcctggacagtcggtcaccatctcctgcactggaaccagccgtagactagttggtncttaataacctatcgtcctcctacggtcccaaacaaccaacccgaggaccaacggacccccaaactcatcctaatttactagtagtgtactagtactacgtccggtacccttcgtacgggtactttacgtaacgttcgtctttccttcgtcgtacctacgtaacgttcgtcggcgtaacgtccgaaccggtcccttacccgtacgaacctaacttccgttcgtacgggtccctaccggacggtcgttacggaacgggtacgacggtctaggtaactttacgtactacgtaccttaactactaagtacgtaccggtactaacgtacttaaccaaaccgttaaaccgttcccgttaccgttacccgggtaacccgtacccggggtaaccgttaacccgggacccgttaaccccggttcccggtacgggtacccgaaccccgtacccgggtaccggtaccccttccccggtacccccgttccgggtacccttaccccggg

SEQ ID NO: 8148 - DNA, 619 bp, Homo sapiens
  misc_feature: GYAE6OF01DJ18S.25.22.B11.1.454.CMB.1.raw
  modified_base (236)..(236): a, c, t, g, unknown or other
  misc_feature (236)..(236): n is a, c, g, or t
  modified_base (298)..(298): a, c, t, g, unknown or other
  misc_feature (298)..(298): n is a, c, g, or t
  modified_base (336)..(336): a, c, t, g, unknown or other
  misc_feature (336)..(336): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacatttggngtcttataactatgtctcctggtcccaacaacaccaggcaacggccccaaatcatcatttangatgtcagtcatcggcctctggtagtttctcgggttcncttctctcggtctaccgaagttctcgggactaacgtccggtcctcccgtgacctagtccgtcgggtcctccgaggtctacggacggacgtacggtcttacttattattgtctatttccattaccaagtacgaacaccaaacgtagttaccgtgggttcgttacgggacggtacgggaacctaaggttaccgtacccggtcccgtcgggtaccacggtacccgaaacggtcccttaccggtccccccttagggtaccctacccgttccgttccggttccccccg

SEQ ID NO: 8149 - DNA, 755 bp, Homo sapiens
  misc_feature: GYAE6OF01EMFVF.25.22.B11.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
tcagactgtacagtcacgaccggtgctcgatttagacgacagctcgaggggggggtctcaggaggcagcgctctcgggacgtctccaccatcggcctgggctctgctcgttcctccaccctcctcactcaggcactagggtcctgggcccagtctgccctgactcagcctgcctcggtgtctgggctccgtaggacngtcgtcacntcnccgtgcacgtcggaaccnggtcccgtgacctagttcggcgtcctttaagtaaccttnttcgttccttccgtacggtaccctaaaccaaccgtacccgaacggacctaaaccgggacccccctaaaacttccgtacttaccgtaagttttaacgacggtacgttacggtacgaggttaccaacggttccggtacctcggttacgggtacgttttccgtacggttccgtcgtttccgttacgttacggtaccttaccgtaacgttccgtacggtacctaacgttccccggggtcccttccggtaccgtaacccttacggttcccgggtccgggggtaccttacccggaaggggtaccgtacggggtaaacggaaccggttacgggtacctttaacgtttactttacgtcgtacctagtttcccaagtactacgacgacctaaaccgtagtacgtcgttgggttgttccgggagtacggtacgagttccgaccgtcgtcggtacgacgtccgaggcctcccgacccgtgaccttcgtcgtccgtccccg

SEQ ID NO: 8150 - DNA, 686 bp, Homo sapiens
  misc_feature: GYAE6OF01ENMOX.25.22.B11.1.454.CMB.1.raw
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggacctccgtggacagtcggtcaccatctcctgcacgtggaaccnggccgtagactagttggtcgtactttaataactnttcgtctccgtcggtacccaaacaaccacccgaggaccaacggacccccaaactcactactatttatagtatgtctacgtactacgtccgtccgtcgtggttacgtttcgtcggtcgtcgtttcgtcgtcggtactccgtaacgttcgtcggacctaaccgttccggcccttcctacgacctacgtccggtccgggtcctccgacgcgtggacggtacgacggtacttaactttattagttcgtacttactttacgtactaacgacgtaacgaaccaacctaacgtacgtcgttacgggttcggtacggggtacgggaacgggtaccgtaacggtccggtacccggttccgtcggttaccgacggtacccggacggtccgtccccgtaccccgtcggttaccctccgtttccgtcccgttacccccg

SEQ ID NO: 8151 - DNA, 693 bp, Homo sapiens
  misc_feature: GYAE6OF01DQ5IY.25.22.B11.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
tcagactgtacagtcacgaccggtgctcgatttagacgacagctcaggggggggtctcaggaggcagcgctctcgggacgtctccaccatggcctgggctctgctgctcctcactctcctcactcaggacacagggtcctgggcccagtctgccgtgactcagcctgcctcgtgtctggtctccgtggacagtcgatcacctatttccngcactggactcagcatgatgtgcgtagttattactttgtctctgtaccaacaacaccagacaaacgaccccaaactcatctagtttacngatgtacagtcatccggtccctcgtggttagttcgttcggtccgtctttctcgtcggtcctacctaagtcgtacggctaaccgtccggtcccttcccgtacgtaccctacttccggtccggggtcctacccggacggtcgtagggacgggaccggacggtacgttacgtaacgttttaacgttaccgttacggtaccttaaccgtacgtaatttaacggtacggtaacctaactaacgtaccaaacctaacccgttccccgttaccggttcccgggaacccgtaccggggtaacccggtacggggtaccccgtacccggtttcccggtaccggggtacgaaccccgtaccccggaaacccggaccccctaaacccccgtcgtaccgttacccccg

SEQ ID NO: 8152 - DNA, 527 bp, Homo sapiens
  misc_feature: GYAE6OF01AZ682.25.22.B11.1.454.CMB.1.raw
  modified_base (389)..(389): a, c, t, g, unknown or other
  misc_feature (389)..(389): n is a, c, g, or t
  modified_base (422)..(422): a, c, t, g, unknown or other
  misc_feature (422)..(422): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggtctcctggacagtcgatcaccatttcctgcactggactcagcactgatgttgcaggttattactttgtctctggtaccaacaacacccaggcaaacgccccaaacttatcatttatgagccactaagccggccctcgaggtagtttctaactcgtcttctctggctccaagtctggcagcacgcctcctgacatctcgtggctccgnggctgaggacgaggctgtattatactgctactnatagtgacactatcaactaactcccgtacgtcgaccgtggacccagggtaccacccgtcgtgggccacgacccgaaggccctaacccgatcgctacgtcgtcccg

SEQ ID NO: 8153 - DNA, 708 bp, Homo sapiens
  misc_feature: GYAE6OF01B2J9D.25.22.B11.1.454.CMB.1.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (322)..(322): a, c, t, g, unknown or other
  misc_feature (322)..(322): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcgagggcacagggtcctgggcccagtctgccctgactcagcctgccctcgtgtcgtgggacctccgtggacaggtcggtcaccatcctccngcacgtcggaaccngccgtgaactgttggtatcttaatactatcgtcctccgtcgtaccaaacaaccaccgaggaccaaccgacccctaaatcatactattttagngtatcgtacacgttaccgacgttccggcccttggtaggttcgttttcgcggttcctcttccgtacgcggtccctacgtagtccgtaggaccctacgtccggtcccttacgtcaaccgtcgtcgggtaccggcttccgagggtacgtagggacggaacggtacggtacctttattacttacgttcgtcttaacgttcaacgtacaaggaaccgtaaccaactaacgtacgtttcggtagggttaccggttaccggggacggtaccgggtaaaccgttacgggtcccgtaacccggtttccggacggttaacccgaccggtacccgtaccggtcccgtaaccccggttccccggtacgtacccgtcccgttcgttccccgtaccccgg

SEQ ID NO: 8154 - DNA, 749 bp, Homo sapiens
  misc_feature: GYAE6OF01D9BIY.25.22.B11.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacgagggtcctgggcccagtctgccctgactcagcctgcctcgtgtctgggactccgtggacaggtccggtcaccatcctcctgacacgtggaaccnggtcgtagactagtttgggntactttaataacttgtcgtctccgtcggtacccaaaccaaccacccgaggaccaacggacccccaaactcactctatttactgtactgtcagtcacgtccgtccttcgtggtacgtttcgtcggtcgtcttcgtcgtcgtctaccgtagtcgtcggtcctccgtccggcccttccgcgtcctacgttcgacgggttcgggtccgttaccgggtccggtaagggtacgtacgggaacggtcgttaacgtaacgtttacttaaccggttgttacggtacggttagggtttcgggtacgttacggtaccgtagggttaccgttaggggttacggtttaccggggtacccgggttaacggggttcgggttaccgggggtacggggtaaaccggggacccgtaaacgggtcccgtaccgggtacccgttaccggttacgggttacccgaccggtaccccggtacggtcccgtaccccgggttcccccgtcggttcccttaccccgg

SEQ ID NO: 8155 - DNA, 763 bp, Homo sapiens
  misc_feature: GYAE6OF01CSE1C.25.22.B11.1.454.CMB.1.raw
  modified_base (250)..(250): a, c, t, g, unknown or other
  misc_feature (250)..(250): n is a, c, g, or t
tcagactgtacagtcacgaccggtgctcgatttagacgacagctcgagggggggggtctcaggaggcagcgctctcgggacgtctccaccatggcctgggctctgctgttcctcaccctcctcactcagggcacagggtcctgggcccagtctgccctgactcagcctgcctccgtgtcgtgggactcctggacaggtccggtacaccattcctcctgcactacggaacctggccgtgactagtttggtntactttaatacttattcgttccttcccgtcggtaccccaaaacaaacccgacccaagggaccgaaaccggaccccccaaaacttcaacttctaattttatcgaatcgtcaacgtctaacgtccggtcccttcgtagggttacgttttccgttgggtccgttcctttcgtaccgtcgggtaccccttaacgttacgtcggtacgtaccgacccggtcccgtccctccgtaccgaaccgttcgtccgggtcccggtcctaccggaggtcgtagggacgggtaagtaccgttacgtttaacgtttacttacgttcgtaacttagtttaacaacgtaggaacgacctaacaaccgtagtacgttgggttaacggtcggttaccggggacgggtaaccggtaggttacggtacccggttcccggttacggacccggtacgtacccggtaacggtaccgtcccgtaaccccgtccccggttaacgtccctaccgtttccccgttccccgttaccccccg

SEQ ID NO: 8156 - DNA, 770 bp, Homo sapiens
  misc_feature: GYAE6OF01CQDB2.25.22.B11.1.454.CMB.1.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
tcagactgtacagtcacgaccggtgctcgatttagacgacagctcaggggggggtctcaggaggcagcgctctcgggacgtctccaccatggcctgggctctgctgctcctcactctcctcactcaggacacgagggtcctgggcccagtctgccgtgactcagcctgcctccgtgtcgtggtctcctggacagtcgatcaccatttccngcactggactcgagcactgatgttgctaggttattactttgtctcgtagtaaccaacaacaccaggacaaacgccccaaacttanactaattatacgacgacctaacgtaacgccgcccctagaacggtagttactaatcgtctttccgtactcggtcctaccgaacgttcgtacggcgacgtacccgaccggtcccttcccgagtaacctaactccttaccgtcggggtccctacccggagggtccgttacgggaacggggaaaccgtacgggtaccgtttagggttaaacttttaacggtacctttacggtcctttaaacgtacttagttaaacgtacgggtaaaccaacctaactaacccgtaaacttaaaacccgtttccccggtaccgtttaaccgggtaaccccggttaccggggtaaacccgttaccgggggttaaccccgtacccgggttacccggtttacggggtaacccgtaacccggtaacccccgtaaaccggggaaacccccccttaaacccccggtaaccgttccggttaacccccttaaccccgg

SEQ ID NO: 8157 - DNA, 840 bp, Homo sapiens
  misc_feature: GYAE6OF01CYP7Y.25.22.B11.1.454.CMB.1.raw
  modified_base (238)..(238): a, c, t, g, unknown or other
  misc_feature (238)..(238): n is a, c, g, or t
  modified_base (332)..(332): a, c, t, g, unknown or other
  misc_feature (332)..(332): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactagttgggtntactttaataactagtcgttccttcccgtcggtacccaaactaaaccaccccgaaggaccaaaccggaccccccaaaactcatactaattttangtatgtcagtcagtccggcctcgtaggtagtttctggtcgtctttcgtcgtaggtccttaccgaaggttctcgggacctaaaccgttcccgggtccctttaccccgtacggtaaccctacgttcccggttacccgggggtcccttacccggtacgggtacccgttacgggaacgggtaaccggtaacggtaacccttttaacgttttaacgttttaagtttacggttaccttaagtttttaccctaaacgtttaaccgaaaggtaaccggtaaaaaccctaaacccgtaaaaccgttacgggttaccgttacggggttttacgggttacccgggggacggggtaaaccgggggtaaacccgtaacgggtttaccgggtacccggttacccggttacccggggttacccgaacgggtaacccccgtaaacgggtccccgttacccgggtaccccccccgttaccggttacccgtaacccgtttcccggttccccgtttaccccccccgg

SEQ ID NO: 8158 - DNA, 817 bp, Homo sapiens
  misc_feature: GYAE6OF01B1DAE.25.22.B11.1.454.CMB.1.raw
  modified_base (192)..(192): a, c, t, g, unknown or other
  misc_feature (192)..(192): n is a, c, g, or t
tcagactgtacagtcacgaccggtgctcgatttagacgacagctcgaggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacngtcgtcaccatctctgcactggaaccagccgtgaactagttggtcgtactttaataactattcgtccttccgtacggtacccaaacctaaccacccgaaggacctaaacggaccccccctaaaactacaacttactaattttactagacttacgtaccagtcctaacgtcccgggtaccccttgttcggggttacgttttccgttcgggttccgttcctttaccgtcgttcgggtacccttacccgtaaggttccgttacgggaaccctaaccgttcccgggtccccttccccgtacgtaacccgtaacggttcccgggttacccggggggtccttacccggaacgggttccggtaacgggaaacgggtaaccggtaagggttaaccctttaaccgttttaatttaacgtttacggaacctttactttaaccaacgttaacgaacggtaacgaaacccaaacccgtaacgtacggtttcggttacgggttcgggttaacgggacggggaacgggtaaccgtaaggttcccgaccggttcccgtaccgggtacaaccggcccgtaacgggtccctacccggtaccccccgttagtaccctcccgttccgttccccggttccccccg

SEQ ID NO: 8159 - DNA, 566 bp, Homo sapiens
  misc_feature: GYAE6OF01BB57M.25.22.B11.1.454.CMB.1.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (398)..(398): a, c, t, g, unknown or other
  misc_feature (398)..(398): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtnctttataactntgtctcctggtcccaacaacacccagcaacggcccccaaactcatcatttatgatgtcagtcatccggcctctggtagtttctggtcgcttctctggctcagtctggcactcggcctcctgaccatcgtcgggctccgaggctgaggacgnggctacttattattgtctatttcattacagtacgaccaacctaacgagttcgtaggttggttacggcgggacgggtacctaaggttcgaacccgttccgtccggtacacggtcccaacgggtccctcccggtaccccctcggtacctacctccgtcccgttccccccg

SEQ ID NO: 8160 - DNA, 709 bp, Homo sapiens
  misc_feature: GYAE6OF01C1W3X.25.22.B11.1.454.CMB.1.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
tcagactgtacagtcacgaccggtgctcgatttagacgacagctcagggggggtctcaggaggcagcgctctcgggacgtctccaccatggcctgggctctgctgttcctcaccctcctcactcagggcacagggtcctggcccagtctgccctgactcagcctgcctcgtgtctgggactccgtggacagtccgtcacatcctcctgcactggaaccngccgtgactattgggtntactttaagaacttgtcgtccttccgtacggtacccaaactaaccgaacccgacggaaccgaaccggaccccctaaaactcaacttactaattttacgtagtacttcgtacacgttcgtacgtccgtccctcgttaggtacgtttcgtcggtcgtccttcgtcgtcgtacctacgtaacgtcgtacgaccgtaacgtcccggtaccctcccgtacgtacccgtacgttccgggtacgggtcctccggaacggtcgtacggaacggtacggtacggtaccttacgttagttacgtagtacctatttactaacgtacgtaagtaccgaaccaaccgtaacgtacgtcgttacggtacggttcgggacgggtaacggtaacgtacggtccgtaaccgtccgttaccggtacaccggacccgacggtacccgtcccgttccccggtacgtcgttacctcccgttccggttacccccc

SEQ ID NO: 8161 - DNA, 736 bp, Homo sapiens
  misc_feature: GYAE6OF01B0UX8.25.22.B11.1.454.CMB.1.raw
  modified_base (396)..(396): a, c, t, g, unknown or other
  misc_feature (396)..(396): n is a, c, g, or t
  modified_base (606)..(606): a, c, t, g, unknown or other
  misc_feature (606)..(606): n is a, c, g, or t
tcagactgtacagtcacgaccggtgctcgatttagacgacagctcagggaccctccaggcttgacgaaggcctcccccagagttcccaggagtttccattcggtgatcagcactgaacacagaggactcaccatggagtttgggctgagctgggttttccttgttgctcttgtaaaaggtgtccattgtcaggtgcagttggtgcagtcgtcggggagcttcgtcaagccgtggagggtccctgacgactctccgtgtgaagtctctggtacttcaccatcaatgtacttactttagtcggtacctggactcccgaccgacggcctccggaggggaacgggtcgtaggtaggtcggtacgtttcgactttataccgagttaacgtggtagttaagnggtactattaactaacgtcccagactccgtccgggacggggtccctacgttccaccgtactacctaccgaacgggtacccaaacggtccctaaacgaacgttaccgtaaccttccgtttaccgtacggaccgtaaacggtacgtaaaccgggtaaccgggtccggaacggaccggaacgggaccgaccggtacccgttaatacccgtttntaccgggtgaccgggtaagggtttacggggtttacgggggtttaactttaggacggtaggttacggaacccgtttacggggttaccgttttaaaccaacccctttaccccggtaacttttaaaacccggg

SEQ ID NO: 8162 - DNA, 710 bp, Homo sapiens
  misc_feature: GYAE6OF01BRFZA.25.22.B11.1.454.CMB.1.raw
  modified_base (319)..(319): a, c, t, g, unknown or other
  misc_feature (319)..(319): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctcgggcccagtctgccctgactcagcctgcctcgtgtctgggactcctggacagtcggtcaccatctcctgactactaggaaccagccttgactattcggtagtctttaataactatcgtctccgtcgtacccaacaaccaccacggaccaaccggacccctaactcactactatttanagtatcgtacagtcacgtccgtccctcgtcggtagtttacgtcggtctccgttctcgtcgtctaccgtaagtcgtacgctaaccgtccggtccctccgtacgacctacgtccgggtccgggtcctaccggtacggcgtagggacggacggtacgtacgttaactttacgttacttaccgtactttacgttactaacgtaacaacggtaacaaccaaccgtaaacgtacgttacgttgggtttacgggtcggggtaccgggtaacggtaaaccggttaaccgttaccggtacccgttccggttaccgggtaccaaccgggtcccgaacggtcccgccccgttaccccggttaccggttacctaccggtttccccgttacccggttacccccc

SEQ ID NO: 8163 - DNA, 676 bp, Homo sapiens
  misc_feature: GYAE6OF01DY588.25.22.B11.1.454.CMB.1.raw
  modified_base (383)..(383): a, c, t, g, unknown or other
  misc_feature (383)..(383): n is a, c, g, or t
tcagactgtacagtcacgaccggtgctcgatttagacgacagctcaggggggggtctcaggaggcagcgctctcgggacgtctccaccatggcctgggctctgctgctcctcactctcctcactcaggacacagggtcctgggcccagtctggcctgactcaacctgcctcgtgtctgggtctccgtggacggtcaatcaccatttcctgcactggaaccagcactgatgttggctactttgaccttgtctcttcggtaccaacaaccacccaggacaaacgaccccctaaattatctatttatgacggaccacgtaacgccggccctcgaggtacgtttctaatcgtcttctctggctccaagtctgcagcacggcctcccngacagtctcgtcgggcctccgaggcgtaggacgggacggtacgggacttagtaacgtttatttaccgtggtaccttaacgtactaacgttaggtacggaaccaactaacgttacctaaacgtaaacccgtttccccggttacgttaccgggtaccccgttagggggtaccccgtacggggtacccgtaccggttcccggtcggggttacccaccggtacccccggaaacggtaccccctaaaccccccgtcgttaccggtaccctaccttcccggttcccgtttacccccccc

SEQ ID NO: 8164 - DNA, 626 bp, Homo sapiens
  misc_feature: GYAE6OF01B8XCH.25.22.B11.1.454.CMB.1.raw
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
  modified_base (400)..(400): a, c, t, g, unknown or other
  misc_feature (400)..(400): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctcgtgtctgggactctggacagtcggtcaccatcctcctgcactggaaccagccgtgacctagtttggctactttaagtaactatcgttctccgtcggtacccaaacaaccacccgaggcaacggcccccaaatcatcatttacngatgtcagtcacgtcggcccttagtggtactttcnggtctacttctcgtggcctaccgaagttctggctaactcggtccctccgtnacctagtcctcggggtcctccgaggtctacgacggaacgacggtacttacgttattacgttacgacgttactttacattaacgaagacgtaaccaaccgaacgtagtcgttagggtcgttaccgggacgggtaacggtcctaaaggttcgaacccgtccgtacggtccacggtcccgaacggtcctccggtccccgttacgtcctaccgttccgtccgttcccccg

SEQ ID NO: 8165 - DNA, 797 bp, Homo sapiens
  misc_feature: GYAE6OF01AF308.25.22.B11.1.454.CMB.1.raw
  modified_base (209)..(209): a, c, t, g, unknown or other
  misc_feature (209)..(209): n is a, c, g, or t
tcagactgtacagtcacgaccggtgctcgatttagacgacagctcgaggggggggggtctcaggaggcagcgctctcgggacgtctccaccatggcctgggctctgctcgttcctccaccctcctcactcgacgggcacgacgggtcctcgggcccagtctcggccctgactcgacgcctcgcctcgtgtcgtcgggactcgtcggacnggtccggtcactatcctctgcacgtacggaaccagccgtcgaactagttcggtactactttaataacttagtcgtcctcccgtacggtaacccaaacaaccgaccgacgggaccaaacccggtaacccctaacttacctacttacgttaacgttttacgtaggtacttacgtctaacgtaccgtaccggttcccggtaccgttacggttacgggttacgttttccggtccggttccgtcctttcgtcggttccggtcctaacggtacgtcccggtacggtacccgtaacccgttccgtacccgttaccggtacgtaaccgttcggttccgggtaccgggtccttaaccgggcggttacggtaacggaaccgggtacgggtaccgttactttaactttacggtattacgtacttaattcgaactaggaaccgttaacaaccgtaacgaacgttcggttactacgggttcggtaaccggggacggtaaccggtaccgtacgttcggtacccgttggtaccgtaccggtacgaccggttaccggccgttaccccggtcggtacccgtattccccgtcggttccctcccccg

SEQ ID NO: 8166 - DNA, 637 bp, Homo sapiens
  misc_feature: GYAE6OF01BBOBG.25.22.B11.1.454.CMB.1.raw
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
tcagactgtacagtcacgaccggtgctcgatttagacgacagctcagggaccctccaggcttgacgaagcctcccccagagttcccaggagtttccattcggtgatcagcactgaacacagaggactcaccatggagtttgggctgagctgggttttccttgttgctcttgtaaaaggtgtccattgtcaggtgcaggttggtgcagtcgtgggggagcttcgtcaagcctggacgggtccctgacgactctctgtgaagtctcnggattccaccatcaatgacttacttanggcctggactccggccacggctccggaaggggacgggcgtggagtggtatttacagtttactcgaagtaagtgggaagttagtggtactagtttaatacgtccagtacctcgtaccgggacgggcctctcacctctccgtccgaagggtaccaacggccaacactactaaccttctttcagtaccaaggttacgaaccgtacggccggaacgccgggaacggtaccgtaaccgggtccgttacgtaccgttcggtaggtcggacgtagggttagggtttacggggttattacggtgacgtcgtacgtaggttacgttaccttacccctaccgttacttaaaccgg

SEQ ID NO: 8167 - DNA, 770 bp, Homo sapiens
  misc_feature: GYAE6OF01BSOY3.25.22.B11.1.454.CMB.1.raw
tcagactgtacagtcacgaccggtgctcgatttagacgacagctcagggggggggtctcaggaggcagcgctctcgggacgtctccaccatggcctgggctctgctgttcctcacccctcctcactcagggcacagggtcctgggcccagtctgccctgactcagcctgcctccgtgtcgtgggactcctggacaggtccggtcaccatcctcctgcactggaaccagccgtgactagttcggtgtactttaactaactagttcgttccttccgttaccggtaccctaaaccaaacccaaccccgaacggaccgaaaccggacccccaaacctaccacttactaatttatacgtattacgtacgtacgtacctacgtcccggtcccgtcgttggtacgtttcgttcggttccgtcttcgtcgtcgtcctaccgtacggtctacggggggactaccgtccgtaccctcccgtaccgaccgtacgtccggtccgggtccgtccgacggtcggtacggacgggtacggtaacggtacgttaactttacgttacgttacgtacttacgtttacacttaacgacgtaacgaacctaaccgtaacgtacgttacgttagggttcgggttccgggacgggtaacgggtaaccgtaacggttaccgtacccggttaccggtaccggttaccgtacccggtccccggtaacggtcccggtaccccgggtccccgttaccccggttaccgttacccttcccgttccccgttaaccccccg

SEQ ID NO: 8168 - DNA, 801 bp, Homo sapiens
  misc_feature: GYAE6OF01BBSR9.25.22.B11.1.454.CMB.1.raw
  modified_base (212)..(212): a, c, t, g, unknown or other
  misc_feature (212)..(212): n is a, c, g, or t
tcagactgtacagtcacgaccggtgctcgatttagacgacagctcagggaccctccaggcttgacgaagcctcccccagagttcccaggagtttccattcggtgatcagcactgaacacagaggactcaccagtggtagtttggctgagtcgttgggttttccttgttgcttcttagtaaaggtgtcctattgtcgaggtgcgtaggttggngacgtaggttcggtaggggggacgtcgttcggtacaacggtccgtagggtacgggttccctaggtaccgtaccgttcctccgttggtacgtaacgttccgtacgtacggtaccttaccgactactacgtaacgttacgttaaccgtttacgtttacggtccggtaccgtacggtaccgtcccggtaccggtacggtcccggtaacggggtaaggggtacgggtacggtagggtaggttaggttactttacgttaagttacgtaacgtaaggttaaggtaggtaacgttagtacgtaattaacttaactactaccgtacgtaccgtccggtacggaccggtcctacctaccgacgtaccgtaccgaacgggaaccgaacccgtaaccgacctaactaccgttacctaacgtttcgtaccgtacgtacgtaacggtaaccgaccgtacggtaccggacggtacccgggacgtaaccggtccgttacgttacgttacgtacgtcggacggtacggttagggttagggttagtagttaggcgtacgtacgtacgttacggttaccgtaacccttacccgtaacgtacgtaacg

SEQ ID NO: 8169 - DNA, 704 bp, Homo sapiens
  misc_feature: GYAE6OF01B6GQ7.25.22.B11.1.454.CMB.1.raw
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
  modified_base (351)..(351): a, c, t, g, unknown or other
  misc_feature (351)..(351): n is a, c, g, or t
  modified_base (532)..(532): a, c, t, g, unknown or other
  misc_feature (532)..(532): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcgagggcacgagggtcctgggcccagtctgtcctgactcagcctgcctccgtgtctgggactccgtggactaggtcgtcacctatcctctgctactcggaaccagccgtanacgtagtttggtactactttaataacgtnttcggttccttccgttaccggtaccccaaaactaacccgacccgaaggacctaaacccggacccccctaaatcactcttaagtttanagtattcgtacgacgtacgtacgtccggtcccttaggttcggttagtttccgtcggtccgttcttcgtacgtcggtacctacgtaagtccgtcggactaccgtcccgtacctccgtacgtacctacgtccgggtaccgggcctacgggagcgtacggagggacgtacgtctttaaactttntacgttcacttactttacacttagacgaacaacctaacgtacgtagttcggtaggtacggtacggaggtaaccgtacgtacggttcgacccgtttaccggcgtaccgaccggtcccgtacgtacccgtcccggtccccttcggtacctcccgttccggtcccgttacccccg

SEQ ID NO: 8170 - DNA, 1040 bp, Homo sapiens
  misc_feature: GYAE6OF01EBO02.25.22.B11.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
tcagactgtacagtcacgaccggtgctcgatttagacgacagctcgaggggggggtctcaggaggcagcgctctcgggacgtctccacatggcctgggctctgctgttcctcaccctctcactcagggcacagggtcctgggccagtctgccctgactcagcctgcctcgtgtcgtggactcgtagacnggtcgtcactntctctgcactcggaaccagccgtagacgtagtttggtactactttaaataacctagttcgttcttcccgacggttaaccccaaacaaaacccgaacccgaacgggaccaaacccggtaacccccccaaaacttaccaacgtttacctaaagtttttagtacgttaacgtttacggtaacgtacgtttacctaaccggtttcccgggtcccgtttacgttacgggggtttaacgtttttccggtaccggggtttccttccccgttttcggtaccggttccgggtaccctttaccgtaaacgggtttttcgaccggggtaacccttaaaccccgggttccggggtaccccctttaaccccgggtaccgttaaaaccccgtttaccgggttcccggggtttaacccgggggtaccccgttacccggtacgggttacggtaaccggggtaaccgggtacgggtaacgggtttacctttaaacgtttttacgtttaacgttttacggaaccttttacgttaacctaactttaacgggtaactaaaccgtaaacccgttaaacccgtaaacgttacgggtttaaccgggttacgggtttaacggggttacccggggtaacggggttaaccgggtaaaaccggttaaccgggtttaacccggttaaacccccgggtttacccggggtttaacccgggttaaccggttaacccccgggaaacccccggtttaaaccggggggttacccccttaccccccggggtttccccccgggttaccccggggttaaaccccttttaacccgggtttccccccgtttcccccgggggttttaaaccccccccccg

SEQ ID NO: 8171 - DNA, 853 bp, Homo sapiens
  misc_feature: GYAE6OF01CVKN2.25.22.B11.1.454.CMB.1.raw
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
tcagactgtacagtcacgaccggtgctcgatttagacgacagctcgagggggggggtctcaggaggcagtgctctcgggacgtctccaccatggcctgggctctgctgttcctcaccctcctcactcagggcacagggtcctgggcccagtctcgccctgactcagcctgcctccgtgtctgggacctccgtggacaggtccggtcaccntcctcctgcactcggaaccngccgtgactagttgggtctacctttaataacgttagtcgttccttcccgttacggtacccaaaccaaaccgaaccccgaacggaccgaaacccgggaacccccccaaaacgtcctaacttacctaatttttacgtacgtaattcggttacctacggttaccgtaacgttcccggtccccttacggtttacgggttacgttttccggttcgggttccgttccgttttccgttccgtcgggttcccttaccgtaacggttccgtacggtaccgtaaccgtcccggtcccttacccgtcgtaccctacgttcccggtacgggtccctaccgtacggtcgtacgggtaacggccggtaacggtacctttaacgtttatttaacgttcggtacttactttaccgtaactaacgtaacgtaacgtaaaccaacccgttaaacgtaggttaccgttggggtttaccggttaccgggtaccggggtaacggttaaccgttaaacggggtttccggtaacccggttacccggttacccgggtaccgtaacccgggtacccggaccggtcccggttccccggtacccccggtttcgtacccgttacccgttcccgttccccggtttccccccg

SEQ ID NO: 8172 - DNA, 730 bp, Homo sapiens
  misc_feature: GYAE6OF01ENLB2.25.22.B11.1.454.CMB.1.raw
  modified_base (240)..(240): a, c, t, g, unknown or other
  misc_feature (240)..(240): n is a, c, g, or t
  modified_base (555)..(555): a, c, t, g, unknown or other
  misc_feature (555)..(555): n is a, c, g, or t
tcagactgtacagtcacgaccggtgctcgatttagacgacagctcaggggggggtctcaggaggcagcgctctcgggacgtctccaccatggcctgggctctgctgttcctccaccctcctcactcagggcacgagggtcctgggcccagtctcgccctgactcagccctgccctccgtgtctgggacctccgtggactggtccggtccaaccatccttcctgcctacgtcgggaacccngtcccgtgactagttcgggtgtactttaataacctgtcgtctccgtcgtacccaacaaccacccgaggaccaaccggacccctaaactccattacctatttatgtatcgtacgtagtcctacgtccggtaccctcgttagggttcgttttccgagggttccctcgtttccgtcgtcgggtccctaaccgtacggtcgtacggtaccctacgtcccggtccctcccgtacgacctacggtttcggtacccgggtccttacccgagggtcgtaaggacgggtacgtacggtactttacgtttagttcttgtacgttntttacgacttaacgagtaaccgaactaaccgtacgtacggttcgttcgggttacggtacgggtaccggtacgggtaaccgttaagggtcccgtaaccggttccggtacggtcccaccggaccgtacggtcccgtcccgtaccccgttacggcttaccgtcccgttccgtaccccc

SEQ ID NO: 8173 - DNA, 716 bp, Homo sapiens
  misc_feature: GYAE6OF01C83ZJ.25.22.B11.1.454.CMB.1.raw
  modified_base (193)..(193): a, c, t, g, unknown or other
  misc_feature (193)..(193): n is a, c, g, or t
  modified_base (314)..(314): a, c, t, g, unknown or other
  misc_feature (314)..(314): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcgtcaccatctcctgcactggactcagcactgattgttgctaggttttattactttgtcctccgtcggtaccaaacaaccacccacggacaaaccgacccctaaattactactatttangacggtccaactaacgccggcctacgaggtacgtttactaactcgtacttctacgtgcctaccgaagtctggctagcctacggccctaccgtgaacctactccttacgtcgggtaccctccgtacgggtctacgggacgggtaacggaggtaccgttaggttattttaacgttaaccgtcgttaccttaaccttacgtaacgttaacgtacggaacctaaccttaacgtaacctaaaccgttaaacccgttccccgtttacgttacccgggaccggttacgggaacccgtacgggttacccgacccggttccggtaggggtaccccacggtaacccccgtaaaccgggacccccctaaaccctaccgttaccggtaccctacgttcccgtttaacccccggg

SEQ ID NO: 8174 - DNA, 653 bp, Homo sapiens
  misc_feature: GYAE6OF01C83KU.25.22.B11.1.454.CMB.1.raw
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (316)..(316): a, c, t, g, unknown or other
  misc_feature (316)..(316): n is a, c, g, or t
  modified_base (417)..(417): a, c, t, g, unknown or other
  misc_feature (417)..(417): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcgagggcacacgggtcctgggctcagtctcgccctgactcagcctgcccttccgtgtctgggacctccgtggaccagtcgtcaccntcctctgcacgtggaaccagtccgtagactagttggtntacttataactatcgtctccgtcggtacccaacaccaccgagccaaccgacccaactcatctatttantatgtacacgtcacgtccgtcctgtcggtacgtttcgtcggtcctctttacgtcgtcgtcctacgagttcgtacgtacacgtccgcccttacgtcgtaccncgtccggtaccgggcctccgtacggtcgtacggacggacggtacgtcctttacgtttattacgttctacttacttacaacttaacgacgaacgtaaccaaccacgttacgtcgttgggttacggtacggacgggtaacggtaccgacgttccggacccgttccggtacgttaccgaccggtacccgaaggtcccgtcccggtacccccgttggtaccctccgttccgttacccccg

SEQ ID NO: 8175 - DNA, 805 bp, Homo sapiens
  misc_feature: GYAE6OF01CO0NV.25.22.B11.1.454.CMB.1.raw
  modified_base (720)..(720): a, c, t, g, unknown or other
  misc_feature (720)..(720): n is a, c, g, or t
tcagactgtacagtcacgaccggtgctcgatttagacgacagctcagggaccctccaggcttgacgaagccctcccccagagttcccaggagtttccattcggtgatcagcactgaacacagaggactcacagtggaggtttgggctgagtcgttcgggtttttccttggttcgcttcgttagtaaaaggtcgtcctattgtcgaggtgcgtaggttggtgcgtaggttccggtagggggagtccgttcggtacgaacgtccgtaggggtaccgggttcccctaggacgtaccttccgtccgttagtagtaacgttcctcgtacggtacttcccaacctaactactaagtacgtaacctttactttacgcggtaccgtacggtaccggtcccgtacccgacggtccgtaccgggaaaggggtacgggtacgttagggtacgttaggttacttttaactaacgttttaagaacgttaaggttaaagtacgggttaaaaggttagttaacgtacgtttaaagtttacaacgttacccgtagtaaccgttccggaccgggtacccggccttacgttacctacccgttacctccgaaccgggtaacgggtaacccgtaaccggacctacgaacttccgttaaccttcgttacgacgtacgaacgttaggacccgtacggtcgaacggcgtaggtaccgtccggtactcgttagtcgtggtacgnggtagggttacgggtttggtaattaggtcgagtccgtagttaacggttccttaacccgtaccccttaacccggtatttaaacggg

SEQ ID NO: 8176 - DNA, 859 bp, Homo sapiens
  misc_feature: GYAE6OF01BLXK6.25.22.B11.1.454.CMB.1.raw
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
  modified_base (314)..(314): a, c, t, g, unknown or other
  misc_feature (314)..(314): n is a, c, g, or t
tcagactgtacagtcacgaccggtgctcgatttagacgacagctcaggggggggtctcaggaggcagcgctctcgggacgtctccaccatggcctgggctctgctgttcctcaccctcctcactcagggcacagggtccctgggcccagtctgccctgactcagcctgcctccgtgtctgggacctcctggacngtccgtcaccatcctcctgccactaggaacctgccgttagactattggtntcttaataactatcgtctcctcggtacccaacaaccaccagccaacgacccccaaatcattctatttagngtatgtacagtcagtccgtccctcgtaggtactttcgtcggtccgtcttcctgtacggtctccgtaagtcgtacggtacctaaccgttcccggtacccttccccgtacgaaccccgttacgtcccggttaccggggcccttacccgagggcccgttagggtagggaaccgtaacgggtacctttaacgttaacgttttacgttcgggtacccttttactttaccgtaacggtttaaacccgtaccgggtaaacggtaaacccccgtaaaccgtttaaacccggtacggttttaccgggtttaacggggtttcccgggttttaaccggggggtacccgggtaaacgggggttaaaccccggttaaagggttttccccgggtaaaacccccgggggttttcccgttacccgggggttaaccggtaaccgggttaccccccccgggtaaagggggtaaccccctttcccggggttaacccccccccgttacgggtttaaccccggtacccccttttcccgggttacccccccgggtttacccccccgg

SEQ ID NO: 8177 - DNA, 766 bp, Homo sapiens
  misc_feature: GYAE6OF01EXNSX.25.22.B11.1.454.CMB.1.raw
  modified_base (241)..(241): a, c, t, g, unknown or other
  misc_feature (241)..(241): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcacgtggaaccagtccgtagactagttggtntacttaataacttagtcgtctccgtcgtacccaaacaaccacccgaggaccaacgacccctaaactcatactatttactgtactcgtctacgtacaccggtccgtcccgttcggtaggttacgtttcggtcggtccgttcctttcgttccgtcggtaccttaccgtaacggtttccgtacggtaccgtaacccgttcccgggtaccccttcccgtaacgtacccgtacggttcccgggtccgggtcccttccggtacggtcgtacgggaaggtaccggtacggtaccttaagtttagttaacttcgtacttagtttaccgaactaaccgacgaactacccgtaaaccgaagtaccggttagttacgggttacgggttaccgggaacgggtaaccggtaaccgttaacggttcgtaaccccggttccgtacggtacccggaaccgtaacccggaaccggtcccgtacccccggtacccccggttcggtaaacccgtcccgttacccggttccccgttaccccccgg

SEQ ID NO: 8178 - DNA, 675 bp, Homo sapiens
  misc_feature: GYAE6OF01EJZAY.25.22.B11.1.454.CMB.1.raw
  modified_base (235)..(235): a, c, t, g, unknown or other
  misc_feature (235)..(235): n is a, c, g, or t
  modified_base (302)..(302): a, c, t, g, unknown or other
  misc_feature (302)..(302): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcaggacacagggtcctgggcccagtctggcctgactcaacctgcctccgtgtctgggtctccgtggacgtcaatcacctatttcctgcactggactcagcactgatgttnctaggtttattactttgtctcctgtaccaacaacaccagacaaccacccctaaattatactatttangtacggcctactaacggccggtcctacgaggttactttacatcgtacttctctgcctcgtaacgtcgtcggcacgccgtaccggtcctcccgtagacctaatccgtacggtcggcctaccggaggtccgtaggacggaaccggtggtaccgtagttactttaacgttacgtactcctacgtactaagttacgtacggtaaccaagtcctaaacaacccgttaacccttcccggttcccgttacggacccgggtacggtaacccgtaccgggtacccttcccggttaccggttccggaccgtaacccgacccggaacccgtacccccgacctaccgtaccgtacctacccttcgttccccgtccccttaccccg

SEQ ID NO: 8179 - DNA, 841 bp, Homo sapiens
  misc_feature: GYAE6OF01BI0IT.25.22.B11.1.454.CMB.1.raw
  modified_base (224)..(224): a, c, t, g, unknown or other
  misc_feature (224)..(224): n is a, c, g, or t
tcagactgtacagtcacgaccggtgctcgatttagacgacagctcgagggggggggtctcaggaggcagcgctctcgggacgtctccaccagtggcctgggctctgctgttcctcaccctcctcactcagggcacgagggtcctgggcccagtctgccctgactcagcctgcctcgtgtcgtgggactcctggacagtcgtcacatctctgactactggaaccngccgtagactagttggtactacttaataactatcgtctccgtacggtacccaaacgaaccacccgaaggaccaaccggacccccctaaaagtcctaattacctaagtttaactggtaacgtggtacctacgtacgtacgttccgggtcccttaggttacgggttagttttccggtgggtacccgttcgtttctccggttagggacccttaccgaagtttccggtacggtaacctaacccgttccgggtaccccttccgtaccggtaaccctacgttccgggtaccgggggtacctacccggtaacgggtcgttaacgggggacggtaaccggtaacggtacccgtttaaactttagtttacggttaccgtaccttaagttttacccaagtaaccgtaacggtaacgtaacccgtaaactaaccgtacggttaccggttagggttaccgggttacggggtacgggaaaccgggttaaccgttaaaggttaccggaaccccggtttaccggtaccgggtaacccggtaccggtaaaccccgggtaaggttcccgtacccccgggttaaccccgtccgggtaacccttcccgttacccgggttcccgttacccccccggg

SEQ ID NO: 8180 - DNA, 799 bp, Homo sapiens
  misc_feature: GYAE6OF01DGJFZ.25.22.B11.1.454.CMB.1.raw
  modified_base (172)..(172): a, c, t, g, unknown or other
  misc_feature (172)..(172): n is a, c, g, or t
  modified_base (185)..(185): a, c, t, g, unknown or other
  misc_feature (185)..(185): n is a, c, g, or t
  modified_base (275)..(275): a, c, t, g, unknown or other
  misc_feature (275)..(275): n is a, c, g, or t
tcagactgtacagtcacgaccggtgctcgatttagacgacagctcagggaccctccaggcttgacgaagcctcccccagagttcccaggagtttccattcggtgatcagcactgaacacagaggactcaccatggagtttgggctgagtcttgggtttttccttgttgcttnttagtaaaaggtntccattgtcgaggtgcaggtttggtcgcgaggtcggtaggggggagtcgtttcgcgaagccgtgggacgggttccctgacgactcttcgngtgaagtctcgtggattccaactatactaaatcgtacttaacgtttagcggaccttgggaaccttccggcgaacggtccgtaccggaagggggacggggtcgtagggtaaggttcggtaattttacaagttttagtactaggttaaagtgggtaaggttaactgggacttaaattttacaacgttccaacggtacgttccgtcccgggaagggggtccctactttaacccgacctacgttcccgtacggtaacggggaacctaaccgggtaaccctaaactaacgttaccgaaaccgttttcttaccgtaggaacttaaacggtacggtaaaccggtaccggtaacgaaccgggacccggaaacgggtacccgtaccgggtaccttacggtttacgttaccgtagggtacggtacgggtaagttaggggttttacggggtttaaattacggttagacggttcggaaccgtttacggtttaaacggttaccctttaacccgttaaaccccttggttaaaacccgg

SEQ ID NO: 8181 - DNA, 705 bp, Homo sapiens
  misc_feature: GYAE6OF01BLQ53.25.22.B11.1.454.CMB.1.raw
tcagactgtacagtcacgaccggtgctcgatttagacgacagctcagggggggtctcaggaggcagcgctctcgggacgtctccaccatggcctggctctgctgttcctcaccctcctcactcaggcacagggtcctgggcccagtctgccctgactcagcctgcctccgtgtctgggactcctggacagtcggtcaccatctcctgccactcggaacctaggccgtgactagtttgggtctcctttaataactagtgttcctccgttcggtaccctaacgaacctacccgaaggcctaaacggacccccaaactcaacttccgtatttatcgtactgttacaggtacacgtccggtccctagtcggtacgtttcgtcggttcgtcctttctcgtcgcctaccaagttctacgggtcctaaaccgtccggaccttccccgtagtaccctacgttccggtccggggaccttcccgaagggtccgtacgggtaacggtacggtacggactttaaccgtttagttaacgttcgtacttactttcaacgttaacgaacgtacgaaccctaacgaacgtagttcgttcggttggttaccggacgggttaaggaccttaaggtccgtacccgttcgtccggttacgaccggtacccgaacggtccctaccgggtcccccttacgggtacctcctccgttccggtacccccc

SEQ ID NO: 8182 - DNA, 717 bp, Homo sapiens
  misc_feature: GYAE6OF01DJFVV.25.22.B11.1.454.CMB.1.raw
tcagactgtacagtcacgaccggtgctcgatttagacgacagctcgaggggggggtctcaggaggcagcgctctcgggacgtctccaccatggcctgggctctgctgttcctcaccctcctcactcgagggcacgagggtcctgggcccagtctgccctgactcagcctgcctcgtgtcgtgggactccgtggacagtcggtacacctatcctccgtgacacgtacggaaccacgccgtgactagttgggtctacttaataacttacgtgttcctccgtaccggtaccccaaacaaccgacccgacggacgaaacccggacccccaaatcactactatttatgagtacgtacgagtaccacgtcccgtccttcgtaggttcttcgtcggtctcttctacgtcgtcctacgtagtcgtacgacctaccgtccgtccctccgtacgtacgacgttccggtcgggtcctacggacggtcgtacgggaacggtacgtacggtaacttactttacgttattcggtacttacgtttacaacgtacgagtaaccaacgtaacctaacggtaccgggtttcgtacgggttcggttcgggtacgggaacggtaaccgttacggtccggtaacccgtccggtcgggacctaccggtaccggtaaccggtccctaccccgggtaccccgttacgtacccttacccgttccgtttccccgttacccccg

SEQ ID NO: 8183 - DNA, 171 bp, Homo sapiens
  misc_feature: GYAE6OF02IESH0.25.22.B11.1.454.CMB.1.raw
  modified_base (170)..(171): a, c, t, g, unknown or other
  misc_feature (170)..(171): n is a, c, g, or t
tcagactgtacagtcacgaccggtgctcgatttagacgacagctcagggcccatcggtcttcccctggcgccctgctccaggagcacctccgagagcacagcggccttgggctgcctggtcaaggactacttccactgtacagtctgagcgggctggcaaggcgcatagnn

SEQ ID NO: 8184 - DNA, 172 bp, Homo sapiens
  misc_feature: GYAE6OF02H1KG3.25.22.B11.1.454.CMB.1.raw
  modified_base (170)..(172): a, c, t, g, unknown or other
  misc_feature (170)..(172): n is a, c, g, or t
tcagactgtacagtcacgaccggtgctcgatttagacgacagctcagggcccatcggtcttcccctggcgccctgctccaggagcacctccgagagcacagcggccctgggctgcctggtcaaggactacttccactgtacagtctgagcgggctggcaaggcgcatagnnn

SEQ ID NO: 8185 - DNA, 713 bp, Homo sapiens
  misc_feature: GYAE6OF02H92HE.25.22.B11.1.454.CMB.1.raw
  modified_base (288)..(288): a, c, t, g, unknown or other
  misc_feature (288)..(288): n is a, c, g, or t
  modified_base (343)..(343): a, c, t, g, unknown or other
  misc_feature (343)..(343): n is a, c, g, or t
tcagactgtacagtcacgaccggtgctcgatttagacgacagctcagggaccctccaggcttgacgaagcctccccagagttcccaggagtttccattcggtgatcagcactgaacacagaggactcaccatggagtttgggctgagctgggtttccttgttgctcttgtaaaaggtgtccattgtcaggtgcagttggtgcagtcgtgggggagcttcgtcaagcctgggagggtccctgagactctcctgtgaagtctctggattcaccatcaatgactactttanggcctggactccgccaggcctccgaggggaacggctggagtggatttcgatttancaagtaatcgggagtaatggacttaagttaataaactccgaagtacccttcgtacccggagggggtccctctttaccaacccgtacgttaccgtacccgaagggaacccgaacgggacccaaactaaactacctaaaccttccttttaccgtagtaccgaaacggttacggaaaccggtacggttaaccccggaacggacccgggaacgggaacccgaaccggggtcccggttacggttaacccgtttcgtacgggttcggaccgggtaaggttaggggtttacggggggttttaattacggtaggttaacgtcggtaccgtaacgggttacggtttaaccgtaaccccgttacccctactttaaaccgg

SEQ ID NO: 8186 - DNA, 523 bp, Homo sapiens
  misc_feature: GYAE6OF02F4169.25.22.B11.1.454.CMB.1.raw
  modified_base (318)..(318): a, c, t, g, unknown or other
  misc_feature (318)..(318): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
  modified_base (451)..(451): a, c, t, g, unknown or other
  misc_feature (451)..(451): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
tcagactgtacagtcacgaccggtgctcgatttagacgacagctcaggggggggtctcaggaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaacgcccccaaacttatcatttatgaggccactaagcgccctnaggagttctaatcgcttctctggctccaagtctggcagcacggcctcctgacaatctctggctccgaggctgacggacgnggctgtattattacngactactcatataggacactatcaactaaactcccgtnttaccggaccgtgggaacctgggtccaccgtccgtgggtccacgcccaaggccccaaacccgntacnctacc

SEQ ID NO: 8187 - DNA, 522 bp, Homo sapiens
  misc_feature: GYAE6OF02F0Q7M.25.22.B11.1.454.CMB.1.raw
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaactcatcatttatgatgtcagtcatcggccctctggagtttctggtcgcttctctggctccaagtctggcaactcggcctccctgaccatctcggggctccaggctgaggacgaggctacttattattgctatttcatacagagacaccaacagtctggtgttcggcggaggaccaagttgaccttccgtcggtcacgcccaaggcctcggcccctcggtccacttcctgttcccccg

SEQ ID NO: 8188 - DNA, 553 bp, Homo sapiens
  misc_feature: GYAE6OF02HIZQ8.25.22.B11.1.454.CMB.1.raw
tcagactgtacagtcacgaccggtgctcgatttagacgacagctcaggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtcccaacaacaccaggcaacggcccccaaactcatcatttatgatgtcagtcatcggccctctggagtttctggtcgtcttctctggctccaagtctggcagcacggcctccctgacaatctcgtcgggctccgaggctggacggacgagctgatttatactgctactcatagtcgacacatcaacaaactcccgtacttaccggacctacgggacctacggggttccacccggttccgtacggggtccaacggccccgtaacgggacccctaacccccacgttaccgtacctacccg

SEQ ID NO: 8189 - DNA, 557 bp, Homo sapiens
  misc_feature: GYAE6OF02JXBRW.25.22.B11.1.454.CMB.1.raw
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (429)..(429): a, c, t, g, unknown or other
  misc_feature (429)..(429): n is a, c, g, or t
tcagactgtacagtcacgaccggtgctcgattagacgacagctcagggttttctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcacgtggaacccngcccgtgacattggtgcttanaactatgtcctcctggtcccaaacaacacccaggcaacggcccccaaactcatcatttangatgtcagtcatcggcctntggtagtttcnggtcgcttctctggctcaagtctggcaacgtccggccctccctgacctagtccgtcggggctccgaggcgtaggaggacgaggtctaacttattattncttatttccatacagagacaccaactgtatgggtgttcggacgggaggacctaaggttcgaccgtccgtcggtctacggacccgtaaggtcctcggcccccttggcctaccgttccctcgttaccccc

SEQ ID NO: 8190 - DNA, 537 bp, Homo sapiens
  misc_feature: GYAE6OF02IROKR.25.22.B11.1.454.CMB.1.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctctggtcccaacaacacccagcagccccaaatcatcattatgatgtcagtcatcggccctctggagtttctggtcgcttctctggctccaagtctggcaactcgcctcctgaccatcgtcgggcctccgaggctgaggacgaggctacgttattattgctatttcatacagagacaccaacagtcgtaggtgttcgggcggtacgggacctaagttcgaccgttccgtcggttcacggcccaacggtcctacggcccccttcggtcctacttccgtccgttaccccc

SEQ ID NO: 8191 - DNA, 518 bp, Homo sapiens
  misc_feature: GYAE6OF02FU3U1.25.22.B11.1.454.CMB.1.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacaccaggcaaggcccccaaactcatcatttatgatgtcagtcatccggcctctggagtttctggtcgcttctctggctcaagtctgcaactcgcctcctgaccatcgtcgggctccgaggtctgaggacgaggtctacttattagttgctatttcatacagacgacaccaacagttcgtggtgttcggacggaggaccagttcgaccgtccgtcggtcacgcccagcctcgcccctcggtcactctcgtcccc

SEQ ID NO: 8192 - DNA, 576 bp, Homo sapiens
  misc_feature: GYAE6OF02G3HFL.25.22.B11.1.454.CMB.1.raw
  modified_base (300)..(300): a, c, t, g, unknown or other
  misc_feature (300)..(300): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggtctcctggacagtcgatcaccatttcctgcactggactcagcactgatgttgcaggtttattactttgtctcctggtaccaacaacacccaggcaaagcccccaaacttatcatttangaggccactaagcggccctcaggtatttctaatcgcttctctgctccagtctggcagcacggcctcctgacatctctggctcgaggctggaggtacgaggctgattattactgcttactcatagtggacacataccaactaaacttccccgttacttaccgggaccttggggaacccagggtccctaacccgggttccgtcggggttaccaacggtacccccgaagggtacccccaacccccggtacgttccggtaccctaccttccgttccccgg

SEQ ID NO: 8193 - DNA, 543 bp, Homo sapiens
  misc_feature: GYAE6OF02IUEC2.25.22.B11.1.454.CMB.1.raw
  modified_base (453)..(453): a, c, t, g, unknown or other
  misc_feature (453)..(453): n is a, c, g, or t
  modified_base (525)..(525): a, c, t, g, unknown or other
  misc_feature (525)..(525): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccagcaacggcccccaaactcatcatttatgatgtcagtcatcggcctctggtagtttctggtcgcttctcgtcggtctccaagtctggcaacgtcgcctccctgaccatccgtcgggcctccgaggctaggacggacgacggtacttacttattattgtctatttcatacagacacaccaacngtctggtcgtcggacggtaggaccagtcgaccgttcgtcggtacacgacccgaggcctccgcccgtcgtccncgttccgtccgttccccg

SEQ ID NO: 8194 - DNA, 532 bp, Homo sapiens
  misc_feature: GYAE6OF02HDP0A.25.22.B11.1.454.CMB.1.raw
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
tcagactgtacagtcacgaccggtgctcgatttagacgacagctcagggaccctccaggcttgacgaagcctcccccagagttcccaggagtttccattcggtgatcagcactgaacacagaggactcaccatggagtttgggctgagctgggttttccttgttgctcttgtaaaaggtgtccattgtcaggtgcagttggtgcagtctgggggaggcttcgtcaagcctggagggtccctgagactctcctgtgaagtctctggattcaccatcaatgactactttatggcctggatccgccaggctccgagggaagggctggagtggatttcgatttancagtaatggagtaatggctatttanaatcagactctccgagggccnctcacatctccaggacaacggccacaatcaacttctttctcgcaagtagaacgacgtccgagccgacgacgaaggaccgtatacttcgtgtgcgagtaggttggggttattagtgtatgcaggtgttatacctaccctactaacg

SEQ ID NO: 8195 - DNA, 546 bp, Homo sapiens
  misc_feature: GYAE6OF02ICQM6.25.22.B11.1.454.CMB.1.raw
  modified_base (236)..(236): a, c, t, g, unknown or other
  misc_feature (236)..(236): n is a, c, g, or t
  modified_base (324)..(324): a, c, t, g, unknown or other
  misc_feature (324)..(324): n is a, c, g, or t
  modified_base (533)..(533): a, c, t, g, unknown or other
  misc_feature (533)..(533): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttataactatgtctcctggtcccaaacaaccacccaggcaacggcccccaaactcaatcattttatgatgtcagtcatccggccctntggtacgtttctggtcgtcttctctggtctcaagtctggcctaacgtccgcctcccgtgacctacgtccgtcgggcctcccgaggcgtggacggacgacggtctaactttattattgctatttcatacagagacaaccacagtctggtgttcggcggacggacagttcgaccgtccgtcggtcacgcccgaagcctcgcccctggtccncttcctcgtcccc

SEQ ID NO: 8196 - DNA, 557 bp, Homo sapiens
  misc_feature: GYAE6OF02HSAOV.25.22.B11.1.454.CMB.1.raw
  modified_base (237)..(237): a, c, t, g, unknown or other
  misc_feature (237)..(237): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttaataactatgtctcctggtcccaacaacaccaggcaacggacccccaaactcatctatttatgatgtcagtcactcggccctcgggtgtagtttctggtcgtcttctcgtggctccaagtctggctaactccgcctcctgacctatcgtcgggcctccgaggtctgaggacgaggcttaacgttattagttgtctatttcatacagacgacaaccaactagtcgtggtcgttcggcggaagggacctaagttcgaccgtccgtcggtccacggacccaaggcctaccgccccgtcgtcctacttccgtccgtacccc

SEQ ID NO: 8197 - DNA, 787 bp, Homo sapiens
  misc_feature: GYAE6OF02IZGVC.25.22.B11.1.454.CMB.1.raw
tcagactgtacagtcacgaccggtgctcgatttagacgacagctcagggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtcccaacaacacccaggcaacggcccccaaactcatcatttatgatgtcagtcatccggccctcgtggtacgtttctggttccgtcttcttcgtcggtccttaccgtaagttccgtacgggacctaaaccgtccgggtccccttccccgtacggacccctagttcccggtacccgggggtcccttacccggaacgggtccgttacgggaaacggggtaacccgggtaacggggtacccttttaaaccggttttaaacgttttaacgtttacggtacctttaacgtttttaccgaaactttaaccgaacgggtaaacgtaaaccctaaacccgtaaacgtaacggttccgttacggggtttacgtttacccggggacgggtaacgggtaacccgtaacgggtttaccggtaacccggtttcccggttaccgggttacccgaaccggtacccccggtaaacgggtcccgttacccggtacccccccgttacgggtaccctacccggtttacccgttcccggtttaaccccccc

SEQ ID NO: 8198 - DNA, 728 bp, Homo sapiens
  misc_feature: GYAE6OF02J12WS.25.22.B11.1.454.CMB.1.raw
tcagactgtacagtcacgaccggtgctcgatttagacgacagctcaggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctgtcccaacaacaccaggcaacggcccccaaactcatcatttatgatgtcagtcatccggcctcgtggtacgtttcgtggtcgtcttctcgtcggccttaccgtaagtcgtcggacctaaccgtccggtccccttacccgtcggaccctacgttccgtccgggggtccctcccggtaagggccgttacgggaacgggtaccggtacgggtacctttaaccgttttaagtttaacgtttcggtaccttaattttaccgaacgtttaacgaacggtaacgtaaccaacccgtaaacgttaacggttccgttagggtttacggttaccggggaccgggtaacggggtaaccgttaacgggtttccggtaacccggtttcccgttccgggttaccaaccggtacccggtaacggtcccgttacccggtaccccccgttcgggttaccctaccgttttcccgtacccggtttaccccccg

SEQ ID NO: 8199 - DNA, 588 bp, Homo sapiens
  misc_feature: GYAE6OF02GA3CZ.25.22.B11.1.454.CMB.1.raw
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttanaactatgtctcctggtcccaacaacacccaggcaaggcccccaaacttatcatttangaggccactaagcggcctcaggagtttctaatcgcttctctggctccaagtctggcagcacggcctccctgacaatctctggggcctccgaggcctggacggacgaggctgtattattactgctactcatatggacacactacaactaaacttcccgttcttccgggaccttcggggaaccctacggggtcctaacccggttccgttcggggtaccaaccgggcccctaaacgggccccaaacccccgtcgttaccggtacccacccttccgtaccgtttcccccccgg

SEQ ID NO: 8200 - DNA, 535 bp, Homo sapiens
  misc_feature: GYAE6OF02HC95P.25.22.B11.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctccngcactcggaaccngcccgtgactagttgggncttataactntgtctcctggtcccaacaacacccagacaacggcccccaaactcatcatttatgatgtcagtcactcggccctctggtacgtttctggtctcttctctggctccagtctggcactcggcctcctcgacctagtcgtcgggctccgaggctggaggacgagtacttacttattattgtctagttcatacagagaccaaccaatacgtgtggttgtcggcggagtacagtcgaccgtcgtcggtcagtaccgacgcgtccgccccgtgtctacgtccgtcgttcccc

SEQ ID NO: 8201 - DNA, 542 bp, Homo sapiens
  misc_feature: GYAE6OF02G27V0.25.22.B11.1.454.CMB.1.raw
  modified_base (337)..(337): a, c, t, g, unknown or other
  misc_feature (337)..(337): n is a, c, g, or t
  modified_base (397)..(397): a, c, t, g, unknown or other
  misc_feature (397)..(397): n is a, c, g, or t
  modified_base (436)..(436): a, c, t, g, unknown or other
  misc_feature (436)..(436): n is a, c, g, or t
tcagactgtacagtcacgaccggtgctcgatttagacgacagctcagggaccctccaggcttgacgaagcctcccccagagttcccaggagtttccattcggtgatcagcactgaacacagaggactcaccatggagtttgggctgagctgggttttccttgttgctcttgtaaaaggtgtccattgtcaggtgcagttggtgcagtctgggggaggcttcgtcaagcctggagggtccctgagactctcctgtgaagtctctggattcaccatcaatgactatttatggcctggatccgccaggctccagggagggctggagtggatttcatttancagtaatggagtaatggctatttataatccagtactcgtccggaggggcccgcttcaccntcctccgagggaccaacggccacaactcaacttctttcngcaagtgaacgacgtccgagccgagacgacggccgtgtacttctgtgcgaggtaggttggggttattagtgatgcctaggttcggttactaccctacccctataac

SEQ ID NO: 8202 - DNA, 554 bp, Homo sapiens
  misc_feature: GYAE6OF02H5AU9.25.22.B11.1.454.CMB.1.raw
  modified_base (335)..(335): a, c, t, g, unknown or other
  misc_feature (335)..(335): n is a, c, g, or t
  modified_base (438)..(438): a, c, t, g, unknown or other
  misc_feature (438)..(438): n is a, c, g, or t
tcagactgtacagtcacgaccggtgctcgatttagacgacagctcaggggggggggtctcaggaggcagcgctctcgggacgtctccaccatggcctgggctctgctgttcctcaccctcctcactcagggcacagggtcctgggcccagtctgccctgactcagcctgcctccgtgtctgggtctcctggacagtcgatcaccatctcctgcactggaatcaaccactgatgttgctatttcatgtaccttgtctcctggtaaccaacaaccaccccgacaaacgccccaaactcatgatttatgagggcactacgcggcctcgaggggtttcngctcgtcttctctcggctccaagtctggacaacgtcgcctcctgactacttctctcggtctccgaggctgaggacgaggctgtactttattactgtcctttcncactatggtcggcagtacgcttagttgggtgttcgggcaggacggacctaaggtcgtacccgtcgtcgggtccacggtacccgaacggccgtccggtcccccgttcggtcctaccg

SEQ ID NO: 8203 - DNA, 777 bp, Homo sapiens
  misc_feature: GYAE6OF02G70NM.25.22.B11.1.454.CMB.1.raw
  modified_base (237)..(237): a, c, t, g, unknown or other
  misc_feature (237)..(237): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttaataactatgtctcctggtcccaacaacacccaggcaacggcccccaaactcatcatttatgatgtcagtcatccggccctcgtggtagttttccgtggttccgtctttccttcgtcgggtccttccctaaaggttcctacgggacctaaaccgttccgggtccccttccccgtacgtaacccctacgttcccgtccggggggtcccttacccggacgggtcccgtacgggaacgggtaaccgggtaacggggtacctttaaccttttaagtttaacgtttacgtaccttacgttttaccaaacttaaccgaacggtaacgtaaccctaaacccgtaaacgtaacggttaccgtttaggggtttacgggtttaccgggggaccggggtaaacggggtaacccgttaaacgggtttccgggtaacccggtttacccggttccggggtaacctaccgggtaccccgaacgggtcccttacccgggtcccccccgttaccgggttaccctacccgtttcccgttacccggttccccccgg

SEQ ID NO: 8204 - DNA, 740 bp, Homo sapiens
  misc_feature: GYAE6OF02JIR54.25.22.B11.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
tcagactgtacagtcacgaccggtgctcgatttagacgacagctcagggggggtcgtcgaggaggcagcgctctcgggacgtctccaccatggcctgggctctgctgttcctcaccctcctcactcagggcacagggtcctgggcccagtctgccctgactcagcctgcctccgtgtctgggactccgtggacagtcggtcaccattctcctgccatcggaaccagccgtgactattggtncttaataactatcgtactcctggtcccaanaaccacccaggcctaacggcccccaaactcactcaattttancgtatgtcagtcatccggaccctgtggtacgttttcngggttcgcctttctcgtcgggttcctcctaacggtttcgtacgggtacctaaaccgttcccgggaccctttccccgtagtaacccctaagttccccgtccgggggtacccttcccgaagggtccttacgggacgggtacggacggttaccgttaacgtttaccgtttaagtttcggacctttaagttttccaagtttaaccgaagtaacgaaaccgtaacctaaaccgtacgtttacgttagggttacgtttaccggggacggtaacgggtacccggttaaaggttccggacccggttaccgttccgggtactaacggaaccccgtagggtaccccgttacggtacccccttgggttaacccctcgttacccgtttccggttaccccccg

SEQ ID NO: 8205 - DNA, 766 bp, Homo sapiens
  misc_feature: GYAE6OF02JGKK6.25.22.B11.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
tcagactgtacagtcacgaccggtgctcgatttagacgacagctcgagggggggggtctcaggaggcagcgctctcgggacgtctccaccatggcctgggctctgctgttcctcaccctcctcactcagggcacagggtcctgggcccagtctgccctgactcagcctgcctcgtgtctgggacctcctggacagtcggtcaccatctcctgcactggaaccngccgtgacattggcncttaanaactntgtctcctggtccaacaacaccaggacaacggcccccaaactcactctatttacngtatgtctacgtcacgtccggcctactggtacgttttctcggtacgtccttctcgtgtctaccgtaaggtctaggcctaaacgtccggtaccctccttacgtacctacgttccgtccggggcttaccgagggtcccttagggaacggaccggagggtcctttaacgttactttaacgtttcgtaccgttaattttacccgaaagttacccgaagggaaccgtaaaccgtaaaccctaaacgttacgggtttacccggtttgggggttaccgtttaccgggggaccgggtaaaacggggttaacccttaaccggggtttacgaaacccccggtttccgggtttaacccggtaaccgaaccggggttaacccccgaaagggtttccccgttaaccccgggtcccccccggtttacggtaacccgtttaaccccggtttccgtttcccccgggttacccccccgg

SEQ ID NO: 8206 - DNA, 599 bp, Homo sapiens
  misc_feature: GYAE6OF02GCZJA.25.22.B11.1.454.CMB.1.raw
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcacgtggaccagccgtgacattggtncttanaactntntctcctggtccaacaacaccagcaacggccccaaactcatcatttatgatcgtcagtcacgtcggccctctggtagtttctggtcgtcttctctggctccaagtctggccaacgtcggccctccctgacctattcggtccgggtcctccgaggtctagggacggacgacggtctacttagttattcgacttactttcatacagtaacgtaaccaaccctaacgtacgttcttacgggttcgtcgggacggacgggtaccgtaggttcgaccgttccggtcggtcgtaccggtccgaacggtcctcccggtccccgttaccggtcctaccgttccgtccggttccccccg

SEQ ID NO: 8207 - DNA, 170 bp, Homo sapiens
  misc_feature: GYAE6OF02GHA50.25.22.B11.1.454.CMB.1.raw
  modified_base (170)..(170): a, c, t, g, unknown or other
  misc_feature (170)..(170): n is a, c, g, or t
tcagactgtacagtcacgaccggtgctcgatttagacgacagctcagggcccatcggtcttcccctggcgccctgctccaggagcacctccgagagcacagcggccctgggctgcctggtcaaggactacttccactgtacagtctgagcgggctggcaaggcgcatagn

SEQ ID NO: 8208 - DNA, 781 bp, Homo sapiens
  misc_feature: GYAE6OF02IBGG7.25.22.B11.1.454.CMB.1.raw
  modified_base (194)..(194): a, c, t, g, unknown or other
  misc_feature (194)..(194): n is a, c, g, or t
  modified_base (240)..(240): a, c, t, g, unknown or other
  misc_feature (240)..(240): n is a, c, g, or t
tcagactgtacagtcacgaccggtgctcgatttagacgacagctcaggggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacngtcgtcaccatctcctgcactggaaccagccgtgaactagtttggngtcttaagtaacctatcgtcttccgtcggttaccccaaaaccaaccacccgaaggaccaaaccgggaccccccaaaacttaccaacttacctaattttaatcggtaattcgtccaagttacaacgttcccggtacccttacgtacggttacgttttcgtggttccgtcctttccgtccgtggtccttaccgaagttccgtcggaacctaacgtcccggtacccttccgtacgtacctacgtccggtaccggggtcctaccggacggtaccgtagggtaacggacggtacgggtaccttaaacgtttagtttaacgttacggtacttaacttttaccgaacgtttaccgaaacgaacgtaaaccctaaacccgtaacgttaacgttaaccggtttcgggttacggtttaccggggacgggttaacgggtaacccgttaaggttcccggtaacccggttccggtaacggtacccgacggtaacccgacggtacccgtcccgtacccccgttcggtaccctaccttccgttccgttaccccccg

SEQ ID NO: 8209 - DNA, 738 bp, Homo sapiens
  misc_feature: GYAE6OF02I3RZP.25.22.B11.1.454.CMB.1.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaanaactntgtctcctggtcccaacaaccacccaggcaacggccccaaactcatcatttatgatgtcagtcatccggcctctggtagtttcgtggtcgtctttccgtctcggccttccaaggttccgtcggtacctaaccgtccggtcccttccccgtagaccctacgttccgtccgggggtcctacccggtaaggtccgtagggaaccgggtaaccgggtaacgggttcctttaggtttttaacttttccggttacgttccggtttcggtttacgtccgtttagttcgggttcggtaccgttaacggtaaaaaaccgttaaggttttggggttacgttcccggtttacgggggaccgggtaaaccggggtaacccttaaggtttccggtaacccggtttacgtttaaacggttcccgtaaccggtaacccgtaaggtcccgtacccggtcccccggttacccggttccctacccgttccgttacccgttaccccccg

SEQ ID NO: 8210 - DNA, 638 bp, Homo sapiens
  misc_feature: GYAE6OF02GWBHD.25.22.B11.1.454.CMB.1.raw
tcagactgtacagtcacgaccggtgctcgatttagacgacagctcagggaccctccaggcttgacgaagcctcccccagagttcccaggagtttccattcggtgatcagcactgaacacagaggactcaccatggagtttgggctgagctgggttttccttgttgctcttgtaaaaggtgtccattgtcaggtgcagttggtgcagtctgggggagcttcgtcaagcctggagggtccctgagactctctgtgaagtctctggattcaccatcaatgacttactttatggcctggactccgcaggctccgagggagggctggagtggatttcgatttactcagtaagtggaagtatggactattatactacagacttcgtccggacggggcctcgttccaccgtatcctacgacgggaccaaccggccaacaactacctaacttccttactacgacgtaacgtacgtaaccggccgtaccggacggaccggaacggtaaccgaccgggtccgttagttaccttcgtcgttacggtaccgtaagggtaggggtttaggggtttaatttacggtgtaacgttcggtaccgttacgggtttacgttaacccgttaaccccgttaccctacgtttaaaccgg

SEQ ID NO: 8211 - DNA, 692 bp, Homo sapiens
  misc_feature: GYAE6OF02I0Q9U.25.22.B11.1.454.CMB.1.raw
  modified_base (204)..(204): a, c, t, g, unknown or other
  misc_feature (204)..(204): n is a, c, g, or t
  modified_base (265)..(265): a, c, t, g, unknown or other
  misc_feature (265)..(265): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
tcagactgtacagtcacgaccggtgctcgatttagacgacagctcagggaccctccaggcttgacgaagcctccccagagttcccaggagtttccattcggtgatcagcactgaacacagaggactcaccatggagtttgggctgagcttgggttttcctgttgctcttagtaaaggtgtccattgtcaggtgcagttgtgacnggtcgtgggggagtctcgtcaaagtccgtgggtacgggtccctgacgtacctcctccgtgngaatcgtacgtggacttccacctaatccaaagtcgtacttacgttagtcggcccttaggactcccgaccngggcctacggaacggggaacgggtntgggagtggtatttgtacgtttangtaacgtaagtgggtaaggtactggtaactagttaataacgcgtaagctcgaccggcgggacctcgtacaccgtatccgtacgacggaccaacggccaactaacgtaccacgttaccttcgagtacctaagtacgaaccggtaccgtaccggacgccggaacggtaaccggtcccgggtaccgttagtacgttaccgtcgtacggtacgtacggttacggggtttagggtttaactacgtacggttacgtacggtacgtaggtttacgggttaacccttaaccccgttacccgttaaccttaaaccgg

SEQ ID NO: 8212 - DNA, 818 bp, Homo sapiens
  misc_feature: GYAE6OF02I3Y37.25.22.B11.1.454.CMB.1.raw
tcagactgtacagtcacgaccggtgctcgatttagacgacagctcaggggggggggtctcaggaggcagcgctctcgggacgtctccaccatggcctgggctctgctgttcctcaccctcctcactcaggcacagggtcctgggcccagtctgccctgactcagcctgcctccgtgtctgggactcctggacagtcggtcaccatctcctgcactggaaccagccgtgactagttggtgtacttaataactatcgtctcctcggtcccaaacaacaacccagcaacggccccaaaactcatcatttatgatgtcagtcactcggccctctggtagtttcgtggtcgtcttctcgtcggtctacctaaagtcgtggacctaaacgtccggtcccttcccgtacgaaccctacgtccggtccggggtacccttccgacgggtcctagggaacgggtaacggacgggtacctttaactttaagtttaacgttacggtaccttaacgtttttacctaaacgttaaccgaaaggtaaccggtaaaccctaaaaccccgtaaaaccgtacggtttaaccggttacggggtttacggggttttacccgggggaacccgggggtaaacgggggtaaaacccgttaaacggggtttacccggtaaccccgggtttacccggtttacccggggttaacccgaaaccgggttaacccccgggtaaaaccggggttccccgttaaccccgggttacccccccccgggtttaccggggttaccccgtaaccccggttttacccgttttaccccgggtttacccccccccgg

SEQ ID NO: 8213 - DNA, 527 bp, Homo sapiens
  misc_feature: GYAE6OF02F3VUT.25.22.B11.1.454.CMB.1.raw
  modified_base (319)..(319): a, c, t, g, unknown or other
  misc_feature (319)..(319): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagcccgtgacattggtgcttataactatgtctcctggtcccaacaacacccaggcaaggcccccaaatcatcatttatgatgtcagtcatcggccctntggtagtttctggtcgcttctctggctccagtctggcaactcgcctcctgaccatcgcgggctccgagctgaggacgaggctacttattattgctatttcatacagacacaccatagtctggttcgttcggcggagggacctagttcgaccgtccgtcggtcacggcccaaggcctccgccccgtggtccaccgttctcgttaccccc

SEQ ID NO: 8214 - DNA, 663 bp, Homo sapiens
  misc_feature: GYAE6OF02FUZOM.25.22.B11.1.454.CMB.1.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatctcctgcactggaaccngccgtgacattggngcttaataactntgtctcctggtcccaacaacaccaggcaacggcccccaaatcatctatttatgatgtcagtcatccggccctcgtggtagttttcgtggtcctcttctcgtcggtcctaccgtaagtcgtcggactaacgtccggtcccttcccgtgaccctagttccgtccggggtctcccgaggtccgtagggaacggaccgacggtaccttaactttagttacgttcgacttatttaccaattacgagtaacgaaccaaccgtaacgtacgttcgttacgggttacgttaccgggacgggaacggttaacctaagggtttccgaacccggttcccgttaccggtacgaaccggtacccgtaacggtccgtacccggtcccccggttaccggtccgtacccgtttccgtacccggtttcccccg

SEQ ID NO: 8215 - DNA, 592 bp, Homo sapiens
  misc_feature: GYAE6OF02INJDC.25.22.B11.1.454.CMB.1.raw
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
tcagactgtacagtcacgaccggtgctcgatttagacgacagctcaggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatccaccactgatgttgctatttcatgtaccttgtcctcctcggtaccaacaaccaccccgaacaaacgcccccaaatcatagtattagngaggcaacgtaacgccggccttacgacgggtttcngctcgtcttctctgctcagtcngacaacgtcgcctccgtgactaactctctcgtctccgaggtctaggacggacgaggtctagtattacttactgtccttctcacgtagtcggtacgtacgacgtagtccgtacggttgggttacgttcgggacgtaacgggtacgggtaaccgtaaacggtcggtaacccggttccggtacgggtccgaccggtacccgaacggtcccgtccggtcccccgtaccgg

SEQ ID NO: 8216 - DNA, 526 bp, Homo sapiens
  misc_feature: GYAE6OF02F3RTM.25.22.B11.1.454.CMB.1.raw
  modified_base (222)..(222): a, c, t, g, unknown or other
  misc_feature (222)..(222): n is a, c, g, or t
  modified_base (302)..(302): a, c, t, g, unknown or other
  misc_feature (302)..(302): n is a, c, g, or t
  modified_base (434)..(434): a, c, t, g, unknown or other
  misc_feature (434)..(434): n is a, c, g, or t
  modified_base (516)..(516): a, c, t, g, unknown or other
  misc_feature (516)..(516): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtgctttaataactatgtctcctggtcccaacaacacccaggcaacggcccccaaactcatcatttangatgtcagtcactccggcctctggtatttcgtgtctcttctcgtcgctcagtctcggcacgtccgcctccgtgaccagtccgtcgggctccgaggtcgtaggacggtacgacggtacttacttattacgttnacttactttcatacagacgacacatgtctggtcgtcgcggagactagtcgaccgtcgtcgcacgccgagctcgcccgtgtcnctctctaccc

SEQ ID NO: 8217 - DNA, 964 bp, Homo sapiens
  misc_feature: GYAE6OF02H85XR.25.22.B11.1.454.CMB.1.raw
tcagactgtacagtcacgaccggtgctcgatttagacgacagctcaggggggggggtctcaggaggcagcgctctcgggacgtctccaccatggcctgggctctgctgttccctcaccctcctcactcgagggcacagggtcctgggcccagtctgccctgactcagcctgcctccgtgtcgtgggactccgtggacagtcggtcacctatctcctgcacgtcggaaccacgccgtagacctagttgggtagactttaataacctatcgtcttccgtcggtaccccaaacaacctaaccccaggtaccaaacgggacccccctaaaacgttcctaaacgttacctaacgtttttaacgtagttaacgttcggtacctaacggtttaccgaacggttcccgggtaccccttacggttcgggtttaacggttttaccgttcggggttaccgtccgttttacccgttccggtttacggggtacccttaacccgttaaaacgggtttccgttacggggtaaaccccttaaacccgggtttccccgggtaccccgtttaccccccggtttaccgggtaacccccctaaacgggttttccccgggtaccccgggggggtacccctttaccccgggtaaaccgggggttccccggttaaacggggaaaccgggggttaaacccgggaaccggggttaaccgttttaaaccggttttaaactttttaacggtttaccgtttaccctttaacgttttaccgtaaacgtttaaccggaaacggttaaccgaaaccctaacccgtaaacgttaccgggttcgttacggggttacgggttacgggacgggtaaaccgggtaaccgttacgttacggtacccggttccggtacggtaccgtaaccggtacccgtaaccgggtccttaccccggcccctttaccgggaccttaccgttcccggttccgttaccccccg

SEQ ID NO: 8218 - DNA, 868 bp, Homo sapiens
  misc_feature: GYAE6OF02GOOIV.25.22.B11.1.454.CMB.1.raw
  modified_base (226)..(226): a, c, t, g, unknown or other
  misc_feature (226)..(226): n is a, c, g, or t
tcagactgtacagtcacgaccggtgctcgatttagacgacagctcagggggggggtctcaggaggcagcgctctcggggacgtctccaccatggcccgggctctgctgttcctcaccctcctcactcagggcacagggtcctgggcccagtctggccctgactcagcctgcctccgtgtcgtgggactcctgacagtcggtcacactctcctgcacgtcggaaccngccgtgactagttgggtacgtctttaagtaacttagttgtcctaccgttccggttaccccaaactaacccgaccccgtaagggaccgtaaaccggtaccccccaaaacttccgacttacctacgttttaacgtacggtaagttcgtacgtacgtccacgttacccggtcccgttacggttcggttacgttttaccgtcgggttaccgttccgtttccgtacgtacgggtccttaccgtaacggttccggtacggaacccgttaccgtccgggtacccttacccgttacggtaaccctcggtttccggtaccgggtcccgttaccgggtaccgggtcgttacgggaacccgggtacgggtaccggttaccgtttaaccgtttacggtttacgttacggttaccgtttaacgtttacgtaacgttaaccgttaacgaccggttaaccaaccggttaaccgtacggttaccgttcggggttacggttaccggggaacgggtaaacggtaccggttaacggttccggtacccggttcccggttacgtaccggtacccggtacccggtaaccggttaccgtacccggtttaccccggtaccggttacccgacccgtttcccggttacccgtacccctttaacccccg

SEQ ID NO: 8219 - DNA, 820 bp, Homo sapiens
  misc_feature: GYAE6OF02IOEUS.25.22.B11.1.454.CMB.1.raw
  modified_base (193)..(193): a, c, t, g, unknown or other
  misc_feature (193)..(193): n is a, c, g, or t
tcagactgtacagtcacgaccggtgctcgatttagacgacagctcgaggggggggggtctcaggaggcagcgctctcgggacgtctccaccatggcctgggctctgctgttcctcaccctcctcactcagggcacagggtcctgggcccagtctgccctgactcagcctgcctccgtgtctggactctggacngtcgtcaccatctctgcactggaaccaggccgtagactagtttgggtcgtactttaaataaccttattcggttccttcccgttacgggttacccccaaaaccaaacccgtaacccccaaggggaccccaaaaccgggaacccccccctaaaaacttccaaactttacctaactttttaacgtacggtaaacgttcggtacctaacggttaccctaacgttcccggggtccccctttcggttacggggtttaacgtttttccggttcgggttccgttcctttccgttcgtcggtccttaccgtaaggtttccgtacggtacctaaccgttccggcccttaccccgttcgaaacctcgttccgtaccggggctacccgacggtccgtaggaacgggtacggtacggtaccgttacttttaagtttacgttgttaccttattttaccgaattaaccgaagtacgaacccgaaactaaccgtcgttaacggttcggttacggttcggggaacggtaacggtacgtaacggttacggtacccgttccggttccggtacctaccggtaccgtacggtccgttacccggtccccggttcggtacccgtacccttcccgttacccgttacccccg

SEQ ID NO: 8220 - DNA, 701 bp, Homo sapiens
  misc_feature: GYAE6OF02JLVK0.25.22.B11.1.454.CMB.1.raw
  modified_base (194)..(194): a, c, t, g, unknown or other
  misc_feature (194)..(194): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcaggcacagggtcctgggcccagtctgccctgacctcagcctgcctccgtgtcgtgggactcctggacngtcggtcaccatctcctgcacgtggaaccagccgtnacattggtnacttataactatgtctctcggtccaacaaccaccgagcaacggacccccaaactcatcctatttatgtatagtcagtcaacgtccggacctcgtggtacgtttcgtggtccgtcttctcgtcggtctacctagtctacggtcaacgtccggtccctccgtcgtaccatccggtaccggggtctaccgagggctacgggacggacggtacgaccttaacgtttaactttagttcgtacttactttacgtaacttaccgaaggttaaccgaaccgaaccctaaaccgtagttccgttacgggttaccgggttaccggggtaccgggaacgggacctttaaacggggttccgtaacccggttcccgttaccgggtacgtaacccgggtaaccccgtaaggtcccgttaccccggtcccccggtacggttaccctacccggtttacccgttcccggttccccccgg

SEQ ID NO: 8221 - DNA, 806 bp, Homo sapiens
  misc_feature: GYAE6OF02I6Q9S.25.22.B11.1.454.CMB.1.raw
tcagactgtacagtcacgaccggtgctcgatttagacgacagctcagggaccctccaggcttgacgaagccctcccccagagttcccaggagtttccattcggtgatcagcactgaacacagaggactcaccatggagtttgggctgagcgttgggttttccttgttgctcttagtaaaaggtgtccattgtcaggtgcaggttggtgcgagtcggtggggggaggtcgttcggtacaaacggccgtgggaggggtcccctggagacttcctcctgtagaacgtcttcgtggacttcacctatcaatgtaccttacttttagcggtcctgggactcccggcccgtaggccgtccggaagggggacggggcgttgggagttggtactttactaagtttacaccgtaaggtaagtgggtaagttaacgtggtactttaatttaactaaactccgaacgtacctccggtaccgggtaccgggggtcccgtaccttacccggaaccctacgttccccgtacccggaagggaaccccgtaaaccgggtacccaaacgtaacctaccgtaacctttccgtttacctcggtaaccgttaaacgtacggtaaaccgggtaccggtacccgaacggtaacccgggaagggacccgtaaccggggtacccgttaagttaccccgtttagtacgggttacgtacgggtacgggtttagggggttttacggggtttattaacgtggtacggttacggtacccgttaagggttaccgtttaaccctaaccccccgtttacccgtaacgttaaaacccgg

SEQ ID NO: 8222 - DNA, 774 bp, Homo sapiens
  misc_feature: GYAE6OF02GSNLX.25.22.B11.1.454.CMB.1.raw
  modified_base (222)..(222): a, c, t, g, unknown or other
  misc_feature (222)..(222): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggtgacttataactatcgtcctctggtacccaacacaccaggcaacggaccccaaatcatctattatgatgtacagtctagtcggcctcgtggtagttttcgtggtctctttcgtcgtcggccttacgtaagttcgtacggtacctaaccgtccggtccctacccgtacgacccgtagtccggtccggggtcctacccggacggtcgttacgggaaacgggacggtaaccgggtacctttaaacgtttaacgttacgtttacggactttacgtttaccgtaacttaacgtaacggtaaccgtaaacctaaacccgtaaaccgttacggttaccggtttacggggtttacgggtttaccggggaacgggtaaaccggggttaacccgttaaacggggtttccgggtaaccccggtttacccgggttaccgggttaacccgtacccgggtaaccccgtaaccgggttacccgttaccccgggtacccccccggttacgggttacccctaacccggtttcccgttacccggtttaccccccccg

SEQ ID NO: 8223 - DNA, 570 bp, Homo sapiens
  misc_feature: GYAE6OF02JLVQM.25.22.B11.1.454.CMB.1.raw
  modified_base (338)..(339): a, c, t, g, unknown or other
  misc_feature (338)..(339): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (431)..(431): a, c, t, g, unknown or other
  misc_feature (431)..(431): n is a, c, g, or t
tcagactgtacagtcacgaccggtgctcgatttagacgacagctcagggaccctccaggcttgacgaagcctcccccagagttcccaggagtttccattcggtgatcagcactgaacacagaggactcaccatggagtttgggcttagctgggttttccttgttgctcttgtaaaaggtgtccattgtcaggtgcagttggtgcagtctgggggaggcttcgtcaagcctgggagggtccctgagactctcctgtgaagtctctggattcaccatcaatgacttcttatggcctggactccgcagctccgagggacgggctggagtggatttcattannagtagtggagtatgctagtttanaactcancgtctcggacgggtccnctcgaccatccncgacgggaccacggaccacactccacttcttancacgaagtcgacacgtacgagaccggagaccgcggtctacgttctcgtgtacgcgtagttagggttggggtttaactagtagtacgtcgtacgttaggttaccggttacctacccgttaacccctagtaaacctttcgg

SEQ ID NO: 8224 - DNA, 686 bp, Homo sapiens
  misc_feature: GYAE6OF02F81CA.25.22.B11.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (327)..(327): a, c, t, g, unknown or other
  misc_feature (327)..(327): n is a, c, g, or t
  modified_base (650)..(650): a, c, t, g, unknown or other
  misc_feature (650)..(650): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcgtcacntctctgctacgtggaaccnggccgtanactagtttggtctctttaanaacttgtcgtccttccgtcggtacccaaactaaccacccaggaccaaccggacccccaaacgtcaacttactatttacngtatcgtactaagtccacgtccggacccttcgtggtacgtttcgtggtccgtcttacgtcgtcggtccttaccgtaagttccgtacggtactaaccgtccgggtcccctacccgtacgtacccttacgtccggtccggggtacctccggtaggtcgtacggacgggtaccggtacggtaccttacgtttagtttacgtcgtactttacgttacaattacgacgtaacaaccaacctacgtagttacggtcggttacggttccggaggtacggtaacctaggttccgaaccgttccggtaacgtccacggtacccaggttcccnccggtaccccttgccttactccgttccgtacccccg

SEQ ID NO: 8225 - DNA, 782 bp, Homo sapiens
  misc_feature: GYAE6OF02GVR3C.25.22.B11.1.454.CMB.1.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactccgtggactagtcggtcaccatctcctgcactggaaccngccgtnactattgggtntcttaataactatgtctccgtggtacccaaacaaccaccaggaccaacggaccccccaaacgtcactacctaatttactgaattcgtacaggttacacgtcccggacccttcgttacggtacgttttcgtcggttccgtcctttacgttccgtcggtcccttaccgtaaacggtttccgtacgggtacccttaaaccggtcccgggtacccccttttaccccgacgtaacccctacgttcccgggtaccggggtacccctttccggaacgggtaccgttacggggaacggaaccggggtaacggtaacccttttaaggttttaactttaaacgtttcggaccttttaactttaccggtaaacttaaccggaaggtaaccgaaacccgtaaaccctaaggtaacctttcgggtacggtttacgggttacccgggacgggtaaaccggtaccgtaacgttaccggtaaccgttcccggtacggtacgaccgtacccgaagtcccgtccgtccccgtgtaccgtaccttccgtccgtacccccg

SEQ ID NO: 8226 - DNA, 628 bp, Homo sapiens
  misc_feature: GYAE6OF02GR4BH.25.22.B11.1.454.CMB.1.raw
  modified_base (447)..(447): a, c, t, g, unknown or other
  misc_feature (447)..(447): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgctttaataactatgtctcctggtcccaacaacacccaggccaacggcccccaaactcatcatttatgatgtcagtcactccggccctcgtggtacgtttcgtcggtctcgtttctctcggctccaagtctgacactcgcctcctgacctagtccgtccgggctccgaggctggacggacgaggacttaactttattagttgacttatttnaactacgaacgactaaccgacctaacgtacgttaccgtgggttacgttcgggacggtaacgggtacctaagggtttcgtaacccggttccggtccggttaccgaaccggtacccgtaacgggtccgttacccggtccccccgttcggtacccgtacccgttcccgttccgttacccccccg

SEQ ID NO: 8227 - DNA, 572 bp, Homo sapiens
  misc_feature: GYAE6OF02GG5YH.25.22.B11.1.454.CMB.1.raw
  modified_base (550)..(550): a, c, t, g, unknown or other
  misc_feature (550)..(550): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttaataactatgtctcctggtcccaacaacacccaggcaaggcccccaaatcatcatttatgatgtcagtcatcggccctctggagtttctggtcgctttctctcggctcaagtctggcaactcgcctccctgaccatccgtcggggcctccgaggctggacggacgaggtcttaacttattattgctatttcatacagacgaccaccaaacgtcgtacgttgttacggttcgggcggaacgggtaccgtaaggttcggacccgttcgtccggtacaccggacccgaacggtcctccgccccgtcggtaccncccgttcgtcccgttacccccg

SEQ ID NO: 8228 - DNA, 879 bp, Homo sapiens
  misc_feature: GYAE6OF02GZIX4.25.22.B11.1.454.CMB.1.raw
  modified_base (223)..(223): a, c, t, g, unknown or other
  misc_feature (223)..(223): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcacgtggaaccngcccgtgactagtttggtgtctttaataacttatcgtccttccgtcggtacccaaccaaccaccccaggaccaaccggcccccaaaactcactactatttatgatgtactacgtcacgtccggtcccttcgttcggtacgttttcgttcgggttcctccgtttcctccgttacggtcctaccgtaaggttccgttacggtcctaaccggttcccggtaccccttcccgtacgtaacccgtacgttcccggttacccgggggtcccttacccgggtacggggtcccgttaacggggaaccggggtaaccgggtaacgggttaccgtttaaaccgtttttaacgtttaacggttttaccggtacctttttaaccgtttttaccgtaaaacgtttaaccggaaacggtaaaccggaaaccctaaacccgtaaaccgttacggtttaccgggtttacggggtttacgggttacccggggggtacgggtaaaccggggtaacccggttaacgggttacccgggtaaccccggttacccggttaacccggggtaccgtaacccgggtaccccgggaaaccgggttccccgtacccccgggttcccccggtttaccgggttaccccgtacccggtttacccgttaccccggtttacccccccg

SEQ ID NO: 8229 - DNA, 584 bp, Homo sapiens
  misc_feature: GYAE6OF02GCL6Z.25.22.B11.1.454.CMB.1.raw
  modified_base (185)..(185): a, c, t, g, unknown or other
  misc_feature (185)..(185): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (365)..(365): a, c, t, g, unknown or other
  misc_feature (365)..(365): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagactgtacagtcacgaccggtgctcgatttagacgacagctcgagggggggggtcctcagggaggcagcgcgtcgtcgggaccgtcgtccaccatggcctgggctctgctgttcctcaccctcctcgactcgacgggcacagggtcctgggcccagtctgccctgactcagcctgcctccgngtctgggactccnggacnggtcgtcacatctctgcacgtggaccagccgtnactnttcggngactttataacttntgtcctccgtcggaccctaacaaccacccgtaaggcaaccggacccccaaatccatctaactttagagtactcggtcagtcacgtcccggcctgtcggtatttcnggtcctcttctgcgcctcagtcgtggctacgtcggacctccgngaccngtcgtccggtcnccggcncgagtacggcgcggtctagtattaactcgacttctcactgtcgtcgtacgtacgagtcgtcgtcgggttgggtcgacggtacgacgggacgtaacgacgtcggtaacgtcgtaggccacgacgtcgtcgcccgtccgacgttcaccttcccgg

SEQ ID NO: 8230 - DNA, 669 bp, Homo sapiens
  misc_feature: GYAE6OF02IXCWO.25.22.B11.1.454.CMB.1.raw
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
tcagactgtacagtcacgaccggtgctcgatttagacgacagctcaggggggggggtctcaggaggcagcgctctcgggacgtctccaccatggcctgggctctgctgttcctcaccctcctcactcagggcacaggggtcctgggcccagtctgccctgactcagcctgccctccgtgtctgggactcctggacaggtcggtcaccatctcctgccactggaaccagccgtgacagttggncttaataactntgtctcctcggtcccaacaaccacccaggaccaacggacccccaaactcactactatttatagtatcgtacagtacctacgtccgttccgttcgtaggtagtttcgtggtcgtcttcgtcgtacggtcctaccgtagtcgtcgacctaccgtccggtcctcccgtagacccgtgtccggtcgggtcctccgacggtcgtaggacggtacggacggtcttaacttattacgttgtacttattacgtaatacgagtaacgaccaacctacgtagtccgttagggttcggttaccggacgggtaacgggtaccgtaacggttccgtaccggtcccggttacggtcccgtaacggacccgtaacggtcccgttacccggaccccgttccggtcctacccgttcgttccccggttcccccg

SEQ ID NO: 8231 - DNA, 846 bp, Homo sapiens
  misc_feature: GYAE6OF02HB5NW.25.22.B11.1.454.CMB.1.raw
tcagactgtacagtcacgaccggtgctcgatttagacgacagctcagggaccctccaggcttgacgaagcctccccagagttcccaggagtttccattcggtgatcagcactgaacacagaggactcaccatggagtttgggctgagctgggttttcctgttgctcttgtaaaaggtgtccattgtcaggtgcagttggtgcagtcgtgggggagcttcgtcaagcctggagggttccctggagaccttcgtcctgtagaagttctactggtaattcgacctactacaaattcggaacttaccttttagtcgggacccttagggtaacttccccggacctaacgggtcctaacccggtaaacggggggaacgggggtcctacggggaacggtttcgggttaaccttttaccgtaagtttttacgtacccggtaaaggtttaaacggtacgggggtaaagggttaaacgttcgggaaaccttttaatttaaacgtaaacgttccccgaaacgggttaaccgttcccgtaacccgggggtaaccgggggttcccgttacgttacccgtaaccccgtacgttaccccgtacccggtaacggggaacccgtaaaccggtacccgtaaacctaaacgtaccctaacgtttacctttaccgtacgtacgtaacggtacggtaaccgttaccggaaccgacggtccccggaaaggtaccctaacgggtacccttaaaggtccgttaacgttcgtaccggacgtacggtgggttaaggggtttaactagtacggttacgttacgttcgttaacggttacgtttacccctaacccgtacccggttaacttaacgg

SEQ ID NO: 8232 - DNA, 671 bp, Homo sapiens
  misc_feature: GYAE6OF02HA40S.25.22.B11.1.454.CMB.1.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcgagggcacgagggtcctgggcccagtctgccctgactcagcctgcctcgtgtctgggacctcctggacagtcgtcaccatctcctgcacgtggaacctaggccgtgactattgggtntaccttaataactntcgtccttccgtgtacccaaacaaccaccacgacaaccggacccccaaactcactctatttactagatcgtcagtctacgtccgcctcgtcgttagtttcgtcggttctcttcgtacgtcgtcctacctagttcgtcgtacctaccgtccggtacccttcccgtacgtaccgtacgtccggttccgggtcccttccggaccggcgtacgggacggacgggtacggtacttaacgtttatttacgttacgtctttaactttacaagtacaacgaacgtaaccaaccgtacgtaacgttcggttacgggtcggttacgggacgggttacggacgttacggttacggtaccgtccggtacgtcgaaccgccgacgtccgtccgtcccgtcgtaccgtccttccgttcccgtaccccg

SEQ ID NO: 8233 - DNA, 722 bp, Homo sapiens
  misc_feature: GYAE6OF02HMBFI.25.22.B11.1.454.CMB.1.raw
  modified_base (238)..(238): a, c, t, g, unknown or other
  misc_feature (238)..(238): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacatctcctgcacgtgaaccagccgtagactagttggtntacttaataactatcgtcctcgtcggtacccaaacaaccacccaggaccaacggacccccaaatccaactactaattatagatcgtacatcacgtccggtccctgtggtactttcgtcggttcctctttccgtcgtcggccttaccgtaacgtcgtcggacctaaccgtccgggtccctacccgtcgaacctacgtccggtccggggtccttaccggaggtccgtagggaacggtacggtacggttaccttaactttagttacgttcgactttactttacgaattaacgaagtaaccgaacctaaacccgaacgtaggtttccgtagggtttcggtaccggggacgggttaaccgggtaccgttaacggttccggtacccggtttccggttaccgggtacccgaaccggtaccccgtaacgggtcccttaccccgggtcccccgtcgttaacccctccggtttacccttaccccgttacccccg

SEQ ID NO: 8234 - DNA, 876 bp, Homo sapiens
  misc_feature: GYAE6OF02IDO9K.25.22.B11.1.454.CMB.1.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagactgtacagtcacgaccggtgctcgatttagacgacagctcagggggggggtctcaggaggcagcgctctcgggacgtctccaccagtcggcctgggctctgctgttcctcaccctctcactcgagggcacgagggtcctgggcccagtctcgccctgactcagcctgccctcgtgtctgggctcgtaggactacggtcggtcacgatcctccgtgcacgtcggaacccaggtccgtanactggtttcggntacgtttaataacctgttcgtcgttaccgtcggtacccaaaccacaccgtagaccgaacggacccccaaacgtcaacgttcttaactttagtacgtaagttcgtacgacgttacgtaccggtcccggtaccccttggttacggttacggttttcccgttcggggttcccttacgtttaccgttccgggtcggtacccttaaccgtaaacggtccggtttaacggaccgtaaccgtcccgggtaaccccttcccgtacggtaacccgtttaccgtacccggggtttcggggtacccgtttacccggaacggggttcggtaaaccgggtacggggttaaacccgggtacggttaccctttaaaccgtttttaagtttacggtacggttacccttattttaaccggaattaacggaacgtacctaaaacccgaacgtttacccgaggttaccgggttcggggtttaccgggtaccgggaaacggggtaccggtaaaaccgttcggttaaccgggtaacccggtttccgtcggggttaacccgaaccggtacccgtaaggttccccggaacccggttccccgggtacgttaaccccgttcggttccccgtacccgtttcccccgg

SEQ ID NO: 8235 - DNA, 984 bp, Homo sapiens
  misc_feature: GYAE6OF02H3H0C.25.22.B11.1.454.CMB.1.raw
tcagactgtacagtcacgaccggtgctcgatttagacgacagctcgaggggggggggtctcaggaggcagcgctctcgggacgtctccaccatggcctgggctctgctgttcctcaccctcctcactcagggcacgagggtcctcgggcccagtctcgccctgactcacgcctcgcctccgtgtcgtcgggacctccgtggacacggttccggtaccaaccgtattccgtccgtaggacctaacggtacggaaacccgtaggtaccgttagaaccgtaggtttcgggtacgttaccgtttaaagttaacgttaacgttcgttcccgttacccggtaccgggtaaccccaaaaaccgaaacccgtaaccccggaaacgggtaccccggaaaaccccgggtaaaccccccctaaaacgttacctaaaaccggtttacctaaacgtttttaaaccgtaggttaaccttacgggtaaccttaacggtaccgtaaccgttacccccgggttcccgttaacggtacggggtttaaccggttttcccggtaacgggttccccgtttacccgtttccggttcccgttaccgggtacccttaacggttaaccgggtttcccggtaaccggtaacccgttacccggttaccccggtacccttccccgtaacggttaaccctaccgggttccggttacccggggtccgtacccggtacgggtacggtacgggtaacggtacgggtacgttaaaccgttagtttaacgttacgttacgttaacgttacgttaccgtaacgtaacgtaacggtaacgtaaccgtaaccgtaacgtacggttcggtacgggttacggtccgggaacggtaacgggtaaccgtacggttaccggttacccggttaccggtacggtacccgtaacggtacccgttaaccggtccgtacccggtacccggtaccgttacccgtaccgttccccggttacccgttacccccg

SEQ ID NO: 8236 - DNA, 734 bp, Homo sapiens
  misc_feature: GYAE6OF02HVX6Y.25.22.B11.1.454.CMB.1.raw
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (536)..(536): a, c, t, g, unknown or other
  misc_feature (536)..(536): n is a, c, g, or t
tcagactgtacagtcacgaccggtgctcgatttagacgacagctcgaggggggggggtctcagggaggcagcgctcgtcgggacgtctccaccatcggccgtgggctctgctgttcctcaccctcctcacgtcgacgggcacgacgggtccgtcgggacccaggttctcgcccttagacctccgacgtccgtctcccgttccggtgtcgcgggtacctcgtcggactacgggttccgacctaacctattcccgtacgtcgacctaaggtacggaaaccgtcgacgtagattaacgttggtactaacttaactaccgtattcgtccgtaccgttcggaaacccaacaccgacgacggaaccacgaacccctaanctactattactagcgtntacgtactaagtcctcgccgttccgtattacgggttcgtacgtttggccgttctcggtcctaacgggtctaacgtagttcgactaaccgtccgtccgtcctaccttacgactacggtccggtcgtcccgacgcggttcgaaacggnggacgtacgttacgttaattacttgtactacgttaacgtacctaagacggacaaccgaactaaccaacggtacgttcgggtaccggttagccgggtaacgggtaccgtaaggtacccgtcgtaccgttacggccgtaacaaccggtcgtacgtccccggtcctaccggaaccgtctttaacggtccctacccgttccc

SEQ ID NO: 8237 - DNA, 837 bp, Homo sapiens
  misc_feature: GYAE6OF02G0AJM.25.22.B11.1.454.CMB.1.raw
  modified_base (177)..(177): a, c, t, g, unknown or other
  misc_feature (177)..(177): n is a, c, g, or t
  modified_base (230)..(230): a, c, t, g, unknown or other
  misc_feature (230)..(230): n is a, c, g, or t
  modified_base (732)..(732): a, c, t, g, unknown or other
  misc_feature (732)..(732): n is a, c, g, or t
  modified_base (816)..(816): a, c, t, g, unknown or other
  misc_feature (816)..(816): n is a, c, g, or t
tcagactgtacagtcacgaccggtgctcgatttagacgacagctcagggggggggtctcaggaggcagcgctctcgggacgtctccaccatgcctgggctctgctgttcctcaccctcctcactcaggcacagggtcctgggcccagtctgccctgactcagcctgcctccgtgtcngggactccgtggacacgtcggtcaccatctcctgccatcggaaccagccgtanaccgatttcggtagccttaaataacttagtcgtccttccgtacggtacccctaaaacaaccgaaccccaggaccgaaaccggaacccccctaaaacgtcctaacgttacccttaagttttactacggacgtttacgtaccgtaaggtaccctaacgtcccggtaccccgttaccgtttagggtaaccgttttcggtccgggtccggttactttacccgttcgttaaccggggtcgttaccccgtaaagggtttccgtaacggggtaacccctaaccgttcccgggtaaccccttccccgaacggtacccgtaaccggtttcccggggtaccggggtcccttaccggtacggtaccccggtaaggtacccggggtagtaacccgggtacgtttaaaccttacgtttacccggtaagttccgtttaacttacccggtatttaacccggcgtaaacgtaccctaaaccgtaacgtacgttcggttaaccggttggttacccgggnggtaaacggggaccttaggtacggtccgtacgttaccggacgtacgaacccgggaattcccggacgtacccgtccggttaaccncgtttaccggtcctacccccg

SEQ ID NO: 8238 - DNA, 719 bp, Homo sapiens
  misc_feature: GYAE6OF02G4VGE.25.22.B11.1.454.CMB.1.raw
  modified_base (309)..(309): a, c, t, g, unknown or other
  misc_feature (309)..(309): n is a, c, g, or t
  modified_base (425)..(425): a, c, t, g, unknown or other
  misc_feature (425)..(425): n is a, c, g, or t
tcagactgtacagtcacgaccggtgctcgatttagacgacagctcagggaccctccagtcttgacgaagcctcccccagagttcccaggagtttccattcggtgatcagcactgaacacagaggactcaccatggagtttgggctgagcttgggttttccttgttgcctattttaaaaggtgtccagtgtgaagtgacaactggtggagtcgtgggggagccggtggtacgagggtcccgggggggtccctggagacgtcctccgtgtgtacggcctcgtggtattcattggttttgatggactttagngccagtgccacgttcgggtccgtacgaacggggtcccggggaagggtcgtgggtaggtggggtcctgtcttaagtggtaccgttggaagtggggaaagaacgtaaacccgtatacngtacaacgtctgtagtcggtaaagggtcgtattacccaaccgtacccctacgaacgaacgtaaccaacgtactaccaaacgtaaccttacccgtagttacgtaccgtttacgaacctaaacggtcggtaacgacgttcgtaacgaaccgtaccgtacagtaccgaccgtaacccgttcgtttaacttagtttacgttagttacggtaacgggtaggtacggttaggttcggttaaggtagtaacgtacggttacccggaccgggttacccccggacggtaccggccgtaacccg

SEQ ID NO: 8239 - DNA, 684 bp, Homo sapiens
  misc_feature: GYAE6OF02FU1I3.25.22.B11.1.454.CMB.1.raw
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (463)..(463): a, c, t, g, unknown or other
  misc_feature (463)..(463): n is a, c, g, or t
  modified_base (515)..(515): a, c, t, g, unknown or other
  misc_feature (515)..(515): n is a, c, g, or t
  modified_base (612)..(612): a, c, t, g, unknown or other
  misc_feature (612)..(612): n is a, c, g, or t
tcagactgtacagtcacgaccggtgctcgatttagacgacagctcgaggggggggggtctcaggaggcagcgctctcgggacgtctccaccatggcctgggctctgctgttcctcaccctcctcactcgagggcacgagggtcctgggcccagtctcgccctgactcgagcctgccctcgtgtccgtggacttccgngacngtcgtacacntcncctgcacgtcgaccngccgtgactnttggngtacttaataactntntcctccttcggtcccaaacaaaccacccgagtaaccgaaccggtacccccaaactcactacttacttatgatcgtcctggtactacgtccggtccctggtacggtgtttcgtcgtccgttcgtttctcgtacggccttacgaagttccgtggtacctaacgttccgtccctaccgtcaccgaccttcggtcgggacctccggnggtcgtggaacggacgtaggtaccttacgtttatcgttaacgtcttacttanacctacgacgtacgaacctacaacggtgttacggttcggttaggggttccggacggtacggtaacgtaaccgttcgtaccgtccggtaacccgggtntaccccgacggtacgtacccggtcccgttccccggttaccgttaccgccgtttccggttcccgtacccccgg

SEQ ID NO: 8240 - DNA, 754 bp, Homo sapiens
  misc_feature: GYAE6OF02HXQMG.25.22.B11.1.454.CMB.1.raw
tcagactgtacagtcacgaccggtgctcgatttagacgacagctcagggaccctccaggcttgacgaagcctcccccagagttcccaggagtttccattcggtgatcagcactgaacacagaggactcaccatggagtttgggctgagctgggttttccttgttgctcttagtaaaaggtgtccattgtctaggtgctagttggtgcagtcgtgggggagcttcgtcaagcctggacgggtccctgacgactcctaccgttgtgaagttctcgttaggacttcaaccattacaatagtacttacgttttaagcggtccgtggactcccggccgagggcctccggaaggggaacggggtcgtagggtggttacgtaagttttcctaagtttactacgaaggttaaacgtggggtaagttagtacggtactttaagtttaactaacgtcctaacgtaaccgtccggtaacccgggtacgggggcccttaccgttacccaacccgtacgttccccgtacggaaccgggtaccgaaaccgggacctaaaccgtaaacgtacccttaaccgttccgttttacgtcggtaactaacgggtacgtaaccgggtaccgtccggacggaccggtaacgaccggtacccggtaacgttagttccgttctgggtaccgtcgtaggttacggggttaagggtttatacggtagtacgtacggtacgttacggttacgtaccgttacccgttacccgacgtttaacg

SEQ ID NO: 8241 - DNA, 1084 bp, Homo sapiens
  misc_feature: GYAE6OF02FVIE3.25.22.B11.1.454.CMB.1.raw
tcagactgtacagtcacgaccggtgctcgatttagacgacagctcagggaccctccaggcttgacgaagcctcccccagagttcccaggagtttccattcggtgatcagcactgaacacagaggactcaccatggagtttgggctgagctgggttttccttgttgctcttgtaaaggtgtccattgtcaggtgcagttggtgcagtcgtgggggacgtcttcgtacaagccgtgggacgggtccctgacgtactctcctggtagaacggttctcgtaggtacttaccgaaccctaattacctaaaagttcggaacctttaaccgtttttagtccggggtaccccgttaggggtaacccttcccccggacccgtaacgggtccccggttacccgggaaacggggggggtaaacggggggtcccgtttaaggggggtaacgggtttacgggggtttaaccttttttaccggttaaaagtttttttaaccggtaaccggtttaaacgggttttaaaacggtttagggggggttaaaaccggggttttaaaaggtaccgggggttaaacttttaaacggttttttaaaacgttaaaaccggttaccccgttaaaacggtttaaccccggtttacccgggtttaaccccgggggaccgggggggtaacccccctttacccgttttacccccgaaaacccgtttaccgtttacccccggttaaccccgggtaaaccggggggaaacccctaaaaccccggggtacccctaaaccgtaaaacccgttaacccgttaaaacccgttttccgttttaaccgttaccggtaaccgttaaaacggtacccgggtaaaaccccgggtacccgggttacccgggaaaccggtaccccggggtaaacgggtaaacccgtaaccggggttacccgtttaaaccgtttaccgtttacggttacggtacggtacgggtaacgggtttaccgggggttttaagggggtttaactttaacgggtcggttaacgtccggtaccggttaagggttttaccggttaaccccttacccccgttaaccccggtttaacttaaacccgg

SEQ ID NO: 8242 - DNA, 929 bp, Homo sapiens
  misc_feature: GYAE6OF02FZO21.25.22.B11.1.454.CMB.1.raw
tcagactgtacagtcacgaccggtgctcgatttagacgacagctcagggggggggtctcgaggaggcagcgctctcgggacgtctccaccatggcctgggctctgctgttcctcaccctcctcactcagggcacgagggtcctgggcccagtctgccctgactcagcctgcctccgtgtcgtgggacctccgtaggaccaggttccggtaccaccattcctcctgcctacgtcggaacccaggccgtagactagttttggtacgtactttaataaaccttgttcggttacccttccgttaccggtaacccctaaaaccgaaacccgaaccccgaagggacccgaaaaccccgggtaaccccccctaaaaagttccctaaactttaccgttaaagttttacgtacggttaacttcggttaccgtaacggtttccaacgtacccgtaccccgttagttcgggttacgttttcggtcgggttcctcctttacgtcgttcggtacctccgtaacgttcgtacggtacctaaccggtcccgtacccgttcccgtaacgtacctacggttccgggtaccggggtaccctaccgggtacgggaccgttaggggtaaccgggtaaccggtaacgggttacccgtttaaacgttttaacggtttacgtttcgtaaccttttaacggtttaccgaaacgttaaacggtaaacgggtaaacccaaaccgttaaaccccgtaaggttaccgtttacgggttggggtttaccgggtacccggggttaaacgggaaacgttaaccgggtttaaccggttacccgtaacccccggttcgggttacccggttacccgaaccggtaaccccggttaggttaccccgttccccggtacccggttccgtaacccgttcccgtttacccggtacccctttaccccccgg

SEQ ID NO: 8243 - DNA, 859 bp, Homo sapiens
  misc_feature: GYAE6OF02JW3FB.25.22.B11.1.454.CMB.1.raw
  modified_base (190)..(190): a, c, t, g, unknown or other
  misc_feature (190)..(190): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
tcagactgtacagtcacgaccggtgctcgatttagacgacagctcagggggggggtctcaggaggcagcgctctcgggacgtctccaccatggcctgggctctgctgttcctcaccctcctcactcagggcacgagggtcctgggcccaggtctgccctgactcagcctgcctcgtgtcctgggactccnggacagtcggtcaccactctcctgctactcggaaccagccgtgactagtttcggngtacctttaanaaaccgttatcggttcctcccgttacggtccccaaaacgaacctaccccgaaggtaccaaacccgggtaccccccctaaaactccaccttaccgtacttttacgacgtacgttacgttaccgaacgttctaaccgttacccgggtacccctttcggttacgggttaacgtttttccggtacgggtttccgtttcctttacccggttcgttaacccggttccgttaccccgttaaaggggtttcccgttaccgggtaaccttaaccccggttcccgggtacccccctttccccggtagtaccccccggtagtttcccggtacccggggtcccgtacccggtacgggtcccgtagggacgggtccgtaaccggtaccgtttaacgtttacgttacgtttacgtaccgttacgttaccgttaacgtaaccgtacgaacgttaaccaccctaaaccgttacgtacgtttacggggttaccggtttcgggaaccggggttaccggaaccgttacgtaccggttaccggtcccgttcgggtacctaccggacccgttaacggccctaccggtcccgtaccggtacctacgttccgtacccgttcccccg

SEQ ID NO: 8244 - DNA, 388 bp, Homo sapiens
  misc_feature: GYAE6OF01EIBNH.30.39.D06.1.454.CMB.1.raw
  modified_base (180)..(180): a, c, t, g, unknown or other
  misc_feature (180)..(180): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (380)..(388): a, c, t, g, unknown or other
  misc_feature (380)..(388): n is a, c, g, or t
tcagcacgctacgtcacgaccggtgctcgatttagtgacatctcgcagttctttggggtacgatttgatgttacctgatgcttagaggctttcctggaagcagggcatttgttgcttcagcaccgtagtgcctcgtcatcacgcctcagccttgattttccggatttgcctggaaaaccngcctacacgcttaaaccgggacaaccgtcgcccggccaacatacgccttctcccgtccccccttgccagtaaccaccaagtacaggaatacttaacctgtttcccatccgactaccgcctttcggcctcgccttagggtcactcaccctgccccgattaacgtgacaggaccttgctcgngagcggctgcagcgcntagnnnnnnnnn

SEQ ID NO: 8245 - DNA, 393 bp, Homo sapiens
  misc_feature: GYAE6OF01B8UFH.30.39.D06.1.454.CMB.1.raw
  modified_base (386)..(393): a, c, t, g, unknown or other
  misc_feature (386)..(393): n is a, c, g, or t
tcagcacgctacgtcacgaccggtgctcgatttagtgacatctcgcagttctttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggaatataacctgtttcccatcgactacgcctttcggcctcgccttagggtcgactcaccctgccccgattaacgtggacaggacccttggtcttccggcgagcggctggcaaggcgcatagnnnnnnnn

SEQ ID NO: 8246 - DNA, 422 bp, Homo sapiens
  misc_feature: GYAE6OF02IM7J2.30.39.D06.1.454.CMB.1.raw
  modified_base (181)..(181): a, c, t, g, unknown or other
  misc_feature (181)..(181): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (387)..(388): a, c, t, g, unknown or other
  misc_feature (387)..(388): n is a, c, g, or t
  modified_base (390)..(391): a, c, t, g, unknown or other
  misc_feature (390)..(391): n is a, c, g, or t
  modified_base (393)..(422): a, c, t, g, unknown or other
  misc_feature (393)..(422): n is a, c, g, or t
tcagcacgctacgtcacgaccggtgctcgatttagtgacatctcgcagttctttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaaccgggacaaccgtcgcccggccaacatacgccttctccccgtcccccttgcagtaacaccaagtacagaatattaacctgttcccatcgactacgcctttcggcctcgccttaggggtcactccacctgaccccgtattaacgtggacaggacccttgtcttccggcagcggctggcaaggcnatagngnngnngnnnnnnnnnnnnnnnnnnnnnnnnnnnnnn

SEQ ID NO: 8247 - DNA, 660 bp, Homo sapiens
  misc_feature: GYAE6OF02ILEOT.41.56.F01.1.454.CMB.1.raw
tcagtctatactatcacgaccggtgctcgatttagcagacgtctgaacacacaaagggggctctgggagaggagccccagccgtgagattcccaggagtttccacttggtgatcagcactgagcacagaccaccaaccatggagtttgggctaatcttgattttcctgttagttttttagagtgtcctagtgcgagggcgactggcggaggtcggggggggcttggcacgagccgaggggcggtctcgtggacgtactctcctgtgtacgtctcaggtattcagttcttagtgtattagtctacgtttcggcccgttgggtacccgttcgacggtcctccggaaggggtaagggtccttggaggtggtattcgtacgtttcgtcaagtaaatgtaaacgttagtgggtaaggaagtaaacgtagtacgcgtagtcgtggaggtaagggagtactcgacctctacggaagggactcgaacctaccgaaacgtggttcgtaggaccctaatttaacgaaagtcgaagacctaacgtgaaccgtacccgagaacctgacgtccgtactacgttaccgcgaccgtaccgtagggctacccggttcggtaacgggttaccctaggacgttacgcctttaaaggtcgtaagttggttacccggggg

SEQ ID NO: 8248 - DNA, 790 bp, Homo sapiens
  misc_feature: GYAE6OF02IAAES.41.56.F01.1.454.CMB.1.raw
  modified_base (692)..(692): a, c, t, g, unknown or other
  misc_feature (692)..(692): n is a, c, g, or t
tcagtctatactatcacgaccggtgctcgatttagcagacgtctgaacacacaaagggggctctgggagaggagccccagccgtgagattcccaggagtttccacttggtgatcagcactgagcacagaccaccaaccatggagtttgggctaatcttgattttccttgttagtttttttagaaggtgtccagtgcggaggggcgacgtgggcggagggtcgggggggggcttgggcacgaggccgaggggcggtctcgtgacgacctctcctgtgtagtctcgaggtattcagtcgttagtgtattatctacgtttcgggccttgggtcccgtacgagggtcctaccggaaggggaacggggtcgttaggacggttgggaacttcgtacgttttcggctaaagtaagtaacggtaaacgtttagtagggtaggtaaaaggtttaaaacggacggtaacggcccggtacgtcgttacgggtaaggaaacggggtaacgtacgtttaccgaacccggttttcgaacgggaaaggggtatacggtaacctacccgaaaaacgttgggttacggttaccgggaccctttaaagttttaaaccaaaagttcggaaccgtaaccctaaacggttacggaaaccggaccccggaaacgtaacccgaaccggaacgggttccgtacttaacgtttacgngacccgtaccggaaggtcccgaaccgttcccgggtagggtaaccgttacgtagttacgtacgtttaagttttggtaacgtttagggttacccgggggg

SEQ ID NO: 8249 - DNA, 173 bp, Homo sapiens
  misc_feature: GYAE6OF01BUAGI.13.57.F02.1.454.CMB.1.raw
  modified_base (173)..(173): a, c, t, g, unknown or other
  misc_feature (173)..(173): n is a, c, g, or t
tcagtcacgtactacacgaccggtgctcgatttagctcgatatagttgggtttgggggaagaggaagactgacggtcccccaggagttcaggtgctgggcacagcggccctgggctgcctggtcaaggactacttcctagtacgtgactgagcgggctggcaaggcgcatagn

SEQ ID NO: 8250 - DNA, 173 bp, Homo sapiens; identical to SEQ ID NO: 8249
  misc_feature: GYAE6OF01DYP8X.13.57.F02.1.454.CMB.1.raw
  modified_base (173)..(173): a, c, t, g, unknown or other
  misc_feature (173)..(173): n is a, c, g, or t

SEQ ID NO: 8251 - DNA, 174 bp, Homo sapiens
  misc_feature: GYAE6OF01C6775.13.57.F02.1.454.CMB.1.raw
  modified_base (173)..(174): a, c, t, g, unknown or other
  misc_feature (173)..(174): n is a, c, g, or t
tcagtcacgtactacacgaccggtgctcgatttagctcgatatagttgggtttgggggaagaggaagactgacggtcccccaggagttcaggtgctgggcacagcggccctgggctgcctggtcaaggactacttcctagtacgtgactgagcgggctggcaaggcgcatagnn

SEQ ID NO: 8252 - DNA, 176 bp, Homo sapiens
  misc_feature: GYAE6OF01CZF3I.13.57.F02.1.454.CMB.1.raw
  modified_base (174)..(176): a, c, t, g, unknown or other
  misc_feature (174)..(176): n is a, c, g, or t
tcagtcacgtactacacgaccggtgctcgatttagctcgatatagttgggtttgggggaagaggaagactgacggtcccccaggagttcaggtgctgggcacagcggccctgggctgcctggtcaaggacctacttcctagtacgtgactgagcgggctggcaaggcgcatagnnn

SEQ ID NO: 8253 - DNA, 175 bp, Homo sapiens
  misc_feature: GYAE6OF01EVPYV.13.57.F02.1.454.CMB.1.raw
  modified_base (174)..(175): a, c, t, g, unknown or other
  misc_feature (174)..(175): n is a, c, g, or t
tcagtcacgtactacacgaccggtgctcgatttagctcgatatagttgggtttgggggaagaggaagactgacggtccccccaggagttcaggtgctgggcacagcggccctgggctgcctggtcaaggactacttcctagtacgtgactgagcgggctggcaaggcgcatagnn

SEQ ID NO: 8254 - DNA, 175 bp, Homo sapiens
  misc_feature: GYAE6OF02HHGVM.13.57.F02.1.454.CMB.1.raw
  modified_base (173)..(175): a, c, t, g, unknown or other
  misc_feature (173)..(175): n is a, c, g, or t
tcagtcacgtactacacgaccggtgctcgatttagctcgatatagttgggtttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 8255 - DNA, 514 bp, Homo sapiens
  misc_feature: GYAE6OF01B4PPL.37.36.D03.1.454.CMB.1.raw
tcagtagtgtagatcacgaccggtgctcgatttagctgcgtcacgaggtctactcttggggggtccacaagaggcagacggctctccgggaacgtctccacccatggcctgggctcctcgctgctcctcactctcctcacgtcaggacacgagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaaactcatgatttgtgaggacagtaagcggccctgaggggtttcaatcgcttctctggctccaagtctggcaacacggcctcctgacaatctctggctcagctgaggacgaggctgatttatactgctgctcatatgcaggtagtcacgttcttatgtcgttcggaattgggaccaaggtccaccgtcctaagtcacgcccaaggtacccc

SEQ ID NO: 8256 - DNA, 517 bp, Homo sapiens
  misc_feature: GYAE6OF01CO8NO.37.36.D03.1.454.CMB.1.raw
  modified_base (280)..(280): a, c, t, g, unknown or other
  misc_feature (280)..(280): n is a, c, g, or t
  modified_base (319)..(319): a, c, t, g, unknown or other
  misc_feature (319)..(319): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccactcccccctgtctgcatctgtaggagacagagtcaccatcacttgccaggcgagtcaggacattggacaacttatttaaattggtatcagcagaaaccagggaaacnccccaagctcctggtctacgctgcatccaattggaaacnggatcccatcaaggttcaggtggaagtggatcgtgggactagtattttactttcacttcagcagtcctgctagtctaggaaatacattgacaatattcttaattcgtacaactcagtcgaccggcctagggaaccctaaagtcggtaataacgtacaaacgaacttggtacggctacgaccacattctcgtcttaccg

SEQ ID NO: 8257 - DNA, 505 bp, Homo sapiens
  misc_feature: GYAE6OF01BOKSK.37.36.D03.1.454.CMB.1.raw
  modified_base (229)..(229): a, c, t, g, unknown or other
  misc_feature (229)..(229): n is a, c, g, or t
  modified_base (422)..(422): a, c, t, g, unknown or other
  misc_feature (422)..(422): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccnagtgacgttggtggttataactatgtctcttggtaccaacatcacccaggcaaagtccccaaactcatgatttatgaggtcactaaacggccctcagggtctctaatcgcttctctggctccaagtctggcaacacggcctccctgacccatctctgggctccaggctgacgacgaggctcactattattgcngctcatatacaagcagcatcacttgggtgttcgggcggagggacccgacgtcgaccgtcttacggtcagcccaaggctcccgg

SEQ ID NO: 8258 - DNA, 491 bp, Homo sapiens
  misc_feature: GYAE6OF01B0Y3O.37.36.D03.1.454.CMB.1.raw
  modified_base (281)..(281): a, c, t, g, unknown or other
  misc_feature (281)..(281): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggactaacttatttaaattggtatcagacagaaaccagggaaacnccccaagcctcctggtctacgctgctagtcctaattggaaacaggacgtacccaatacaaggttcagtggaagtggatcgtggacagtatttacttcacttcagcagcctgcagtctagaanacntagacaacattcttattagtacaacaccatcggaccggcctagggacaaagtgaatagacaagactgngctgacacanctgtctc

SEQ ID NO: 8259 - DNA, 558 bp, Homo sapiens
  misc_feature: GYAE6OF01EHJ7U.37.36.D03.1.454.CMB.1.raw
  modified_base (280)..(280): a, c, t, g, unknown or other
  misc_feature (280)..(280): n is a, c, g, or t
  modified_base (429)..(429): a, c, t, g, unknown or other
  misc_feature (429)..(429): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggactaacttatttaaattggtatcagcagaaaccagggaaacnccccaagctcctggtctacgctgcataccaatttggaaacaggacgtcccatacgaaggtttcaaggtggaagtggatcgtgggactagtattttacttcaccttcagtcagtcctagctagtctagaagtactagttacgactaactntacttattacgtacaacacctatacggaaccggtcccgtagggaacctaaaggtcggtaaataacgtaaccaaaacggtaacgttggtacggactacggacctaaccgtatccttacgtcctttaaccg

SEQ ID NO: 8260 - DNA, 502 bp, Homo sapiens
  misc_feature: GYAE6OF01B3IE6.37.36.D03.1.454.CMB.1.raw
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaactcatgatttgtgaggacagtaagcggccctcaggggtttctaatcgcttctctggctcaagtctggcaacacgcctccctgacaatctctgggcctccaggctgaggacgaggctgattattactgctgctcatagtgcaggtatcactcttatgttcgttcggaactgggaccaaggtcaccgtcctaagtcacgcccaaggacccc

SEQ ID NO: 8261 - DNA, 836 bp, Homo sapiens
  misc_feature: GYAE6OF01DU4HM.37.36.D03.1.454.CMB.1.raw
  modified_base (131)..(131): a, c, t, g, unknown or other
  misc_feature (131)..(131): n is a, c, g, or t
  modified_base (133)..(133): a, c, t, g, unknown or other
  misc_feature (133)..(133): n is a, c, g, or t
  modified_base (165)..(166): a, c, t, g, unknown or other
  misc_feature (165)..(166): n is a, c, g, or t
  modified_base (170)..(170): a, c, t, g, unknown or other
  misc_feature (170)..(170): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcccacncncgacgacaggtcgtcggccgactctcgcctcnnctcnctctctccgtcgtctcggtcggtcctcggtacgacgtcggtactactaccaactcttcctcgtcacctacggaaccgaacgcgacgtaggtacggttagggtttaggggttaattaaaattaaagttgttcgttacctttacgggttaaccgtaaaaccaactactaaccccaaaacccaaacttaccgtaacccccaaccgggtacgaaaaccgtaaaccccctaaaaccctaaactaacttaaaattttaaacgtttagaacgggtaccgtaaacctaaaaaccggtaacccgtccctaagggtaacggttttactttaaactacggtcctttaccttcttcggtcgtaccctaaacgtacgttcggaccgaaaccctaaccgggccccgttacccctaccggaacctaaccttcgttcccgttcgggggtaccctaccctaaaccccgttagggaacggggacgggtaaccggacttacccttaacgtaaacttttagttacggtaccacgtaccttacctaattaaacttaaccaaacggcacggtaccgttcgtaacccgtttgggggttgggttaccgggtacggggaacggggtaacccggtaccctcggtacccgggttaccgtttacgggaccgacggccccgtaaacgggtcccgg

SEQ ID NO: 8262 - DNA, 526 bp, Homo sapiens
  misc_feature: GYAE6OF01DYZ4V.37.36.D03.1.454.CMB.1.raw
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaaactcatgatttgtgaggacagtaagcggccctcaggggtttctaatcgcttctctggctccaagtctggcaacacggcctccctgaccatctctgggctcaacctgaggacgaggctcacttattattgcagctcatatacaagcagcgtcacttgggtcgttcgggcgggacgggacccgaccgtcggacccgttcgttacggtcaacgcccaaggtcctcggtcccccccg

SEQ ID NO: 8263 - DNA, 530 bp, Homo sapiens
  misc_feature: GYAE6OF01AVVNY.37.36.D03.1.454.CMB.1.raw
tcagtagtgtagatcacgaccggtgctcgatttagctgcgtcacgatctctcttggggggggtcacaagaggcagcgctctcgggacgtctccaccatggcccgggctctgctgctcctcactctcctcactcaggacacagggtcctgggcccagtctgccctgactcagcctgcctccgtgtctgggtctcctggacagtcgatcaccatctcctgcactggaaccagcagtgatattgaaactataaccttgtctcttggtaccaacagcacccagcaaacgcccccaaactcatgatttgtgaggacagtaagcggccctcaggggtttctaatcgcttctctggctccaagtctggcaacacggcctccctgacaatctcgtgggcctcaggctggaggacgaggctagattatactgctgctcatatgctaggtacgtcacttcttatcgttccgttacggaacgtggggaaccaacgggttcccaccgttacctaaggtcacgccccaaggccccaaaccccc

SEQ ID NO: 8264 - DNA, 653 bp, Homo sapiens
  misc_feature: GYAE6OF01C3RYQ.37.36.D03.1.454.CMB.1.raw
  modified_base (286)..(286): a, c, t, g, unknown or other
  misc_feature (286)..(286): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtcctccactcccccctgtctgcatctgtaggagacagagtcaccatcacttgccaggcgagtcaggacagttggactaacttatttaaattggtatcagacaagaaaccgagggaaacnccccaagcctccgtggtcctacgctgctatccaagtttacggaaacaggacgtacccataccgtaaaggttcaaggtaggaagtggattcgtagggaactaggttactttttaccgttccacctttcgacgtacacgtcctagcctaagttccgtaaggaaacgacctagtttacggaacctaaacttattaccttttaagttacgtaccctaaaaccgtaccctaacgttacgggaaccccgggtaccccgttaacgggggaaaccctaaagggttcgggaaacttaacgtaaccgaaaaacggtaccgttgggttacggtacccttacggacccaacctaagtttccgtacgttcctttaacccg

SEQ ID NO: 8265 - DNA, 502 bp, Homo sapiens
  misc_feature: GYAE6OF01BYB45.37.36.D03.1.454.CMB.1.raw
  modified_base (301)..(301): a, c, t, g, unknown or other
  misc_feature (301)..(301): n is a, c, g, or t
tcagtagtgtagatcacgaccggtgctcgatttagctgcgtcacgatctctcttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcaccaggcaaagccccaaatcatgatttgngaggacagtaagcggcctcaggggtttctaatcgcttctctggctccaagtctggacaacacggcctccctgacaatctctgggctcgaggctaggagacgagctgattatactgctgctcatactgctaggtagtcacttcttatcgtcttcggactgggaaccaggtcaccgtctaacgtcacgcccgaaggtaccccc

SEQ ID NO: 8266 - DNA, 589 bp, Homo sapiens
  misc_feature: GYAE6OF01BSZSV.37.36.D03.1.454.CMB.1.raw
  modified_base (277)..(277): a, c, t, g, unknown or other
  misc_feature (277)..(277): n is a, c, g, or t
  modified_base (348)..(348): a, c, t, g, unknown or other
  misc_feature (348)..(348): n is a, c, g, or t
tcagtagtgtagatcacgaccggtgctcgatttagctgcgtcacgagtctctcttggggggggtcacaagaggcgagcgctctcgggacgtctccaccatggcctgggctctgctgctcctcactctcctcactcaggacacagggtcctgggcccagtctgccctgactcagcctgcctccgtgtctgggtctccgtggacagtcgatcacatctcctgcactggaacctagcagtgattattagaaacttataaccttgtctcttaggtaccaanagccaccgagaccaaacgcccccaaatcatgtatttgagagacagtaagcgcctgaggttcaatcgcttcncgtggctcaagtctacggaaacctacgcctcccgtagactaactctcgtcggctaccgaggctaggacggacgtaggtctagtattacgttacgtgtactgtcttactagttatcgacgtaggttacgtacctacgttcgttagtcgttaccgttaccgggtaacgtcgggtaacccgtaacggtaccctaacccgttacctaaacgtccaaccggtacccaacgggcccctaaacccccg

SEQ ID NO: 8267 - DNA, 706 bp, Homo sapiens
  misc_feature: GYAE6OF01EJ92A.37.36.D03.1.454.CMB.1.raw
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttgtaccaacacgcacccaggacaaacgcccccaaactcatgatttgagagacagtaacgcgcctgtagggtttactaagtcgtcttctcgtcggtcctccgaagtctacgggacaaccgaccggtccctcccgtacgaccctagtccgtcgtcgggtaccttacccgaaccgtggaacgggtaccgaacggtcctaccgtaaactttaacgtttaacgttcggaccgtacggtacccttaccgaaacttaaccgtaaccgaaacgtaccgtaacggtcccgttaaccgtaacgggttttcgggggttaccggtttccgggggaccgggggtaaccggggtaccccggtaacccggttccggtaaccccggtttacggtttaacgggttacccgaaccgggtaccccccggaaagggtcccgtacccccgggttaccccccccgg

SEQ ID NO: 8268 - DNA, 508 bp, Homo sapiens
  misc_feature: GYAE6OF01DKH8G.37.36.D03.1.454.CMB.1.raw
  modified_base (327)..(327): a, c, t, g, unknown or other
  misc_feature (327)..(327): n is a, c, g, or t
  modified_base (393)..(393): a, c, t, g, unknown or other
  misc_feature (393)..(393): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagccacccaggaccaaacgcccccaaactcatgatttgtgaggacagtaagcgcctnaggggtttctaatcgcttctctggctcaagtctggcaacacgcctcctgacatctctggctcagcngagacgagctgtattatactgctgctcatactacaagcagctatcacgtttgggtgttcggcgggagggcccgaccgtggacccgttcgttaaggtccaacgcccgaaggtcccg

SEQ ID NO: 8269 - DNA, 514 bp, Homo sapiens
  misc_feature: GYAE6OF01B9DSA.37.36.D03.1.454.CMB.1.raw
  modified_base (230)..(230): a, c, t, g, unknown or other
  misc_feature (230)..(230): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccgnagtgacgttggtggttataactatgtctcttggtaccaacatcacccaggcaaagtccccaaactcatgatttatgaggtcactaaacggcctcaggggtctctaatcgcttctctggctccaagtctggctaacacggcctccctgaccatctctggctccaggctgacgacgaggctcgactattattgcagctcatatacaagcagcatcacgttgggtagttcggcgggagggaccggtccgtcgaccgtcgttacggtccgacgcccaaggctccccgg

SEQ ID NO: 8270 - DNA, 601 bp, Homo sapiens
  misc_feature: GYAE6OF01BXN3F.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttgtaccaacagccaccaggacaaacgacccccaaactcatgatttgtagagacagtaacgccggccctcgtaggggtttctaagtcgcttctctggctccaagtctggcaacaccggcctcctgacatctcgtcggcctcgaggctggaggacgaggtctagtatttattactgtctgactacattagtgcgtaggtacgtacctacgttacgtttacgtcggtttaccgttaccgggtaaacgttacggggtaaacccgtaacgggttaccccgaacccggttaccccgttaaacggttacccgaaccggtaacccccggtaaacggtaacccccccg

SEQ ID NO: 8271 - DNA, 513 bp, Homo sapiens
  misc_feature: GYAE6OF01CBHSZ.37.36.D03.1.454.CMB.1.raw
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttggtaccaacagcacccaggcaaacgcccccaaactcatgtatttgngaggacagtaagcggccctcgaggggtttctaagtcgtcttctctgctcagtcnggcacncggcctccngacatctctcggctcgagctggacgcgaggctgattattactgctgctcatagtgcaggtactctacttcttatcggttcgttcggaacgtcgggaaccaggtccaccgtactaagtcacgcccgaacggtacccc

SEQ ID NO: 8272 - DNA, 506 bp, Homo sapiens
  misc_feature: GYAE6OF01BGXAQ.37.36.D03.1.454.CMB.1.raw
  modified_base (229)..(229): a, c, t, g, unknown or other
  misc_feature (229)..(229): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccnagtgacgttggtggttataactatgtctcttggtaccaacatcacccaggcaaagtccccaaactcatgatttatgaggtcactaaacggccctcagggtctctaatcgcttctctggctccaagtctggcaacacggcctccctgaccatctctgggctcccaggctgacgacgaggctcactattattgcagctcatatacaagcagcatcacttgggtgttcgggcggagggacccgaccgtgacccgtcttacggtcagcccaaggctcccgg

SEQ ID NO: 8273 - DNA, 517 bp, Homo sapiens
  misc_feature: GYAE6OF01AV4RA.37.36.D03.1.454.CMB.1.raw
  modified_base (363)..(363): a, c, t, g, unknown or other
  misc_feature (363)..(363): n is a, c, g, or t
  modified_base (427)..(427): a, c, t, g, unknown or other
  misc_feature (427)..(427): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgcccccaaactcatgatttatgagtcactaaacgcctcgagggtctctaatcgcttctctggctcaagtctggcaacncggcctccctgaccatctctgggcctccgaggcctgaccgacgagctcactattatgcagcctnatatacaagcagcatctacgtttgggcgttcgggcgggtacgggacccgtacctggacccgttattacggaccacgccccgaagggtccc

SEQ ID NO: 8274 - DNA, 617 bp, Homo sapiens
  misc_feature: GYAE6OF01BTBXW.37.36.D03.1.454.CMB.1.raw
  modified_base (228)..(228): a, c, t, g, unknown or other
  misc_feature (228)..(228): n is a, c, g, or t
  modified_base (313)..(313): a, c, t, g, unknown or other
  misc_feature (313)..(313): n is a, c, g, or t
  modified_base (524)..(524): a, c, t, g, unknown or other
  misc_feature (524)..(524): n is a, c, g, or t
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcatcaccatctctgcactggaaccngcagtgatattagaaacttataaccttgtctcgttacggtaaccaacagccaccgaggaccaaacgaccccaaatcatgatttgngagacagtaacgcgcctacgtagggttctaatcgtacttctcgtggctaccaagttcgtggacaaccgaccggtccctaccctagaactaacttccgtcgtcgggccttccggaaggtccgtaggaacgggacggaaggtccttaggtaactttaagttactggtcttcgaccttacctaagttaacgtgacgtaaggtacgtccactttnttacgttcgttaccgttacgggaaccgttcgggaaacctaaccgggtccctaaccggtacctaacggtaccaaccgcccgtaaccggaacccc

SEQ ID NO: 8275 - DNA, 505 bp, Homo sapiens
  misc_feature: GYAE6OF01CMY90.37.36.D03.1.454.CMB.1.raw
  modified_base (381)..(381): a, c, t, g, unknown or other
  misc_feature (381)..(381): n is a, c, g, or t
  modified_base (410)..(410): a, c, t, g, unknown or other
  misc_feature (410)..(410): n is a, c, g, or t
  modified_base (435)..(435): a, c, t, g, unknown or other
  misc_feature (435)..(435): n is a, c, g, or t
  modified_base (491)..(491): a, c, t, g, unknown or other
  misc_feature (491)..(491): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggccaaacgccccaaactcatgatttgtgaggacagtaagcggccctcgtaggggtttctaagtcgtcttctctggctccaagtctggacaacgcgcctccngactatctctgggctcgagctgaggacgnggctgtattatactgctgctcatangcaggtctcacttcttagtgtcgttcggacgtgggacctaggtacacgtacctagnacgcccaagacccc

SEQ ID NO: 8276 - DNA, 612 bp, Homo sapiens
  misc_feature: GYAE6OF01AZFEO.37.36.D03.1.454.CMB.1.raw
  modified_base (229)..(229): a, c, t, g, unknown or other
  misc_feature (229)..(229): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattagaaacttataaccttgtctcttggtaccaacagcaccaggacaaacgcccccaaatcatgattgtagagacagtaacgcggccctcgtacggggtttactaagtcgtcttactcgtcggtctaccgaagtctggactaaccgccggtccctccctagaactaacttccgtcgtcgggcctaccgaggtcgtaggaacggacggagggtctagtaactttacgttacgtgtccttgaccttactaagttacgtcgtacgtagggttactacctacttacttagtcggttaccgttacggaacgttcgggtaaccctaacgggtccctaaccgttaccgtaagtcccgaacgaccccgtaacggtaacccccg

SEQ ID NO: 8277 - DNA, 517 bp, Homo sapiens
  misc_feature: GYAE6OF01EZ3AE.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgcccccaaactcatgatttgtgagacagtaagcggccctcgaggggtttctaatcgcttctctggctccaagtctggcaacacggcctcctgacaatctctgggctccgaggctgaggacgaggctgtattattactgctgctcattatgctaggtactcacttcttagtgttcgttacggaatgggaccaacggtcacccgtactaacgtcacgcccgaacggtaccccc

SEQ ID NO: 8278 - DNA, 767 bp, Homo sapiens
  misc_feature: GYAE6OF01A6KCH.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggacaaacgccccaaactcatgatttgtagagacagtaagccggtaccctcgtaggggtttctaagtcgtacttctcgtcggccttaccgaagtccgtacgggaccaaaccgacccgggtccccttacccgtagaacctaaacgttccttaccggtcggggtcccttacccggtagggccgttagggaacgggtaccggtaacgggtccttaggtaacgttttaacgtttaccgttacggtccgttcggtacccttacgtaagttaacgttacggtaccgttaaggggttacggttacccttaaccgttttaccgtttaaacggtttaccggtttacccgggttttaacccgggtaaaaccggtttaccggggggtaaaacccccgttaaaccggggttacccccgtaaaccccggtttaaccccgttaaaacgggttaccccgtaacccgggtaaaccccccggaaaaccgggtaaccccccccccg

SEQ ID NO: 8279 - DNA, 673 bp, Homo sapiens
  misc_feature: GYAE6OF01BOU9A.37.36.D03.1.454.CMB.1.raw
  modified_base (368)..(368): a, c, t, g, unknown or other
  misc_feature (368)..(368): n is a, c, g, or t
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccatctcctgcactggaaccagcagtgatattagtaaaactttataaccttgttcttcttacggtaaccaacacgccacccgaggaccaaaacgacccccaaaatcagtgtatttgtagagacaagtaagccggtccctgtacgggtttctaactcgtnttctctcggctacgaagtctaggaccaacgccggaccctccgtagacctaatcgtacgtcgggtcctccgaggtcgtggaacgggacgtaggcttagtacgttttaacttacgtcgtcgtacgtcttacgaacttagtcgtaccgttaagggttaccttacgtaaccgtttcgtttaacgttcgggttacccgtttaaccggggaaacgtttccggggaaaaccccgtaacgggttcccgaaacccggtttaacccgtaacggttacccgaacccggtaaaccccgaaacccggtaacccccccg

SEQ ID NO: 8280 - DNA, 579 bp, Homo sapiens
  misc_feature: GYAE6OF01EACQU.37.36.D03.1.454.CMB.1.raw
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgatattagaaacttataaccttgtctcttggtaaccaacagccaaccaggaccaaacgccccaaatcatgatttgagaggacagtaacgccgcctgagggtctactaatccgtcttctcgtggctacgaagtctggaccaacgaccggtcctccgttacgaccattcctcgtcgggtctaccgaggccgtaggaggacgtaggcttagtatttaacgttactcgtcgtgccttacgtaattacgtcgacgtaggtaacgtctacttcgttaagtcgtccgttaggaacttcgggaaccttaacgggtctaacccgttcgtaaaggcctacgaacccgtaaacccgg

SEQ ID NO: 8281 - DNA, 509 bp, Homo sapiens
  misc_feature: GYAE6OF01EZSQT.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgatattgaaacttataaccttgtctcttggtaccaacagcacccaggcaaagcccccaaactcatgatttgtgagacagtaagcggccctcaggggtttctaatcgcttctctggctccaagtctgcacacggcctccctgacaatctctgggctccaggctgacggacgaggctgattattactgctgctcatatgcaggtacgtcactcttatgttcgttcggactgggacccaggtaccaccgtacctacgtacacgtcccgaaggtaccccc

SEQ ID NO: 8282 - DNA, 632 bp, Homo sapiens
  misc_feature: GYAE6OF01B6UN6.37.36.D03.1.454.CMB.1.raw
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtggaaccagcaagtgatattagaaacttataaccttgtctcttggtaccaacacgccaccacggaccaaacgaccccctaaactcatgtatttgagaggacagtaagcgccctcgtaggggttactaagtcgtacttctcgtcggcctaccgtaagtcgtacggacaaccgacggtcccttaccgtacgactaactccttacgtcgggacccttccgaaggtcctaggaacgggtacggaacgggtcttaggtaactttaagttacgtcgtcttcgacttacaagttactacggacgtacgttacgtaccgtactttacgtttagtcgttaccgttacggtaaccggacgggtacctaacgggtaccacccgttacgtacgtaccgacgaccccgtaacggtaacccccc

SEQ ID NO: 8283 - DNA, 555 bp, Homo sapiens
  misc_feature: GYAE6OF01A78AS.37.36.D03.1.454.CMB.1.raw
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (405)..(405): a, c, t, g, unknown or other
  misc_feature (405)..(405): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctggacccagtctgccctgactcagcctgcctccgtgtctgggtctcctggacagtcgatcaccatctcctgcactggaaccagcagtgatattagaaacttataaccttgtctcttgtacacagcaccagacaacgccccaactcatgtattgtgaggacagtaacgcgcctcgtagggtttactagtcgtcttctctgctcaagtcngacaacncggcctccngactatctcgtcggctcgagtctaggacggacgngctagtatttacttacgtgtcgtgactacgtatagtcgtacgtaggttactactacttcttagttcgttccgttacggaacgtacgggtaaccctaacgggtcccgtacccgtaccgtaacgtaccgaccgaccccgaacggtaaccccc

SEQ ID NO: 8284 - DNA, 615 bp, Homo sapiens
  misc_feature: GYAE6OF01B4UZF.37.36.D03.1.454.CMB.1.raw
  modified_base (229)..(229): a, c, t, g, unknown or other
  misc_feature (229)..(229): n is a, c, g, or t
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataacttgtctcttggtaccaacagcaccaggacaaacgccccaactcatgtactttgtgagacaggtaagccggtaccctcgtaggggtttctaagtcgtcttctcgtggctaccagtctggacaccgacggcctacccgtagactaactcgtctcgggtcctccgaggccgttaggacgggacgacggtccttaggtaactttattacgtgcttacgtctactagttagtcgacgtaggtacgtctaacgttcgttagttacgttaccgttacgggtaaaccgttcggggtaacccgttaaacggtcccgtaacccggttaccgtaacgtaccgaaacccggtcccgtaaaccggtaaaccccccg

SEQ ID NO: 8285 - DNA, 562 bp, Homo sapiens
  misc_feature: GYAE6OF01D5XKC.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcagaaaccaggggaaacgcccccaagctcctggtctacgctgcataccaattggaaacaggactcccatcaaggttcagtggaagtggatcgtgggactaggtattttacttcacctttcagtcagcctgcagtctagaagactattcgactaactattactttaattagtaccaaacctacctattcggaaccgggtccccgtaggggaaccctaaagggtggaacttaacgtaaccgaaaacggtaacttgggtacggtactacggtaccaacccgtatttccgttgttccgtttaaccc

SEQ ID NO: 8286 - DNA, 572 bp, Homo sapiens
  misc_feature: GYAE6OF01DNW4N.37.36.D03.1.454.CMB.1.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
  modified_base (436)..(436): a, c, t, g, unknown or other
  misc_feature (436)..(436): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggaccaaacgccccaaactcatgtatttgngagacagtaagcgcctcgagggtttctaatcgtcttctcgtgctcaagtctggacacacggcctcctgaccatcctcgtcgggcctcgaggctggacggacgaggtctgtatttatactgctgcctntattatgtacgtaggttactctacctttacgttagttcgttccgttaacgggtaacgttacgggaacccgtaacgggttcccaacccggttacccttaacggtaccaaccggtaccccgaaaccggtaaccccccg

SEQ ID NO: 8287 - DNA, 561 bp, Homo sapiens
  misc_feature: GYAE6OF01C3QFP.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttgtaccaacagcaccaggcaaacgccccaaactcatgatttgtgaggacagtaacgcggcctgagggtttctaatcgtcttctctggtctcaagtcgtggacaacacggcctccctgaaccatcctcgtgggcctccgaggcctggacggacgaggctagtatttattactgtctgtctcatatgctaggttctacctgttacttacgtcgttaccgttacgggtaacgttacgggaaccgtaacggttccctacccggttaccgttaagtccgaaccgccccgaaacgggtaacccccc

SEQ ID NO: 8288 - DNA, 553 bp, Homo sapiens
  misc_feature: GYAE6OF01B4I64.37.36.D03.1.454.CMB.1.raw
  modified_base (323)..(323): a, c, t, g, unknown or other
  misc_feature (323)..(323): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgcccccaaactcatgatttgtgagacagtaagcgcctnagggtttcaatcgcttctctggctcaagtctggacacgcgaccgtccctacgacgactactcgtacggtcgtcctacgacgtcgaggacggacggacgtacgtagttactttaacttcgacgtcgtactcgtactagtgtcgagtaggttacacttcttattacgttcgttcgtacgtacggtcgaaccgtacgtaccgtaccgtaactacgacacccgacgtaaccccg

SEQ ID NO: 8289 - DNA, 535 bp, Homo sapiens
  misc_feature: GYAE6OF01CB8SK.37.36.D03.1.454.CMB.1.raw
  modified_base (308)..(308): a, c, t, g, unknown or other
  misc_feature (308)..(308): n is a, c, g, or t
  modified_base (449)..(449): a, c, t, g, unknown or other
  misc_feature (449)..(449): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttgtaccaacagcaccaggacaaacgaccccaaactcatgtatttgngagtcaacgtaaacgcctcgaggtactttctaatcgtcttctctggctacaagtctgacaacgacggccctacctagaactaactctcgtgggcctccgaggctggacggacgaggtctagtatttatactgctgctcatntgacgtaggtctctacttcttagtcgttacgttcggaacgtcgggaacctacggtccaaccgtctaagccacgcccgaacgacccc

SEQ ID NO: 8290 - DNA, 771 bp, Homo sapiens
  misc_feature: GYAE6OF01CENX0.37.36.D03.1.454.CMB.1.raw
  modified_base (246)..(246): a, c, t, g, unknown or other
  misc_feature (246)..(246): n is a, c, g, or t
  modified_base (606)..(606): a, c, t, g, unknown or other
  misc_feature (606)..(606): n is a, c, g, or t
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacgagggtcctcgggcccagtctcgccctgactcacgcctcgcctccgtgtcgtcggtctccgtggacagtcgatcacctatctcctgcacgtacggaaccagcagtnatatagtaaacttataacttgtctacttacggtaaccaacacgaccaaccgaacggaaccaaaaccgaccccctaaaactacaagttagtaagtttggaggaacggaacgaaggtaacggcccggtacccgtacggtaacggggttttactaaacgttccgtcctttcgtccgtacggtcctaaccgtaaacggttccgtacggaaccaaacccggacccggtcccctacccgtacgaacctaacgtccgttccgtcgggtaccctaccggtaacggtaccgttacggggaacgggaaccgggtacggtaccgtacgtttaaacgtttaacttaccgtaggtccgtttcgaccctttaanaagttacgtacgtacggtaaggttacgtacctaacgtttcgttaacggttacgttaccggttaaccgggtaaaccggtacgggttaaacccgaacgggttacccgtaaccccgttaaaccggtaacgtaaccgaacccggtaacccggaaaccggtaaacccccc

SEQ ID NO: 8291 - DNA, 709 bp, Homo sapiens
  misc_feature: GYAE6OF01DZH2Q.37.36.D03.1.454.CMB.1.raw
  modified_base (689)..(689): a, c, t, g, unknown or other
  misc_feature (689)..(689): n is a, c, g, or t
  modified_base (698)..(698): a, c, t, g, unknown or other
  misc_feature (698)..(698): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccactcccccctgtctgcatctggtaggggacagagtcaccactactaccttcgtccgacggacggacgtacgtacggaacgtacttaggtacgtaaacttaaattttaaagtttaaggttacgttactaacgacgaacggaaaaccgaaacgggaaacggaacccccgaaccgtaccgtacccgttcggtacgtaccgtacgtcgtacaactacctaaacgttaaggtaaacgaacggacgtacctactacgtaacggtacgtaggtagggtaaggtaggtagtacgtaggaacgtagttaacgttttaacttttccaccttacacgatacggtccttgacgtagttactaggaaagtaacctagttagaccaacttaatttctttaacttacgttaccaaaccctacctacggttacggacccgggacccgttacgggaaacgaaaacggttggtaaactaacgttaacgaaaacccggtaaagttggtcgggaccctagaccctaaaccacgtttntaccggttnttcctaacccg

SEQ ID NO: 8292 - DNA, 598 bp, Homo sapiens
  misc_feature: GYAE6OF01BWYT3.37.36.D03.1.454.CMB.1.raw
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttggtaccaacagcaccaggacaaacgcccccaaactcatgatttgngaggacagtaagcgcctgtaggggtttcaatcgcttntctggctaccaagtcgtggacaacgaccggcctccctagactaactctcgtacgggtcctccgaggtctggacgggacggaggtcctaggtaatttactactgtcttcgacttacgtaattacgtgacgtaacgggttatacctaacctttcttacgttcggttaccgttaacgggaacggttacgggaacccgtaacggtacctaacccggttcccttaaggtaccgaccgtaccccgaaccggtaaccccc

SEQ ID NO: 8293 - DNA, 505 bp, Homo sapiens
  misc_feature: GYAE6OF01BB9FV.37.36.D03.1.454.CMB.1.raw
  modified_base (458)..(458): a, c, t, g, unknown or other
  misc_feature (458)..(458): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagactgcctccgtgtctgggtctcctggacagtcgatcaccatctcctgcactggaaccagcagtgatattgaaacttataacctgtctcttggtaccaacagcacccaggcaaagcccccaaaactcatgatttgtgaggacagtaagcggccctcaggggtttctaatcgcttctctggctcaagtctggcaacacggcctccctgaccatctctgggctccgagctgacgacgaggctcactattattgcagctcatatacaagcagcatcacttgggtgttcgggnggagggacccgacgtgaacccgttcttaggtcacgcccgaaaggtcc

SEQ ID NO: 8294 - DNA, 553 bp, Homo sapiens
  misc_feature: GYAE6OF01EOGT8.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccactcccccctgtctgcatctgtaggagacagagtcaccatcacttgccaggcgagtcaggacagttggactaacttatttaaattggtatcagcaagaacagggaacgccccaagctcctggtctacgctgcactacctaagttacggaaacaggacgtcccatacgaaggttcaggtggaagtggatcgaggactagttattttacttctaccttcagcagcctgctacgtctagaacgtactattagactaactattacttattcgtaccaactacctaagtcggaccggtacccgtaacgggaacctaaaggtaggtaactaagtaaccgaaacgtacgtcggtaagtcgtacgccaacctattcgttgtccttaccg

SEQ ID NO: 8295 - DNA, 541 bp, Homo sapiens
  misc_feature: GYAE6OF01EJ8UJ.37.36.D03.1.454.CMB.1.raw
  modified_base (283)..(283): a, c, t, g, unknown or other
  misc_feature (283)..(283): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggactaacttatttaaattggtatcagacaagaaaccgagggaaacncccccgaagcctccgtggtctacgctgcatcctaagttacggaaacaggacgtcccagtacgaaggttcaaggtggaagtggatcgtggactagttatttactttcctaccttcagtcacgtcctgctagtctagaagtactattcgactaactattcttaattacgtacaacacctatacgaccgacccgtaggaacctaagtagataacgtaccgaaacgtactggtacgactcgaccacctattcctgtcttacc

SEQ ID NO: 8296 - DNA, 685 bp, Homo sapiens
  misc_feature: GYAE6OF01BERPA.37.36.D03.1.454.CMB.1.raw
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggaccaaacgcccccaaatccatgatttgtgagacagtaagccggcctcgtacggggtttctaatcgtcttctctggctcaagtctggacaacgacggccctaccctcgaccgatcctcgtcgggtcctccgaaggtctacggtaacgacggtaggccttacgtaaccttagtttaactttcggacctacgtaccttacaacttaacgttaaccgaaacgtccgtaacggaccttaaccgttaccgttaaccggttttcgggggttacggtttacccgggggtaccggggaaccggggggtaaacccccggtacccggttacccgggttaaccccgggttttaccggtttaaccggggtttaccccgacccgggttaaacccccgaaacggggttacccccccggg

SEQ ID NO: 8297 - DNA, 625 bp, Homo sapiens
  misc_feature: GYAE6OF01BHUHF.37.36.D03.1.454.CMB.1.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccactcccccctgtctgcatctgtagagacagagtcaccatcacttgccgaggcgagtcgaggacattcggactaaacgttatttaaagttggtaatcgagacaacgaaaccgaagggaaaccgaccccaaagcctaccgtacgtctacgctagacactaccgtaagttacggaaacacggacgtacccatacgaagttacgaagtaggaagtggatcgtaggactagttacttttactacnccttanacgtcacgcctgacgagtactagaactacgattcgaactaacctagtttacttagtacgtaacctaacctaccgtaacgtacgggacccggttaccgtaacgggaaaccgtaaagttcgggtaaactacgttaaaccggaaaacggtcgttacggtacggacccttaaggaccccctaagttactttcccgttgttacctttacccg

SEQ ID NO: 8298 - DNA, 714 bp, Homo sapiens
  misc_feature: GYAE6OF01CT1FZ.37.36.D03.1.454.CMB.1.raw
  modified_base (177)..(177): a, c, t, g, unknown or other
  misc_feature (177)..(177): n is a, c, g, or t
  modified_base (634)..(634): a, c, t, g, unknown or other
  misc_feature (634)..(634): n is a, c, g, or t
tcagtagtgtagatcacgaccggtgctcgatttagctgcgtcacgaggtctctcgtgggggggtcacaagaggcaggcgctctcgggacgtctccaccgatggcctgggctctgctgctcctcactctcctcactcgacggacaccagggtcctgggccccagtctgccctgactcngcctgcctccgtgtcgtggtctccgtggacagtcatcaccatcctcgtgacacgtacggaaccagacgtaggtagtaattacgtttagtaaaactttacgttaaaccttagtaccttaccgttacggtaacccaaacgacggaccaaccccgaacggtaaccaaaaccgaccccccctaaaatcctaagttacggtaacgttttacggtaggaacgggtaaccgtaaggtaaccgggtaccggtacccgtacggttacggggtttactaacgtccgttacttcctcgtcggcctaccgtaaggttccgaccggactaacgaccgtccgtccctacgtacgacttaccgtcgtcgggtccgtaccgaggtccgtggtaacggacgtacgtgtacgtattacgttaactgtacgtcgtacgtacctagttacgacgtgttacgtacgtacgttaccgtnttacgttgttaccggaacggtacgtacggacgtacgtaccggtacctaccggtaacacccgacgacccgactaaccccgg

SEQ ID NO: 8299 - DNA, 275 bp, Homo sapiens
  misc_feature: GYAE6OF01BGSQL.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatcgacccagtcctccactccccctgtctgcatctgtaggagacagagtcaccatcacttgccaggcgagtcaggacagttggactaacttatttaaattggtatcgagacaaacgg

SEQ ID NO: 8300 - DNA, 593 bp, Homo sapiens
  misc_feature: GYAE6OF01ANUZZ.37.36.D03.1.454.CMB.1.raw
  modified_base (307)..(307): a, c, t, g, unknown or other
  misc_feature (307)..(307): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttaggtaccaacagcaccaggacaaacgccccaaactcatgatttgngagacagtaacgcggccctcgacggggtttctaagtcgcttctctcgtctccaagtcgtcggacaacgacggcctcctacgacactctcgtcggtctccgacgcgtgacggacgaggcgtagtatttattactagtcgtgtctacgtacttagtcgacgtagggtacgtactacgttactttacgttacgttacgtttaccgggtaacgttacggggtaccgtaaacggtcccgtaaaccccgttaccgttaacgtaccgaccgtacccgaacccggtaaaccccg

SEQ ID NO: 8301 - DNA, 693 bp, Homo sapiens
  misc_feature: GYAE6OF01CTSPP.37.36.D03.1.454.CMB.1.raw
  modified_base (229)..(229): a, c, t, g, unknown or other
  misc_feature (229)..(229): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgacgttggtgttaataatatgtctcttacggtaccaacatcacaacatccaacccaggaccaaacgtaccccaaactctaattaaatttatagacggtacctaaaccgtaaaccggccctagtacggtacgttttactaacgttcgtacttctcgtcggacctacgtaacgttcgtacggacctaaccgtacccggtcccttcccgtacgtaaccctacttcccgttccggtacgggtaccccttacccgtaaacccgtagggtaaccgggaaccgtaacggtccttaaccgtaacgttaatttacgttcgaccgtacgtcctactaacttactaacacgtaccgtaacgtccgttaccgtacggttcgggttcggttaccgggaccgggtaacggggaccccgtaccgtccgggtacccggttacgttacggtacctaacgggtccccgtaaaccggg

SEQ ID NO: 8302 - DNA, 533 bp, Homo sapiens
  misc_feature: GYAE6OF01B1TWQ.37.36.D03.1.454.CMB.1.raw
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgatattgaaacttataacccttgtctcttggtaccaacagcacccaggcaaacgccccaaactcatgatttgtgagacagtaacgcggccctcgaggggtttctaatcgcttctctcggctccaagtctggcaacncgcctcctnacatctctggctcgaggctgagacgagctagattacttactgctgcctacattatcgctaggttcgctacgttcttatcgttccgtttcggaacgttcgggacctaacggtcctaacccgttacttaacgtaccaacgtcccgaacgtaacccccg

SEQ ID NO: 8303 - DNA, 723 bp, Homo sapiens
  misc_feature: GYAE6OF01BRHUQ.37.36.D03.1.454.CMB.1.raw
  modified_base (269)..(269): a, c, t, g, unknown or other
  misc_feature (269)..(269): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgccctgactcagcctcgcctcgtgtcgtcgggtctcctggacagtcgatcacctatctcctgcacgtacggaaccagcagtgattattagtaaacttactaacgttnttcttcgttacggtaaccaacacgaccaaccgacggaaccaaaccgaccccctaaatcgaatgtagtttagagaacggtaactaaggtaacggccggtaccgttacggttaacgggtttactaacgtcgttccttcgtcgtcggaccttacgaacgtcgtacggaaccaaccgtacccggtcccttaccgtacgaaccttaacgttcctccggtacgggtccctaccgggcggacgtagggaaccggacgggtgtacgtagttaacttacgttacgcgtacttcgtacttacgtaacgttaggtaccggacgttaacggtacttaccttacggttactttacggtcggtttacccggtaacgggttacggtaaccgggtaacccgtaccggttaacccgtacccgttaacggttaaccgacccgaaccggtaaccccgtaacccggtaaccccc

SEQ ID NO: 8304 - DNA, 569 bp, Homo sapiens
  misc_feature: GYAE6OF01DTGXN.37.36.D03.1.454.CMB.1.raw
  modified_base (308)..(308): a, c, t, g, unknown or other
  misc_feature (308)..(308): n is a, c, g, or t
  modified_base (377)..(377): a, c, t, g, unknown or other
  misc_feature (377)..(377): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactcggaaccagcagtgaatattgaaacttataaccttgtctcttggtaccaacagcaccagcaaacgccccaaactcatgatttgtnaggaacagtacgcgcctgagggtttctaatcgtcttctctggctccaagtctgacaacacggccctccngaacatctcgtcgggctccgaggctaggacggacggacggtctgtaatttacttactcgtcgtgtctcattagtcgtctaaggtgtaccgtacttacgtttgttcgttcgttacggtaacgtcggtaaacccgaacggttacccgaaccggttacctaaacgtccgtaacgacccgtaacggtaaccccccg

SEQ ID NO: 8305 - DNA, 661 bp, Homo sapiens
  misc_feature: GYAE6OF01BY4C9.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacgagggtcctgggcccagtctgtcctgactcagcctgcctccgtgtctggtctccgtggacagtcgatcaccatctcctgcactggaccagcagtgatattgaacttataaccttgtctcttgtaccaacagcaccagcaaacgccccaactcatgtatttgtgaggacagtaacgccggtccctgtacggggtttctaagtcgtacttctcgtcggcctaccgaacgtcgtacggaccaaaccgtacccgggtcccttaccccgtaggaacctaaacgtttcccgtacggtccgggtaccttacccggacggtacggtacggtaaccgggaacggtacggtacgtacgttaacgtttacgtttacgtcgtcgtacgtacgtacgtaagttacgtacggaacgttagggtacgtaccgttacttacgtttagtcggttacggtaccgggtacggtacggtaaccgtacggtaccgtaacccgttccgaacgtaccgaacccgtaccgaacccgtaacccccg

SEQ ID NO: 8306 - DNA, 672 bp, Homo sapiens
  misc_feature: GYAE6OF01DANI3.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtcctccgtggacagtcgatcacctatcctcctgcacgtcggaaccagcagtgattaattagtaaactttactaacctttgtcttcttacggtaaccaacacgccacccgagaccaaaccgaccccaactcatagtatttgtaggagtaacgacggtaacgccggtcccgttacggttagggggtttactaacgtccgttacttctcggtacgcctaccgtaagttccgtacggaccaaaccgtaccggtcccttacccgagtacctaacgtccgtacggtcggaccttccggaaggtcgtacggaacgggtacggtacggtacttagttaacttttacgttacgtgtcgttcgtcctagtacgtagtcgacgtaggttactaccttacttcttacgttacgttacggttaacggtacggtacggtaaccgtaccgtacttaccgtaccgtacgtaccgacccgtaaccgtaccgtaacccccg

SEQ ID NO: 8307 - DNA, 611 bp, Homo sapiens
  misc_feature: GYAE6OF01E4TY2.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttgtaccaacagcaccaggcaaacgcccccaaactcatgtatttgtgagacagtaagccggccctcgtaggggtttctaagtcgtcttctctggcctaccaagtctggacaacgccgcctccctgacaatcctcgtcgggtcctccgaggtcgtaggacgggacggtacggtcgttagtaactttattactgtctggtcctacgtatacgtcgtacgtagggttacttactacttacgtttagttcggttaccgttaccgggtaacggttaccggggtaacccgtaaccgggtaccctaaccccggttaccgtaacgtacccgaaccgtaccccggaaacggtaacccccc

SEQ ID NO: 8308 - DNA, 651 bp, Homo sapiens
  misc_feature: GYAE6OF01BTAMS.37.36.D03.1.454.CMB.1.raw
  modified_base (228)..(228): a, c, t, g, unknown or other
  misc_feature (228)..(228): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggcaaacgcccccaaactcatgatttgtgaggacagtaacgccggcctcgtaggggtttactaagtcgtcttctctcggctccgaagtctggcaacgaccggtcctcccgtgactaacgtctacgtcgggtcctccgagggtcttggaacgggaccggacgggctttagaacgttttaacgtttaacgtcggtccttggaccttaccgtaagttacgtttaggaccgtaagggttaacgtccgttacttacgtttacttacggtttccgttaccgggtaaacgttacgggggtaaacccgtacgggttaacccgtaaccccggtttaccgtaaacggtacccaccgggacccccgtaaacgggtaaccccccc

SEQ ID NO: 8309 - DNA, 545 bp, Homo sapiens
  misc_feature: GYAE6OF01D9MHS.37.36.D03.1.454.CMB.1.raw
  modified_base (230)..(230): a, c, t, g, unknown or other
  misc_feature (230)..(230): n is a, c, g, or t
  modified_base (368)..(368): a, c, t, g, unknown or other
  misc_feature (368)..(368): n is a, c, g, or t
  modified_base (410)..(410): a, c, t, g, unknown or other
  misc_feature (410)..(410): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggcaaacgccccaaactcatgatttgtgaggacagtaagcggcctcgaggggtttctaatcgcttctctggctccaagtctggcaacncggcctccctgacaatctctgggcctccgaggctgaggacgnggctgatttattactgctgctcatatgcaggtagtcacttcttagtgttcgttacggaacgttggggaacccgtaaagggttccaacccggttaccgttaaacgtccgaaccggaccccgaagggtaaccccccc

SEQ ID NO: 8310 - DNA, 507 bp, Homo sapiens
  misc_feature: GYAE6OF01A1K0G.37.36.D03.1.454.CMB.1.raw
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgcccccaaactcatgatttgngaggacagtaagcgcctnagggtttctaatcgcttcnctggctcagtctgcaacncgcctccctgacatctctgggctcgaggctgaggacgaggctgtattatactgctgcttacattatcgctagggtactctatcttatgtcttacggactgggactaggtccaccgtactaagtcacgcccaaggccctaacccg

SEQ ID NO: 8311 - DNA, 784 bp, Homo sapiens
  misc_feature: GYAE6OF01CSA15.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatcgacccagtcctcccactcccccctgtctgcatctagtaggagacagacgtcaccatcacttgccgaggcgagtcgaggactagttacggactaaacttaatttaaagttggtaatcgaagacgaaacggaaaaccgaacgggaaaccgccccaaagtcctaccgtaggtcctacgcgtacgactacttaccgtaaagtttacgggaaaacctacgggtaaccgttacccgtaagttaccgtaaacgggtttacgtaaagggtaagggtaaacggttacgggtaacgttacggtacgggtaaacgttaacgtttaacgttttttaacccgttttacccaacccgttttaccgaacggtaccctaacggtccccgtaggtaccgttaacggttacgtaacggtaaacgtaaccttagtttaccggaaccttaaacttacgttttacctttaacgttaccggtaacctaaacccgtaccgtaacggttaccggaaccccgggttaccgtaacgggggaaaccctaaaaggggttccggtaaataaaccggtaaaccgtaaacggtaacggttcgggacggtacctacgtacccggtaaactcgttaccgttcgtttccttaacccg

SEQ ID NO: 8312 - DNA, 525 bp, Homo sapiens
  misc_feature: GYAE6OF01BDCGF.37.36.D03.1.454.CMB.1.raw
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtggttataactatgtctcttggtaccaanatcaccaggcaaacgtccccaaactcatgatttangagtcaactaaacggcctcagggtctctaatcgcttctctggctccaagtctggacaacacggccctccctcgaccattctcgtcgggctccgaggctgacgacgaggctcactattatgcngtcncatanacagcagctatcgtacttggggtcgttcgggcgggacgggtacccgaccgtcggtaccgtcgttaggtccaacggtcccgaggtcccg

SEQ ID NO: 8313 - DNA, 595 bp, Homo sapiens
  misc_feature: GYAE6OF01CR53P.37.36.D03.1.454.CMB.1.raw
  modified_base (229)..(229): a, c, t, g, unknown or other
  misc_feature (229)..(229): n is a, c, g, or t
  modified_base (502)..(502): a, c, t, g, unknown or other
  misc_feature (502)..(502): n is a, c, g, or t
  modified_base (576)..(576): a, c, t, g, unknown or other
  misc_feature (576)..(576): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattagaaacttataaccttgtcttcttggtaccaacagcacccaggacaaacgccccaaatcatgtatttgtagaggacagtaagcggtcctcgtaggggtttcaagtcgcttctcgtaggtctaccaaagtcgtacggacaaaccgaccgggtccctacccgtagaccctaagttcctacgtcggggacccttccgaaggcctaggaaccgacggaacggtcctacgtaaccttatttagttcgactaacgtcacctatactanaagtcagtcatcgaccgttggggtacgttccgggaggagggaacccgaccgtaggacccgttacgtaacggtanacggtcccgaaggtccccg

SEQ ID NO: 8314 - DNA, 804 bp, Homo sapiens
  misc_feature: GYAE6OF01C875R.37.36.D03.1.454.CMB.1.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctcgccctgactcagcctgcctccgtgtcgtcgggtctccgtggacagtcgatcaccntcctcctgcacgtggaaccngcagtgaatattagaaacttataacttgtcttcgttacggtaccaacacgaccaacccgaggaccaaaaccgaccccctaaaatcctaagtcgtaagttttaggacggtaacggtaacgaaggtaacgccgggtaccccttaggttacgggggttttaacctaacgtccgttacgttccgtcgttcgggtacctaccgtaaaggttccgtacgggaacctaaacccggacccgggtaccccttacccgtaagaacccttaacttcccgttcggtacgggtcctaccggaacggtcgtaggaacgggtacgaggttcgttaggtaatttacgtttaacgtcgtacgttacgaccgttactaaggttacttacgggtacgtaaccgggtttacgtaccgtttaaccgtttagttaaccggtttacggtttaccccgggttaaaccgggtaaacgggttacccggggtaaaacccgttaacccgggtttacccgtaaaccccgggttaacccgtttaaaaggacccccgggtaaacctaaccccccgggaaacccgggttaaacccccccc

SEQ ID NO: 8315 - DNA, 522 bp, Homo sapiens
  misc_feature: GYAE6OF01BP8YN.37.36.D03.1.454.CMB.1.raw
  modified_base (228)..(228): a, c, t, g, unknown or other
  misc_feature (228)..(228): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (450)..(450): a, c, t, g, unknown or other
  misc_feature (450)..(450): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatattgaaacttataaccttgtctcttggtaccaacagcacccaggcaaacgcccccaaactcatgatttgtgaggacagtaagcgccctcgtaggggtttctaatcgcttctctggctcaagtctggcacncgcctccngacatctctgggcctccgaggctggacggacgaggtctagatttatactgctgctcatatgctaggtactctactnttatcgttcgttacggaacgtcgggaaccaacggtccaccgtacgtaacgtccacggacccaacggtacccc

SEQ ID NO: 8316 - DNA, 669 bp, Homo sapiens
  misc_feature: GYAE6OF01AZG18.37.36.D03.1.454.CMB.1.raw
  modified_base (284)..(284): a, c, t, g, unknown or other
  misc_feature (284)..(284): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccactcccccctgtctgcatctgtaggagacagagtcaccatcacttgccgaggcgagtcaggacagttcggactaacttatttaaatggtatcagacaagaaaccgaggaacnccccaagcctcgtgtctacgctcgctactacctaaagtttacggaaaccaggtaccgtaccctaagtaccgtaaagggtttcaagggtagggtaaaggtgggaagtttcggtaggggaactaaggtttaactttttaacctttacctaacccgtttcgaacgtccgtaacgtccgtacggacctaggtaccgtaggaaacgtactattcgactaactattactttacttacgtaccaaaccgtaccgtagtaccgggtaacccggtacccgtaacggggtaaccctaaacgggtacggtaacttaaccgtaaccgtaaaacgtaacggttggtaccggtactaccggtaccctaacccgtacgttccgttcgtttaccttacccg

SEQ ID NO: 8317 - DNA, 709 bp, Homo sapiens
  misc_feature: GYAE6OF01EGI83.37.36.D03.1.454.CMB.1.raw
  modified_base (230)..(230): a, c, t, g, unknown or other
  misc_feature (230)..(230): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctgccctgactcagcctgcctcgtgtcgtgggtctctggacagtcgatcaccatctcctgcactggaaccngcagtgtatattagaaacttataaccttgtcttcgttacggtaaccaacacgccaaccccgaggaccaaacgacccccaaatctagtgtatttgtaggaagacaggtaacgccggtccctacgtacgggtttactaacgtcgtcttcgtcgtcggcctacgtacgtcgacggaccaaaccgtaccggtccctaccctacgaacctaacgttccgttcgtcgggtaccctaccggacggtccgtacggacgggtaccggtacggtaccgttagttaactttacgtttaccgtcggtacttacgtcgtacgtagttacgtacggtaccgtaagggttaccgtacctaacctttcgtttaccttcgggtttacccgttacgggttaacggtacccgggtaaacccgtaaccggttaccccgtaacccgttaacccgttaacggacccgtaaccggtacccccggtaaccggtaacccccccg

SEQ ID NO: 8318 - DNA, 605 bp, Homo sapiens
  misc_feature: GYAE6OF01CL9NE.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataacttgtctcttgtaccaacagcacccaggacaaacgcccccaaactcatgtatttgtcgaggacaagtaacgcggaccctcgtaggggtttctaagtcgtcttctcgtggctaccaagtctagggcaaccgacggccctccctgactaactctcgtcgggcctccgaggctggagggacgaggtctagtatttacttactgcttcgcttacaagttagtgtctaagggttacttccgtactttacgttattcggttaccgtttacgggtaaccgttacggggacccgtaaaccgggtcccgtaacccgttacccgttaacggtacgaacccggaccccgtaaaccggaacccccg

SEQ ID NO: 8319 - DNA, 670 bp, Homo sapiens
  misc_feature: GYAE6OF01A8JLX.37.36.D03.1.454.CMB.1.raw
  modified_base (232)..(232): a, c, t, g, unknown or other
  misc_feature (232)..(232): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccatctcctgcacgtggaaccngcagtgatattagaaacttacttaaccttgtcttcgttaggtaaccaacacgccacccgaggaccaaacgacccccaactcatgtatttgtagaacgacagtaacgccggtccctacggtagggtttactaagtcgtacttctcgtcggctacgaagtctacggaccaaccgcgtccctcctacgactaactcgtcgtgggtcctaccgacggtcgtagggaacggacggtacggtcgttagtaactttacgttacgtcgtcgttcgtacctagtaacttcgtacgtacggttaaggttactacccgtaagtttacctttacggttcggtttaaccggttaccgggttaaaccggtaccgggtaacctaaccgggttaccctacccggttaacgtaaccgtaacccgacccgtaaccccggtaccggtaaaccccccg

SEQ ID NO: 8320 - DNA, 700 bp, Homo sapiens
  misc_feature: GYAE6OF01A89QS.37.36.D03.1.454.CMB.1.raw
  modified_base (226)..(226): a, c, t, g, unknown or other
  misc_feature (226)..(226): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcacatctctgcactggaaccngcagtgatattagaaacttataaccttgtctcttcggtaccaacagccaccaggacaaaccgaccccaaactcatcgtatttgagagacaggtacgcggtacctacgtaggggtttactaatcgtcttcgtcgtgtctaccgtacgtcgtcggacaaccgtaccggtccctccctacgaacctaacttcgttacgtcggggtacctaccgtacgggtcgttagggacgggtaaccggtagggtacctaggttaactttaacggtttacgttacgtacgttcgtaccttacgtaagttacgttaccggtacgttaaggttaccgttaccgttaacccttacgtttacgttacggtttaccgtttaaccgggttaaccggtaccggggtaacccgtaaccgggttaaccccgtacccggtttaaacccgtacggttacccgaacccggtaccccgtaaacccggtaaacccccccg

SEQ ID NO: 8321 - DNA, 678 bp, Homo sapiens
  misc_feature: GYAE6OF01ETSCK.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatcgacccagtcctccactcccccctgtctgcatctgtaggagacagacgtcaccatcacttcgccgaggcgagtcaggactagtcggactaacttaatttaagttggtatacgagacaacggaaaccgagggaaccaccccgaagcctccgtggtacctacgctgactactactaagttacgaaacgacgaccgtaccagtacgtaaggttcgaaggtaggaaggtggatcggtagggtaactaggttactttttacttacctaccttagactacgtacgtccgtacgtacgtacgttataacggtaacgtaccgtaagttacgaaccttaacgttactttacgtttaacgttacctaacccgtaaaccgtaaccgttacgtaccgggaacccggtacccggtaacgggaaacccgttaaagggtacgtaaacgttaaacgtaaacgaaaaccggttacgtacgggtaccggtaccttacggaacccttacctaagttcccttacgtccctttaacccg

SEQ ID NO: 8322 - DNA, 729 bp, Homo sapiens
  misc_feature: GYAE6OF01EPUL9.37.36.D03.1.454.CMB.1.raw
  modified_base (429)..(429): a, c, t, g, unknown or other
  misc_feature (429)..(429): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccactcccccctgtctgcatctgtaggagacagagtcaccatcacttgccgaggcgagtcgaggacagttggactaaacttaatttaaattggtatacagacgaacgaaaccgaagggaaaccgcccccgaagcctcccgtggtacctacgctgactactacctaaagtttcggaaactaggacgtacccatcgtaaggttcgaggtaggaagtgggtatcggtagggaactagttatttttaccgttactacccttanacgactacgcccgtgtacgtacgttcgtagaaacggtacctaagttcgaacctaacgtactttacgtttaagtttaccgtaacctaacccgtaaacccgtaacggttaccgggtaaccccgggtacccccggttaaaccgggggaaaccccgtaaaaagggtttaccggggtaaacgtttaaaacccgttaaacccggtaaaaaccggggttaaccgttcgggggttaccggtaacggttaccccgtaccggtaaaccccttaacgttccccgtttacggtttaccccttttacccccgg

SEQ ID NO: 8323 - DNA, 796 bp, Homo sapiens
  misc_feature: GYAE6OF01C13F5.37.36.D03.1.454.CMB.1.raw
  modified_base (231)..(231): a, c, t, g, unknown or other
  misc_feature (231)..(231): n is a, c, g, or t
  modified_base (328)..(328): a, c, t, g, unknown or other
  misc_feature (328)..(328): n is a, c, g, or t
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccatctcctgcactggaaccngcagtgattattagaaactttactaacctttgtccttacgttacggtaaccaacgacgccacccgaggaccaaaccgccccaaactcatgtatttgngagacaagtacgcggtcctagtacgggtttcaatcgtcttctcgtcggctaccgtaagtcgtacggaccaaccgccggtccctaccgtagtaacctagttccgttcggtcgggtaccctaccggtacggtacgttagggaacgggtaaccggtacggttaccgttaagttaacgttttaacgtttaccggttcgttaccgtttacgggtacccttaaccgttaacgtttaaccggttacgggtaacccggttaagggttttacccgtaacctttaacccgttttacgtttaccggttaccgggttttacccgggttaaacccggggttaacccgggttaaccgggggttaaaccccgttaacccggggtttaacccccgttaaccccgggttttaaacccgttaaacccgggttccccggtaaaccccgggtaaacccccgggtaaacccccgggttaaacccccccc

SEQ ID NO: 8324 - DNA, 682 bp, Homo sapiens
  misc_feature: GYAE6OF01A7DKG.37.36.D03.1.454.CMB.1.raw
  modified_base (247)..(247): a, c, t, g, unknown or other
  misc_feature (247)..(247): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcgaggacacgtacgggtccgtcgggcccagtctcgccctgactcagcctgcctcgtgtcgtgggtctccgtggacaggtcgactccaacctatccgtcctgccacgtacggaaccngcgtagtgtaattagttaacgtaaactttaacttaacctttcgtcttcgtttacggtaacccaaacacggaccaacccgacggaccaaaaccgacccccaaactccaagttgtagttttcggaggacggaactaacggtaacgccggtccctaggtacggggtttactaagtccgtctttctcgtcgcctacgtaagttcgcgaccgtaacaccggtccctaccctagaacctaacgtcctacggtcggcctcgacggtctaggacggacgaggtcgtagtatttacgttacgtcgtcgtcgtactctaagtacgtcgtacgtaaggtcgtacctacgttgttacgtcgtttaccgtcgggtaaaccggttcgggtaaaccctacggtacccgtaccgttacctaggtaccaaccgacccgtaacgtaacccccg

SEQ ID NO: 8325 - DNA, 653 bp, Homo sapiens
  misc_feature: GYAE6OF01DVLAX.37.36.D03.1.454.CMB.1.raw
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcagacacagggtcctgggcccagtctgccctgactcagcctgcctccgtgtctgggtctcctggacagtcgatcaccatctcctgcacgtgaaccngcagtgatattgaaacttataacctgtctntggtaccaanagcaccgagaccaaaacgccccaaactcactgtatttcgtgaacggacaaggtaacgccggtccctcgtaggggtttactaattcggtacttctcgtggtactccgaagtcgtggaccaaaccgtaccggcccttacccctaggaacctaacgttcctcggttacggggccctccggaacggtcgttaggacgggaaccggtacggtcgttagttatttagttaacctgtacgtcgtctacctatacgttcgacgtggttactacgttacttacgttacttcggttaccgttaccgggtaagttccggggtaaacctaacggggtccctaaccccggttaacgttaacggtacccaaccggtaacccgaccggtaaaccccccg

SEQ ID NO: 8326 - DNA, 648 bp, Homo sapiens
  misc_feature: GYAE6OF01DCFY2.37.36.D03.1.454.CMB.1.raw
  modified_base (532)..(532): a, c, t, g, unknown or other
  misc_feature (532)..(532): n is a, c, g, or t
tcagtagtgtagatcacgaccggtgctcgatttagctgcgtcacgatctctcttggggggggtcacaagaggcagcgctcgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtgaaccagcagtgatattagaaacttagtaaccttgtcttcgttagtaccaactacgaccaccaggaccaaaccgaccccaaactcatcgtatttgtgaagacagtaacgccggtacctcgtacggggtttactaacgtccgtcttctcgtcggtacctccgtaaggtcgttacggaccaaccgtacccgggcccttaccctacggtaacctacgttccgttacgtacggggtcccttaccggagggttcgacgggtaacgggacgggtaaccgtcgttaggttaacttttacgtacgttcgtcgttcncttacgagtcgtagcgttaggtactcgtctttcgtagttcgttaccgtacggtaacgtacggaccgttaaccggtccttacccgtactaacgacctaaccggccgaaccgtacccc

SEQ ID NO: 8327 - DNA, 571 bp, Homo sapiens
  misc_feature: GYAE6OF01BGPE1.37.36.D03.1.454.CMB.1.raw
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (391)..(391): a, c, t, g, unknown or other
  misc_feature (391)..(391): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctgccctgactcagcctgcctccgtgtctgggtctccgtggacagtcgatcacatctcctgcactggaaccngcagtgatattagaaacttataactgtctcttgtacaangcaccagacaacgccccaaatcatgattgngaganagtagcgcctcgtaggttctatcgtcttctctgtctacgagtctaggacacgaccgctcccgtagactacgtctcgtcggctacgngcgtaggacggtacgaggtctagtattacgttacgtgtcgtgactactagttcgtacgacgtagtacgtaccttacgttacttacgtaccgttcggttacgggtaaacgttcgggtaaccgtaacggtaccctacccgttaccttaaacggtccaaaccggcccgtaaccggaacccccg

SEQ ID NO: 8328 - DNA, 515 bp, Homo sapiens
  misc_feature: GYAE6OF01DKXQ9.37.36.D03.1.454.CMB.1.raw
  modified_base (459)..(459): a, c, t, g, unknown or other
  misc_feature (459)..(459): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctctgcactggaaccagcagtgatattgaaacttataaccttgtctcttggtaccaacagcaccaggcaaacgaccccaaactcatgatttgtgaggacagtaagcgccctgaggggtttctaatcgcttctctcggctcaagtctggcaacacggcctccctgacaacgtctctcgggctccaggtctggagacgaggtctgtaatttatactgtactgactctatatgactaggtactctacttntattcgtcttacgagtcggactaggtcaccgtactacgcacgccctaacggacccc

SEQ ID NO: 8329 - DNA, 559 bp, Homo sapiens
  misc_feature: GYAE6OF01D3WMA.37.36.D03.1.454.CMB.1.raw
  modified_base (310)..(310): a, c, t, g, unknown or other
  misc_feature (310)..(310): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttaggtaccaacagccaccaggacaaacgcccccaaactcatgatttgngagacagtaagcggcctcgtaggggtttctaatcgtcttctcgtcggctaccaagtctaggcaacgaccggccctcctgactacttccgtcgtcgggctccgaggtctggaggacgaggctagtatttactactgtctgctcgatagtgcgtaggtactctacttcgtttatcggttaccgttacggtaacgtcgggtacctaacggtcctaacccgttactaacgtccacggaccccgaggaaccccc

SEQ ID NO: 8330 - DNA, 593 bp, Homo sapiens
  misc_feature: GYAE6OF01C6MT9.37.36.D03.1.454.CMB.1.raw
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccntcctcctgccactcggaaaccngcagtcgattattgaaaacctttataacctttgtccttcttggtaccaacagccaccgaggcaaaccgcccccaaatcatcgtattgttgagacagtacgcggccctcgcggtctactactacgtcttctctcggactaccgacgttctcggacgaccacggtccgtccctaccgaccactctctggccgtctacgcgtcgacggacggacgccgtctacgttatattttcgactacgactactataactactaacgacagactataccgttcgtagggttcggttacgggcgggtaacggggtaccgtacccgtcggttacccgtacggttacggtacgtccgtccgtaacccggg

SEQ ID NO: 8331 - DNA, 553 bp, Homo sapiens
  misc_feature: GYAE6OF01DP5VN.37.36.D03.1.454.CMB.1.raw
  modified_base (144)..(144): a, c, t, g, unknown or other
  misc_feature (144)..(144): n is a, c, g, or t
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (223)..(224): a, c, t, g, unknown or other
  misc_feature (223)..(224): n is a, c, g, or t
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
tcagtagtgtagatcacgaccggtgctcgatttagctgcgtcacgatctctcgttggggggggtcacaagaggcagcgctcgtcgggacgtctccaccatggcctgggctctgctgctcctcactctcctcactccaggacacngggtcctcgggcccagtctcgccctgactcacgcctcgcctccgtgtcgtcgggtctccnggacagtcatcacntctcnncanggaccagcagtnatatanaacttatacttgtctntgacangcacagacaacnccccaatcatgatttgagagacagtaacgcgacctgtacggttctatcgtcttctcgtcggtcctacgtaagttcncggacaaacgcgtcccttccganactacgtctcgtgggtctccgaggcgtaggacggacgtaggtctagtatttaatctgctgtccttagtactagcgtacgtaggtactctactttacgttacgtcggttacgtacggtaacgtacggaacgttaccgccgtaccgtacgacgaccgaccgtaacccgaccgtaccc

SEQ ID NO: 8332 - DNA, 768 bp, Homo sapiens
  misc_feature: GYAE6OF01CHER7.37.36.D03.1.454.CMB.1.raw
  modified_base (629)..(629): a, c, t, g, unknown or other
  misc_feature (629)..(629): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctcgccctgactcacgcctcgcctcgtgtcgtgggtctcgtggactagtcgactccacctatcctctgccacgtacggaaccctgactagtagtaattaagttaacgtaaaactttacttaaacctttgtaccttacgttaccggtaaccaacgaccgacccaacccgaacggtaacccaaaaccggtaacccccctaaataccgtaagttaggttaacgtttttcgggaacgggtaacggtaaccgtaacgggttaaccggacccgggttaccccgttacgggttaaccgggggttttacctaacggttcccgttacgttccgttcgtaccggtacctaaccgtaacggttcgtacggaacccgtaaccgtacccggtccctcccgtaacgtaacctacgttccgttcgtacgggtcctaccggacggtactagggacggtacggacgtacttagttaactttactacgngtactcgactacgtatagtcgtaagtacggtactacgtacttacgttcgtacgttacggttacgggaaaccgtacgggtaacccgttagtaccccgtaacgttaccgaagtacccgaaccgtcccgaacgtaacccccg

SEQ ID NO: 8333 - DNA, 846 bp, Homo sapiens
  misc_feature: GYAE6OF01CA0UL.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtcctccactcccccctgtctgcatctgtaggagacagagtcaccatcacttgccaggcgagtcgaggactagttcggactaaacgttaatttaaagttggtaatacgagacgaagaaaaccgaaggggaaaccgtcccccaaagtcccgtccgtacggtcctaaccgcctggactaaccttaccgtaaagtttacgggaaaacctagggaaccgtacccaagtaccgtaaaggtttccgaagggttaaggtaacgggtggtaacgttaccggtaggggtaacttaaggtttacgttttttaaccgttttacccgtaacccgttttaccgaacggtacctaacggtccccgttacggaccgtaacgttaccgtaacgggtaaacgtaaccgttagtttaaccggaaccttaaaccggtaacttttaccgttttaaacgttttaacggttaaccccctaaaaccgttaaccccgtaaacggttaacccggggaacccccggggttaccccggttaaaccggggggtaaaaccccgttaaaaacgggttaccgggtaaaacctttaacggttaaacccggtaaaaaccgggttaaccgttacgggggttaccgggtacccggttaaccgaacccgttaacccgtaacgttttccctttagggtttaccccttttaaccccgg

SEQ ID NO: 8334 - DNA, 730 bp, Homo sapiens
  misc_feature: GYAE6OF01ARQ0U.37.36.D03.1.454.CMB.1.raw
  modified_base (313)..(313): a, c, t, g, unknown or other
  misc_feature (313)..(313): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttggtaccaacacgccaccaggaccaaacgcccccaaactcatgtatttgngaggacagtaacgcggtccctacgtaggggtttactaagtcgtcttctcgtcggtcctaccgtaagtccgtacggaccgtaaaccgacccgggtccctacccgtacgaacctaacttccgttacggtcggggtaccctaccggtacgggtccgttagggacggggtaacgggaacgggtcgttaggttaacttttaacgtttaacgtcggtacgttcgtccttactaacgttaggttacggtacgttaacggggttacgttaccttaacttacgtttaacgttcggtttaacccggtttaccgggtaaaccggtttcgggggaaaccccgttaaccgggttacccgttaaccccggttacccggttaacgtaaccccggaacccggtaacccccggtaaacccggtaaacccccccg

SEQ ID NO: 8335 - DNA, 514 bp, Homo sapiens
  misc_feature: GYAE6OF01CVR5R.37.36.D03.1.454.CMB.1.raw
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgccccaaactcatgatttgtgagacagtaagcggccctcgaggggtttctaatcgtcttctctggctccaagtctgacacacggcctcctgacatctctgggctcagctgaggacgaggctagtatttatactgtctgctnatntgntaggtatctactcttagtgtcgttacggattcgggaccgtaggtcctacccgtctaacgtaccacgaccccaaggtaccccc

SEQ ID NO: 8336 - DNA, 640 bp, Homo sapiens
  misc_feature: GYAE6OF01BCD64.37.36.D03.1.454.CMB.1.raw
  modified_base (293)..(293): a, c, t, g, unknown or other
  misc_feature (293)..(293): n is a, c, g, or t
  modified_base (495)..(495): a, c, t, g, unknown or other
  misc_feature (495)..(495): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctcgggcccagtctcgccctgactcacgcctcgcctccgtgtcgtcgggtctccgtggactagtcgatccactactcctcctgccacgtacggaacagcgagtgattattagtaaacttataccttgtctcgtacggtaaccaancgccaccgaggacaaccgaccccaatcatgtatttgagagactaggtacgccgtacctggtaggttactacgtcgtacttcgcgtcgcctacgtacgtcgacgtacaccgtccgtcctaccgacgtactacgtcgtacggtcgacctcggacgtacgtagggacggtacggtacgtcgttagtactttacgtacgtgtcctntactactagtatacggtacgtacgtacttacgtacttctttacgtacgttaccggttaccgggaacgtacgggtaaccgttaccggtacccgtaacccgttacggtaacgtaccgaaccccggtaacccgaaccggtaacccccc

SEQ ID NO: 8337 - DNA, 680 bp, Homo sapiens
  misc_feature: GYAE6OF01AFRK6.37.36.D03.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcacgcctgcctcgtgtctggtctcgtgacngtcatcactatcctctcgcacgtcggaaccngactagtgattattacgtaacttataccttgtcttcgttacgtaccaacacgaccacccgaacggaccaaaccgtaccccaactactagtagtagtttggaggtacggacgtaggtaacggccggtacccgtacggttacggggtttactaacgttccgtcttcgtcgtcggtacctaccgtaacgttcgacgtaccgaaccgtcccggtccctaccgtacgactacttccgtcggtccgtacccgtacgcggtcgtagggacgacggtacgtactacgtacttacgttcgtagtacgcgtacctagtactacgtacacgtacctgtaccgtacgtcgggtttggggtaccggttaccggggacgggttacccgggtaccggtcccggttacggtacccgtttacgggtaccggtaccgaccggtacccgtacgggtcccgtaccccggg

SEQ ID NO: 8338 - DNA, 718 bp, Homo sapiens
  misc_feature: GYAE6OF01B41VR.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatcgacccagtcctccactcccccctgtcctgcatctagtaggacgacagacgtcaccatcacttgccgaggacgagtcgaaggactattacggactaaacgttaatttaaacgttggtaatcgaagacgaacggaaaaccgaacgggaaaccgtacccccaaagtcctaccgtcggtactacgcgtagactaactaccgtaaagtttaacggaaaacgtacgggtaaccttaccccgtaaagtaccgtaaagggtttaccgaagggtaagggtaaggtcggtaagtaccggtagggaaccttaggtttaactttttaccgttaccgttaaccttacgtagtacccgtagtacccgttggaacgtacgtacgtaacggtaactaccgtaattacggaacctaaactaactttacctttaagttacgtaaccaaaccgtaaccgacgttacggtaccgggaccccttaaggggaaccctaaaggtaccggtaaactacgtaaactaaaccggtacgttcggtacgcttacgacccaacttatacggttctacgttaacccg

SEQ ID NO: 8339 - DNA, 675 bp, Homo sapiens
  misc_feature: GYAE6OF01ELQCN.37.36.D03.1.454.CMB.1.raw
  modified_base (231)..(231): a, c, t, g, unknown or other
  misc_feature (231)..(231): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtctggtctccgtggacagtcgatcacctatctcctgcactggaaccngcagtgattattagaaactttataaccttgtcttcttcggtaaccaacacgaccacccgaaggaccaaaccgcccccaaaatcatagtatttggtagtaggactaggtaacgcggccctaggtacggggtttactaagtccgtcttctcgtcggcctacgaagtctggacaaccgccggcccttacccgagacctaactccgtcgtcgggccttaccgacggcgtaggaacgggaccggtaggtaccgttagtaatttacgttacgttgtcgtcgtaccttatagttagtacgacgttaggtaccgttactaccgttactttacgtcggtttaccgttaacggggtaacccgttacggggtaaaccctaacggggtttacccgaaacccgtttacccgttaacggttacccaaccggttaacccccgaaaccgggtaacccccc

SEQ ID NO: 8340 - DNA, 680 bp, Homo sapiens
  misc_feature: GYAE6OF01DQ1H3.37.36.D03.1.454.CMB.1.raw
  modified_base (243)..(243): a, c, t, g, unknown or other
  misc_feature (243)..(243): n is a, c, g, or t
  modified_base (390)..(390): a, c, t, g, unknown or other
  misc_feature (390)..(390): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgccctgactcacgcctcgcctccgtgtcgtcggtcctccgtggacagtcgactcaccatcctcctgacacgtacggaaccngcagtgattatacgtaaacttactaccttgtctcgttacggaaccagcgccaccgacgactaaccgaccctaagtcacgttagtagtttgacggaagacgaagtaaccggccggtaccctaggttagggtttacacgtcgtcttcgngtcgacctacgtaacgttcgacgaaccaccgccggtccctacgtacacctacgtcgtcggtccggacgtaccgaggtcgtacgggaacggacggacgtagttacgttagtttaactacgtgtacgtcgttacctactagtacgtacgtacgtagttaccgtcttaccgtttacgttcgttacgtttaccgggttaaaccggacgggttaacccgggtaacccgttaacgggtaacccgttacccgtaacgtaaccgtacccgtaaccgaacccgtaacccggtaaccccc

SEQ ID NO: 8341 - DNA, 640 bp, Homo sapiens
  misc_feature: GYAE6OF01AU44Q.37.36.D03.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctgccctgactcagcctgcctcgtgtctggtcctccnggacngtcatcaccatcctcctgcactacggaaccagcagtgtattattagaaactttactaaccttgtcttcttacggtaccaaacaggccaacccgacggaccaaaccgacccccctaaactctatgtattggtagaggacaaggtacgccggccctacgtacggggtttactaagtcgtacttctcgtcggtccttacgacgtcgtacggacaaccgccgtccctccgtagacctactcgtcgtcggcctccgaggcgtaggacgggacgaggtcgtagtactttacgttacgtcgtctcgtactatagtagtcgtacgtaaggttacgtactacgtttccttagttccgtttacggttaccggtaacgggttacggtaccgttaaccggtacctacccggtacctaacgtaccgaacccgacccgtaaccgtaacccccg

SEQ ID NO: 8342 - DNA, 740 bp, Homo sapiens
  misc_feature: GYAE6OF01DUB4T.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccatcctcctgcacgtacggaaccagcagtgattagtagtaaaactttataaccttgtccttcgttacggtaaccaacacgaccaacccgacggtaaccaaaccgtacccccaaaacttctaacgtggtaacttttggtacgaaggtaaccgaaggttaacggcccgggtcccgttacggttaacgggggttttactaaacgttccgttcgttccgttccgtcggtaccttaccgtaaacgtccgttacggaccgaacccgtaccggtacccttacccgtacgtaaacctaacgttccgttacggtcgggtacccttaccggacggtcgtaggaacgggacgtacgggtccttaggttaactttacgttaacgtcgtacgtcgtacttacgtagttacgtgtaccgtaggttactacgttacctttagtttaacgttcgttacggttaccggtaaggtccgggtaaacctaaccggtccgtaacccgttaccgtaaacgtaccgaaccgaccccgtaacggtaaccccc

SEQ ID NO: 8343 - DNA, 583 bp, Homo sapiens
  misc_feature: GYAE6OF01BOWVP.37.36.D03.1.454.CMB.1.raw
  modified_base (421)..(421): a, c, t, g, unknown or other
  misc_feature (421)..(421): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccatctcctgcactggaaccagcagtgatattagaaacttataaccttgtcttcttggtaccaacacgcacccaggaccaaacgcccccaaactcatgatttgtgagacagtagcgcctcgtagggtttactaatcgtcttctctcggtctacgaagtgtaggcaacgcgcctcctgacactctcgtcggctaccgaggcgtgacggacggngcctagtatttacttactgtctgtctacgtattacgtgacgtaggttactcgtacttcgtttagtcgttacgttacgggtaacgttcggggtaaccgtaacggttacccgtaacccggttccttaacggtaccacccggtacccgtaaccggtaaccccccg

SEQ ID NO: 8344 - DNA, 550 bp, Homo sapiens
  misc_feature: GYAE6OF01E27VC.37.36.D03.1.454.CMB.1.raw
  modified_base (229)..(229): a, c, t, g, unknown or other
  misc_feature (229)..(229): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatatgaaacttataaccttgtctcttggtaccaacagcacccaggcaaacgccccaaactcatgatttgtagagacagtaagccggcctagaggggtttactaatcgtcttctctggctcaagtctggacaacgaccggcctcctagactaatccgtacgtggccttccgaggtctaggacgggacgaggtctgtaattattacgtgctgctacatatgacgtaggtactctacttctttagtcgttacgtacggaagtacgggaaccgtacggtaccaccgttactaacgtccacgtaccccaacggtaccccc

SEQ ID NO: 8345 - DNA, 700 bp, Homo sapiens
  misc_feature: GYAE6OF01AOWL5.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaacttataaccttgtctcttcggtaccaacagaccaccgaggaccaaacgccccaaatcatgtattgtagagacaggtaacgccggtcctacgtacggggtttactaacgtcgtcttccgtcgtcggtccgtacgtaacggtcctaggacctaaccgtacccggtcccgttacccgtacgaacctaacgtccgttccgtcgggtaccctaccgaacgggtcgtacggaacgggacgtacggtacctagttaactttacgttaccgtgtacgtcgtacctacgtaattacgtaccgtacgttacggttacgtccttaaccgtttactttagttaccggttaccgtttaaccgggtaacggtacccggggtaaacccgtaaccgggttaaccttaacccccggttaccgtaaccgtacccggtaacccggaacccccggtaacccggtaaacccccccg

SEQ ID NO: 8346 - DNA, 704 bp, Homo sapiens
  misc_feature: GYAE6OF01BANDD.37.36.D03.1.454.CMB.1.raw
  modified_base (227)..(227): a, c, t, g, unknown or other
  misc_feature (227)..(227): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatattagtaaacttataaccttgtctcttaggtaccaacagcacccaggaccaaacgaccccaaactctactgtatttggtagaaggaacaggtaacgccggtaccctacgtaggggtttactaagtccgtcttctcgtcggtcctaccgtaagttccgtcggaccgaaaccgtaccggtccccttacccgtacgtaaccgtaacttcccgttaccggtcggggtaccccttaccggaacggtccgttacgggaacgggtaccggaacgggttaccctttaaggtaacgtttttaacgttaaccgttgtacgttcgtaccttacgtaactttacgtacgtacgtacggttactccttaacgttacgttacgttacggttacgttaccgggtaagtaccggggtaaaccgtacgggttacccaacccggttacccgtaagtaccccgaacgaccccgtaaacggtaaccccc

SEQ ID NO: 8347 - DNA, 641 bp, Homo sapiens
  misc_feature: GYAE6OF01DLMWH.37.36.D03.1.454.CMB.1.raw
  modified_base (499)..(499): a, c, t, g, unknown or other
  misc_feature (499)..(499): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctcgccctgactcacgcctgcctccgtgtcgtcgggtctccgtggacagtcgatccacctatcctcctgccacgtacggaaccagacagtagaattattagtaaactttacttaacttgtcttcttagtaccaacagaccaccgagaccaaccgaccccaaactcatagtatttggtagaggacagtacgccgcctacgtgggttactacgtctcttctcgtcgcctcgaacgtctgacaccgaccgtcctacctagaaccattctacggtcggtcctacgacggtcgtaggacgggacgacggtcgttattacgtttaactacgtcgtcgtgtccttacngttagtacgtacgttagttacgtacttaccgttatttaccgtcggttaaccggttacgggtaacggttaccgggaaaccgttaacgtacccgtaccgttacccgaacgttaccgaaccggaccccgtaaacggtaacccccg

SEQ ID NO: 8348 - DNA, 618 bp, Homo sapiens
  misc_feature: GYAE6OF01A91PW.37.36.D03.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
  modified_base (365)..(365): a, c, t, g, unknown or other
  misc_feature (365)..(365): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcactcaccatctcctgcacgtggaaccngcagtgtacgttggtagttaataatntgtctcttagaaccanctacaccanactcaccagcaacgtcccaatcaattaattntagacgtacaacgtaaccgcctagaaggtactttactaacgtcgtctttcncgtcggtacctaccgtaacgtcgtacggaaccaaccggtccccggtaccccttacccggtagaacctacgttcccgtccggtcgggtaccctcggacggtccgtagggacggtacgacgggtctaagtagtttactcggtcgtctcgtacctagtaactggtaccgacgttaggtccgtacttacgttacttgtcgttccggttacggaacgtcggtaacccggacttccgtaaccgtctaacggcaacccgg

SEQ ID NO: 8349 - DNA, 673 bp, Homo sapiens
  misc_feature: GYAE6OF01EMVKI.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctcgccctgactcagcctgcctccgtgtcgtgggtctcctggacagtcgatcaccatctcctgcactcggaaccagcagtgaattattacgtaaaactttaacttaaacctttgttaccttacgtttacggtaaccaaacacgaccaaccccgaaggaccaaaaccgaccccctaaaactccagttacgtagtttggtacgaaggaactaaggtaacggccggacccttacggtacggggtttactaagttccgtctttcgtacgtcggtcctaccgaagttcgtacggaccaaccgtaccggtcccttccgtaacgtaacctacttccgttacggtccgggtacctaccggacggtacggtaggaacgggacggtaggtcttagtaatttacgttacgtcgtcgtcgtctacgtattacgtggtacgtagtactctacttacttagttcgtacgttacggtaacggtacggaccgtagtaccaaccgttcaagccacgacccgaaccggtacccc

SEQ ID NO: 8350 - DNA, 807 bp, Homo sapiens
  misc_feature: GYAE6OF01DA087.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctcgccctgactcagcctgcctccgtgtctcgggtctcctggacagtcgatcaccatctcctgccactaggaaccagacagtgaattattagaaacttattaacctttggtccttacgttacggtaaccaaacgacgaccaaccccgaagggaccaaaacccgaccccccaaaacttcaacgttagtacttttaggacggaacggaacaaggttaacggccggtaccccgttagggtaacgggggtttttctaaacgtcccggtactttccgttacgtacggtccctaccgtaaacggtccgtacgggacctaaccggaccgggtacccttcccgtaacgtaaccgtaacttccgtaccgtcgggccttaccggaggtcgtacgggacgggtacggacgtaccgtgttaacttttacgttacgtgtccgttacgtaccgttaccgtaagttacgtcggtaacccggttaagggttacgtttaacccttaacggttttactttagtttcccgggtttacgttttaaaccgggggaaaccggtttaccggggggaaacccctttaacgggggttacccctaaccccggtttaaccggtaaaccggttacccggaaacccggacccccgggaaaacgttaacccccccccgg

SEQ ID NO: 8351 - DNA, 589 bp, Homo sapiens
  misc_feature: GYAE6OF01BLLOK.37.36.D03.1.454.CMB.1.raw
  modified_base (278)..(278): a, c, t, g, unknown or other
  misc_feature (278)..(278): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcagaaaccgagggaaacnccccaagcctcctggtctacgctagcatccaattggaaacaggacgtacccatacaaggttcagtggaagtggatcgtgggacagtattttacgttctacttcagcagtcctgactagtcgtagaacgtactagttacgactaacgtacttactttactttacggttaccaaccgtaaccgacgttacggaacccggtaccccgttaaggggaaccctaaagggtacggtaaacgtaacgttaaccggtaaaacggtaacggtcggttacggtactacggtacctaccgtaagttctacggttctttaccg

SEQ ID NO: 8352 - DNA, 626 bp, Homo sapiens
  misc_feature: GYAE6OF01BXNPF.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcccacatctcctgcacgtggaaccagcagtgatattagaaacttataaccttgtctcttaggtaccaacagaccaccgaggacaaacgccccaaatcatgtatttgtagagacaagtacgccgcctcgtacgggtttactaatcgtcttctcgtggcctacagtctcgacaacgaccggtcctccgagactacttctcgtacgggccttaccggaggtaccgtagggacggaaccggtggtaccttaggtaattttaacgttcgtgtcgtacgtcctacgttacgtagttcggacgttaacgggttactacctacttacgtttagtcggtttaccgtacggtaaccgtacgggtaaacccacggttacccgaaccgtttaccgtaaagttcccaaccggtccccgaaacggtaacccccc

SEQ ID NO: 8353 - DNA, 643 bp, Homo sapiens
  misc_feature: GYAE6OF01EKCH7.37.36.D03.1.454.CMB.1.raw
  modified_base (229)..(229): a, c, t, g, unknown or other
  misc_feature (229)..(229): n is a, c, g, or t
  modified_base (272)..(272): a, c, t, g, unknown or other
  misc_feature (272)..(272): n is a, c, g, or t
  modified_base (339)..(339): a, c, t, g, unknown or other
  misc_feature (339)..(339): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggacagtcatcaccatctcctgcactggaaccngcagtgtacgttggtagttataaattatgtctcttggaccaanatcaaccaacatcaccaggaccaaacgtccccaaatcattaattatgagtcaacgtaaaccgcctanaggtactttactaactcgtctttcctgtcggacctacctaaaggtcgtacggactaaccgaccgggtccccttacccgtacgaaccctattcccgttcgtcgggaccttacccgaaccgtggaacggacgacggtctactacgttattacgtgacctatccgttacaattactaacgaacgtacacgtcgttacgtaacggtttggggttacggttcggggaccgggtaacggggaaccccgtaccggttacggtaaccccggtttagttaaccggtaccgaccggtaacccggtaacccgggg

SEQ ID NO: 8354 - DNA, 524 bp, Homo sapiens
  misc_feature: GYAE6OF01BO9N6.37.36.D03.1.454.CMB.1.raw
  modified_base (229)..(229): a, c, t, g, unknown or other
  misc_feature (229)..(229): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtacaacagcaccaggacaaacgcccccaaactcatgtatttgtgagacagtaacgcgccctgagggtttcaatcgcttctctggctcaagtctgcaacacgcctcctgacatctctgggctcgagctgaggacgnggctagattattacntctcgctnatatgacgtaggtacgtactacgttcttagtcgttcgttaccggaagtacgggaccctaaggtccaccgtacctaacgtaccacggacccgaacggaccccc

SEQ ID NO: 8355 - DNA, 821 bp, Homo sapiens
  misc_feature: GYAE6OF01BRFSX.37.36.D03.1.454.CMB.1.raw
  modified_base (647)..(647): a, c, t, g, unknown or other
  misc_feature (647)..(647): n is a, c, g, or t
  modified_base (792)..(792): a, c, t, g, unknown or other
  misc_feature (792)..(792): n is a, c, g, or t
tcagtagtgtagatcacgaccggtgctcgatttagctgcgtcacgatctctcttgggggagtcagtcccaaccaggacacagcatggacatgagggtccctgctcagctccgtggggctcctgctgctctggctctcaggtgccagatgtgacatccagatcgaccctagtcctccacctccccctgtctgactatcgtaggtaggacgacaggtaccgtccaacctacttaccgtaacgttcggaccggaacgggtaccggaacggtaccggaaagggtaaccttaacggtttaacgggtaaccttaaaaacgttttaaaagtttttaaaacggttacggttaacttaaccggaaacggaaaccggaaaacgggtaaaaccccgggaaaaccgggggtaaaccccctaaccccccggtaacggttcccgtttacccggttaccgggttacccgtaccgtaccgtacggtaacccgttaacgttaaacccgttaaaggtttaaccgggaaaacgtacggttaaccctaacccgtaagttacggtaacgtaggtacggtaaggtagtacgtacgtaggtacggtaactttagtttactttactacctacgtacgtacgctacgtaccgtacgtctaagtacggtaaanaacggttacttacggttaaccaactttacgttaacttactttaccgttaaaccaacctaacccgtacggtccgtaacccggggacggttaccggaaggtaacgtaagtataaaccgtacgaacggtaagtcgtaggtccaccgtntacccgattaacgttctccttaccgtacc

SEQ ID NO: 8356 - DNA, 590 bp, Homo sapiens
  misc_feature: GYAE6OF01CAOUE.37.36.D03.1.454.CMB.1.raw
  modified_base (390)..(390): a, c, t, g, unknown or other
  misc_feature (390)..(390): n is a, c, g, or t
  modified_base (424)..(424): a, c, t, g, unknown or other
  misc_feature (424)..(424): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccatcctcctgcacgtggaaccagcagtgatattagaaaacttacttaaccttgtcttcttacggtaaccaacagccaacccaggaccaaaaccgacccccaaactcaatcgtatttggtgaacggacagtaagccgacccttggacggggtttactaatcgtcttctctggctcaagtcngcaacgcgcctccacacactctcgtcggctacgnggctacgaccgagcggctacacttattatcgcngcctanacttanacaagtcgtacgcgtacgtacggtttgggtcggttccgggacgggacgggtacccgtaccggtaccggttaaccgttcgttaacgggacccaacggccccggtaaaggcccgtaccccggg

SEQ ID NO: 8357 - DNA, 736 bp, Homo sapiens
  misc_feature: GYAE6OF01ELZU5.37.36.D03.1.454.CMB.1.raw
  modified_base (230)..(230): a, c, t, g, unknown or other
  misc_feature (230)..(230): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctcgccctgactcagcctgcctcgtgtctgggtctctggacagtcgactcaccatctcctgcacgtggaaccngcagtgaatattagaaacttacttaaccttgtccttacttaggtaaccaacacgaccacccgaacggaccaaaaccggaccccctaaaactcgaattggtacttttcggtacggaacgggtactaacgggtaaacgcccgggtaccccgtttacggtaacggggggttttactaaacgttccggtccgtttccgtacgttcgggtccttacccgtaaacggttccgtacgggaaccctaaacccgtacccgggtaccccttaccccgttaacggaaacccttaacgtcccggttcgtcggggtccctaccgacgggtcgtacgggacggtaacggtacgtcgtaggtactttaagttactcgtctcggtactacgtacgtacgtcgtacgtagggttaaccgtctaacgttctttagtcgtttaccggtaacgggtacgtacgggaaccctaaccgggttccaacccggttacgtaactccgaaccgtacccgtacggtaaccccc

SEQ ID NO: 8358 - DNA, 870 bp, Homo sapiens
  misc_feature: GYAE6OF01A10BK.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctcgcctccgtgtcgtgggtctcctggacagtcgatcaccatcctcctgcacgtacggaaccagcagtgatattagaaactttataaccttgtcttcttacggtaaccaacacgccacccgaaggaccaaaccgacccccaaactcatgtattgtagagacagtaacgccggccgtcgtacgggtttactaagtccgtcttcctcgtcggtacctaccgtaacgttcgtacggaccaaaccgacccggtacccctacccgtacgaacctaacgttccgtaccgtcggggcccttacccggaacgggtccgtagggaaacgggtaccggtaacgggtcgttaacgttaacgtttttaacgtttaccgttacgggttacccgttacggtacccttaacgtaacgtttaacgtttaccgggtaacccggttaaaggggtttaaccgttaacccgtttaacccgttttaaccggtttttaaccggttaccgggtttttaacccccgggtttaacccgggggttaaaaacccgggtttacccggggggttaaaacccccgttaaaaccggggttttaaccccccggttaaaccccccgggttttaaacccccgggtttaaaaacccgggtacccccggttaaaaaccccccggggtaaacccccccggtaaaaaccccccggggttaaaaccccccccccccg

SEQ ID NO: 8359 - DNA, 626 bp, Homo sapiens
  misc_feature: GYAE6OF01C239T.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataacctttgtcttcttacggtaccaacagccacccaggaccaaacgacccccaaactcatgtatttgtgagacagtacgcggcctgtagggtttctagtcgtacttctcgtgtcctaccgtaagtcgtacggaccaaccgtaccggcccttacctagaacctaacgttcctcgtcgggccttccgagggtctaggacgggacggacggtccgtagtactttattacgtgtctcgtactactaattacgtcggtactaagggttactccgttacctttacgttacgttcggttacgttaccgggtaacgtcggggaacccgttaaccggtaccgtaccgttaaccgttaacgtccgaacgccccgaacggtaacccccc

SEQ ID NO: 8360 - DNA, 653 bp, Homo sapiens
  misc_feature: GYAE6OF01A13MR.37.36.D03.1.454.CMB.1.raw
  modified_base (231)..(231): a, c, t, g, unknown or other
  misc_feature (231)..(231): n is a, c, g, or t
tcagtagtgtagatcacgaccggtgctcgatttagctgcgtcacgatctctcttggggggggtcacaagaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgnagtgacgttggtgttataactatgtctcttggtaccaacatccacccaggacaaacgtaccccaaactcatgtatttatgagtcaactaaacgccctcgacgggtctctaatcgtcttctctcgctccagtctgacacgaccggtcctcctacgacctactctacgtcgggtccctcgacggtctacggaccgacggacggtcctactaccttatttacgttcgactacgtacctactaattaactaaaccgaacgtccgtaacgtacctaacttacccggtaacggttttcgggggttaccgggtttacccgggggaccggggtaaccggggtaaccccgtaacccggttaccgggtaacccggtttacccgggttaacgggttacccgaaccgggtaccccggtaaacggggttcccccg

SEQ ID NO: 8361 - DNA, 541 bp, Homo sapiens
  misc_feature: GYAE6OF01EQQHA.37.36.D03.1.454.CMB.1.raw
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccatctcctgcactggaaccagcagtgatattagtaaacttataaccttgtctcttacggtaccaacacgccacccacgacaaaccgccccaaactcatagtatttgtgagacagtaacgccgaccctcgtaggggtttctaatcgtcttcgtcnggcctcgacgtctgacacgacgcctcctnaactactctcgtcggctcgagcgtgaggacgaggtctagtattactctgtctgtcctanatagtcgacgtaggtactctacttgttagtcgtacgttacgacgttcggactacggtaccaccgtcctagaccacgacccacgtacccc

SEQ ID NO: 8362 - DNA, 736 bp, Homo sapiens
  misc_feature: GYAE6OF01DBK0F.37.36.D03.1.454.CMB.1.raw
  modified_base (238)..(238): a, c, t, g, unknown or other
  misc_feature (238)..(238): n is a, c, g, or t
  modified_base (543)..(543): a, c, t, g, unknown or other
  misc_feature (543)..(543): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctcgccctgactcagcctcgcctcgtgtcgtggtctccgtggacagtcgatccaccactctcctgccacgtacggaaccngcgagtgtaattattagtaaacttacttaaccttgtccttcttacggtaaccaacacgaccaacccgaggacctaaacccgacccctaaacgtcctagttgtaactttcggagtaacgggaactagggtaacgtccggtacccgttacggttaaggggtttacctaacgttccgtcttacgtcgtcggtccttaaccggtacgtaccggtcggaaccctaaccggacccgtccccttaccgtacgtaacttaacggtccgtacggtcgggtaccctcggaggtcgaacgggacgggacgtcggtntttacgtaactttacttcgtagtcgttcgaccttagtagtacgtacggtacgttaaggttacttaccgttactttacgtttacggttcggttaaccggtacgggttaaccggtccgggtaaacccgtaacggttcccgttaacccgttacgtaaccggtacccggaccctaacccccggaacgtaaccccccg

SEQ ID NO: 8363 - DNA, 679 bp, Homo sapiens
  misc_feature: GYAE6OF01DSYMQ.37.36.D03.1.454.CMB.1.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
tcagtagtgtagatcacgaccggtgctcgatttagctgcgtcacgatctctcgttgggggggtcacaagaggcagcgctctcgggacgtctccaccatggcctgggctctgctgctcctcactctcctcactcagacacagggtcctggcccagtctcgccctgactcagcctgcctcgtgtcgtcggtctcctggacngtcgatccaccactcctcctgcacgtcggaaccngctagtgtattattagtaaactttacttaaccttgtccttcgttacggtaaccaacgacgaccaccgaacggaaccaaacccgacccctaaactactagttagtacgtttaggtacgacggaacgtaaggtaaccgccggtccgtacggttacggggtttacaacgttcgtctttcgtccgtacgctaccgtacgtacgtacggacaaccgtaccggtccctaccgagaactactccgtcggtacggtcctaccggaggtacgtacggaacgggtaccggtacggtacttacggtaactttacgttacgtcgtacgtcgtaccttagtaaacgttcgcggtacgtacggtacttcgtacttcgtttagtcgttacggtacgtacggtacgtaccggtaacgtacctaaccgtacaacctaccaccgtaacccgccggtaaaccccc

SEQ ID NO: 8364 - DNA, 770 bp, Homo sapiens
  misc_feature: GYAE6OF01C6LKR.37.36.D03.1.454.CMB.1.raw
  modified_base (180)..(180): a, c, t, g, unknown or other
  misc_feature (180)..(180): n is a, c, g, or t
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (626)..(626): a, c, t, g, unknown or other
  misc_feature (626)..(626): n is a, c, g, or t
  modified_base (635)..(635): a, c, t, g, unknown or other
  misc_feature (635)..(635): n is a, c, g, or t
  modified_base (681)..(681): a, c, t, g, unknown or other
  misc_feature (681)..(681): n is a, c, g, or t
tcagtagtgtagatcacgaccggtgctcgatttagctgcgtcacgatctctcgttggggggggtcacaagaggcagcgctctcgggacgtctccaccatggcctgggctctgctgcctcctcactctcctcactcgaggacacgacgggtccgtcgggcccagtcctcgccctgacctcncgcctgcctcgtgtcgtcggtctcgngactgtcactcactctctcngacagcgaccagngtagtatattaacgttacgtaaaactttacgtaaccgtttcttacttacccgttaaggaacccaacgccgaacccctacggaaaccggtaaacccaaacccgtaaccccaaatcgtaaacgtttaggttatttaagggaacgtaacggtaaacgttaaacggggtacccggtaccggttaacccggtttaacgggttaacggttttaccaccgtttccggtaaccgtttccctaggtccggaacccttacgaacggggttctaccgggaaccgaacccgtcccgtaccctaacgtagaaccttgtacccggtcgtaaccgggtccttacgggaacgtcggtaacgggaactacggggtactaacggtttagtaaccttggtaacgtntccggtaanacttaccgaagtcgaccggttattaccgggtaactccttacggttntttaaaccggtcgttaccggtaacggtacggtaccggtacgttaccgtaccgtaacgttacacgtaccgaccgaaacacccgtaacccg

SEQ ID NO: 8365 - DNA, 689 bp, Homo sapiens
  misc_feature: GYAE6OF01DOWC8.37.36.D03.1.454.CMB.1.raw
  modified_base (219)..(220): a, c, t, g, unknown or other
  misc_feature (219)..(220): n is a, c, g, or t
  modified_base (230)..(230): a, c, t, g, unknown or other
  misc_feature (230)..(230): n is a, c, g, or t
  modified_base (321)..(321): a, c, t, g, unknown or other
  misc_feature (321)..(321): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgccctgactcagcctgcctccgtgtctggtctccgtggacagtcatcaccatctccnncactgaaccngcagtgaattattagaaacttactaacttcgtctcttagtaaccaacagaccaccgagaaccaaaccgaccccaaactccatagtatttgngaagacaagtaacgccggccctagtacgggtttactaagtccgtacttcgtccgtggtcctaccgtaagtccgtacggaccaaccgtaccgtcccttacccgagtaacctaacgttcgttacgtacggggtccctaccgaaggtaccgtagggaacgggaacggtacggtacccgtttaggttaacttttaacgttacctcgtaccgttaccgtaccgtactaaacgttgtacgtaacgtacgggttacaccggttacttcgttagttccgttaccggttacggtaaccgtacgggtaacccgtaacggtaccctaacccggtaaccttaacggaccgaacccggtaaccccgaccggtaaacccccc

SEQ ID NO: 8366 - DNA, 839 bp, Homo sapiens
  misc_feature: GYAE6OF01C3QAD.37.36.D03.1.454.CMB.1.raw
  modified_base (189)..(189): a, c, t, g, unknown or other
  misc_feature (189)..(189): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgacgggtcctgggcccagtctcgccctgactcagcctcgcctccggtntcgtcgggttctccgtggacgagtcgatccacctacttcctctgccacgtacggaaccngcaggtnaacttattagtaaactttactaaccttgttccttcgttaacggtaacccaacgacgacccaaccgtacgaacctaaaccgacccccaattcgaattgtagtttcgaggaagtacgaaggtaaccggccggtacccgttaggttaacggggtttaccttaacgttccgtctttccgtcgtcggtcctacgtacgtcgtacggaactaacccgccgtccccgtaccgtaacgtacctaaccgttcctaccgggtcggtaccccgttcggaaggtaccgtaacggggacggaacccgggaggttaccgttacggtttaacgtttttaacgttaccggttaccgtacggttacgttaacctttaacgaaactttaaccgaacgtttaaacgccgtaaccgggttaccggtttaccggtttaaacgggggtttccgggggtttaagggtaccccgggggtaaccgggggttaaacccgggtaaccccggtaccgggttacccgggttacccggtttaaccgggtttacgggttaaaccccgggtcccggtttaaaccccgggaggggttacccccggtttccccccggg

SEQ ID NO: 8367 - DNA, 602 bp, Homo sapiens
  misc_feature: GYAE6OF01DFUVF.37.36.D03.1.454.CMB.1.raw
  modified_base (309)..(309): a, c, t, g, unknown or other
  misc_feature (309)..(309): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgccactggaaccagcagtgatattgaaacttataaccttgtctcttggtaccaacagcacccaggacaaacgccccaaactcatgatttgngagacagtacgcgcctgagggtttctaatcgtctctctggctactaagtctaggcaacgcggccctcctagactaacttctcgtgggcctacgacggtctggacggacgtaggtctaggtatttactactgactgtcttactaagttagtcggaccgtaagggttactacgttacctttacgttagttcggttaccgttaccgggtaacgttacggggaaacccttaacgggtaccctaaccccggtttacgtaaaccggtcctaaccggacccccgtaacgggtaacccccc

SEQ ID NO: 8368 - DNA, 772 bp, Homo sapiens
  misc_feature: GYAE6OF01DEI8G.37.36.D03.1.454.CMB.1.raw
  modified_base (243)..(243): a, c, t, g, unknown or other
  misc_feature (243)..(243): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgccctgactcacgcctgcctcgtgtcgtgggtctcctggacagtcgataccacctattcctcctgaccacgtacggaaccngcagtgaattattacgtaaacttaactaaccttgtcttacgttacggtaaccaacgtacgaccaaccccgaggaaccaaaaccgtaccccctaaactacgtaagttaggtacgttttggacggaaacgggtaacgtaaacgggtaaccggtacccgggtacccgttacgggttaacggggttttcctaacgttccgtctttcgtcgtcgtacctaccgtaacgtcgtacggaaccaaccggtacccgtccctaccgtacgaacttacgtccggttcgtccgggtccctcggaacggtcgtacgggaaccgggtacgggtacggttactacgtttactttacgtacgtggtcctagttacctagtagttacgtccgtacggttaaggtttactaccgtttactttcgtttaaggtttccgttaccggttaaaccggggtacggttaaccggaaccggttaaccggtacccgttacccggttaaccgtaacgtacccggaaaccctaccccgggaacccgtaaaccccccg

SEQ ID NO: 8369 - DNA, 649 bp, Homo sapiens
  misc_feature: GYAE6OF01BI9T4.37.36.D03.1.454.CMB.1.raw
  modified_base (232)..(232): a, c, t, g, unknown or other
  misc_feature (232)..(232): n is a, c, g, or t
  modified_base (282)..(282): a, c, t, g, unknown or other
  misc_feature (282)..(282): n is a, c, g, or t
  modified_base (331)..(331): a, c, t, g, unknown or other
  misc_feature (331)..(331): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctcgccctgactcagcctgcctccgtgtcgtgggtctctggacagtcgatccacattctcctgcactcggaacngcagtgattattagtaaacttattaaccttgtcttcttacggtaccaacncgccaccgaggaccaaaccgaccccaaactcagtagtatttggagaganagtacgccgtcctacgtagggtttacagtcgtcttcgcgtcgcttccgaagtcgtacggacctaacgacccggtcccttaccgtacgaacctagttccgtcggtacggccctaccgaggtccgtagggaccggacggtacggtacttacgttatttacgttactggtactagtacctatacttagtaccgcgtaacgtacgtactacgttacgtttaggtccgttacggtaaccggaaggttccgggtaaaccttaacgggtccccttaaccggttacctaacggtacccaacgggacccctaacccgggtaaccccc

SEQ ID NO: 8370 - DNA, 790 bp, Homo sapiens
  misc_feature: GYAE6OF01CH5JX.37.36.D03.1.454.CMB.1.raw
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (284)..(284): a, c, t, g, unknown or other
  misc_feature (284)..(284): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcaccctcctcactcgagggcacgagggtcctgggcccagtctcgccctgactcagcctgcctccgtgtcgtgggtcctccgtggacngtcgatcaccatctccngcacnggaaccagcagtgtacgttggtaggttaataatatcgtctacgttcgtaaccaanataccacaacataccaaccgacggacctaaaccgtaccccaatactaattattagaggtaagtaccaacgtaaaccggtcctagtaggtaacgtttactaatcgttacctttcgtcgtcggtacctaccgtaaggttccgtacgggtaaccaacccggtacccggtccccttaccccgtaacgtaaccctacgttcccgtccggttaccgggtacccttacccgtaaacccggttacgggaaccgggtaaccgtaccgggttacccttacggttaaacttttaacgtttaacgtttcggaccgttaacggtacctacgtaacgttaacgtaacgtaaacggaccgtacgttcccggttacggtttacggggtttacggggttccgggttaccggggaccgggggtaaccccggggtcccgttaaccccggtttaggggttaacccccggttcggtttaaccgggacccgtaaaccccgggtcccgggtaaccggttaccccccggg

SEQ ID NO: 8371 - DNA, 760 bp, Homo sapiens
  misc_feature: GYAE6OF01B89NI.37.36.D03.1.454.CMB.1.raw
  modified_base (269)..(269): a, c, t, g, unknown or other
  misc_feature (269)..(269): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgccctgactcagctgcctcgtgtctgggtctcgtggacagtcgatcaccatcctcctgcctacgtcggaaccagcctaggtcgtacggttggtaggttaataaaatntcgtctcgttacggaccaatactaccaaccaactactaccaacccgaggtaccaaaaccgtaccccaaaactctaacttaatttactaggtacgtacaaccgtaaaccggccctaagaggtactttactaactcgtcttactctcggactaccgtaacggtctaggacctaacgccggtccctaccgttacgaccctaattccgtacgtcgggtaccctacccgaacgttgggtaacggaccgtacggtccttaccgaacttttaatttacgttcgaccgtaagtacctacgttaaataaacgtttaacccgaagtacccgtaagggttccccgttacggttaaccggggtttacggggttacccgggtttaccggggggaacccgggtaaaccggggttacccccggttaaaccggtaccggggtttaaacccggtttcccggtttaaaggggttaccccgtaaaccgggtaccccggtaaaccccgggg

SEQ ID NO: 8372 - DNA, 786 bp, Homo sapiens
  misc_feature: GYAE6OF01DOV22.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctccgtggggctcctgctgctctggctctcaggtgccagatgtagacatccagatgacccagtctccacctcccccctgtctcgcatctgtaggacgacagacgtcaccatctacgttcggacccgggcaggtcgaacttagttacgtaccgttgggttcggccgttaggtactaccaaacgaacggaaaaccgaaggggaaaccgtaccccggttaacggtcctagtacttactaagtgtactccgtacccttaccgtaacggtttacgggaaaacgggtcccgggtacctacggttacgtaacgggttcgaacgggccggtactaaggttacggtacgtacgggtagggtaaccaaagttaacctttaccgacttaccgtaccctaaccgtataccgtaacggtaccgttcccgtcggtaccgtacgtcccgtagttacgttagtttacgtttacgtaacctttaacttttacgttacgttacgtaacgtacgtactaacgttaagttaacggtcgggttaacggtaccgggttaccggggtacccggggtaacggggtaaccgggttagggttaacggtaaaccggtaaaccggtttaaacgtaaaacccgggtaacggtttcggggttaacggtaccgttaccggtaccctaaccggttcgtttcgttaccccgg

SEQ ID NO: 8373 - DNA, 885 bp, Homo sapiens
  misc_feature: GYAE6OF01B8WC1.37.36.D03.1.454.CMB.1.raw
  modified_base (701)..(701): a, c, t, g, unknown or other
  misc_feature (701)..(701): n is a, c, g, or t
tcagtagtgtagatcacgaccggtgctcgatttagctgcgtcacgatctctcgttggggggggtcacaagaggcagcgctcgtcgggacgtctccaccatggcctgggctctgctgctcctcactctcctcactcacggacacgacgggtccgtcgggcccagtctcgcctgactcacgcctcgccgtcgtcgtcggtcgtcctcgacgacgtacgtactactacctaacctcttccgtccgacgtaccgtaccgaaccggaaccgacggacgtagtaagtaatttaacgttaaaccgttaaaacctttacgttaccgtttcgttaccgttaccggttaaccgaaccaacgaccgaacccgaaaccggtaaccgaaaaccccaaaccccgtaaccccttaagtacgtaacgtttacggttaacgttacggaacgggaacgtaacgtaaacggtccccggacccggtttacgttagggtttaaccgttacgtactccggtttcgtcgtacggtcctaaccgtaacgttcggtacgaaccggtaaccgtaacccgccgtttacccctaacggtaacgtaacccgttcggtttccggaccgggttaccggacccgtaaacgggtcggtaaacggggacgggtaaccgggtacggtttacgttacgtaaaacgtttttacgttcgtaacgggtccttaaccggtnttaaaccgtagttaccggtaacggtaccggttaagtttacccggttactaccgttttagtacccggtttaggttaccgggttaaaccggtacgggtaaacccgttacggttaaaccggaacccgtttcgtaaccccgttagtaacccggaccccgtaacccgaacccggaacccttaccccggg

SEQ ID NO: 8374 - DNA, 781 bp, Homo sapiens
  misc_feature: GYAE6OF01BW3UD.37.36.D03.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
tcagtagtgtagatcacgaccggtgctcgatttagctgcgtcacgatctctcttgggggagtcagtcccaaccaggacacagcatggacatgagggtccctgctcagctcctgggctcctgctgctctggctctcaggtgccagatgtgacatccagatgacccagtcctccactcccccctgtcgtcgcatcgtgtagganactagagtcaccatcacttcgccgaggcgatcgaggactagtcggactaacttatttaaagtggtatcgaacggaccaacggaaaacccgaacgggaaaaccncccccaaacggtccttaccgtacggttcctaaccgtctacggacctaacttaccgtaaaagtttacgggaaaaaccgacgggtaaccgtacccctaagttacccggtaaaaggtttccggaaaggtaggggtaaacggtttagggaaccgtttaccggtacgggggtaacctaacggtttaacttttttaccccgtttaacttaaacccctttccgaaaccgggtccctaacggttccccgtaggtaacccgttaaggtaccgtaaggtaaaacggtaactttaacgtttaacggaacctaaacttacgtttaaccttttacggtacgttaacccaaacctaaccgtacgttacggaacccgggttaccccgtaacggggtaaccgtaaaacgggttcgaaacgttacgtaaaccgtaaaccgaccgttaggcgtaccgttacgaccaaccggttaatccgtacgttccttacccg

SEQ ID NO: 8375 - DNA, 705 bp, Homo sapiens
  misc_feature: GYAE6OF01DIJRY.37.36.D03.1.454.CMB.1.raw
  modified_base (92)..(92): a, c, t, g, unknown or other
  misc_feature (92)..(92): n is a, c, g, or t
  modified_base (571)..(571): a, c, t, g, unknown or other
  misc_feature (571)..(571): n is a, c, g, or t
tcagtagtgtagatcacgaccggtgctcgatttagctgcgtcacgatctctcgttggggggggtcacaagaggcagcgctctcgggacgtcnccacatggcctgggctctgctgctcctcactctcctcactcaggacacgcgggtccgtcgggccctagtctcgtccctgactcacgcctcgtcctccggtcgtcgtggtcgtcgtggacacgtcgactaccaactactcctactcgacctacgacggaaccagactagataattattaagtaaacttacttaccttgttacttcgtaacgtaccaacacgaccaaccgaacgaaccaaaccaacccccaagtctaagtacggttatttaggacggaacgaagtaacgggtaaccggccgtaccggtacgttaacggggtttactacgtccggttcttcgtacgttcgaccgttacgtaacggttcgaccggaaccaaccggtaccgtccctaccgtacgaactaccgtcgttaccgcggtccgtacggtacgagtaaccggagggtacggtaacgtctttaagttacctttatccggtntacgtcgtacatagtaccgtagtaccgttagtaccgtacttagttcctaggttccgttaaggtaccgaacggttacgggacccagttacccggtaacgtaccacgaaccgaccctacccggaaccgtaaccccc

SEQ ID NO: 8376 - DNA, 815 bp, Homo sapiens
  misc_feature: GYAE6OF01APZSV.37.36.D03.1.454.CMB.1.raw
tcagtagtgtagatcacgaccggtgctcgattttagctgcgtcacgtactcttccctaaccttaggggggggtcaccaagaggcagcgcctcctcgggacgtctccaccatggccgtgggctctgctcgcctacctccacgtctccctactacctaccgagggaaccacgacggggttcccgttggggccccgtaggtcctagacccttcggacctacgacgaccgtcggcccgtccggtgtcctcgggtcctaccgtggaccacggttccgactccgaccacgtccgtccctcgacctaccgtggaacccacgacgtacgtgtactagttaacggaactttacgtaaccgttgtccttcgttacgtaaccaacgacgtacctaccgtaggaccgtaaaccgacccctaaatctaagttacgtacgtttaggtacgtacgggtacgaacgggttaaccggccgtacccgttacggttacgggtttaacctaacgttccgttacctttaccgacgttaccggtccttaaccgtaacgtttaccgttacggaaacccgtaaccgtacccggttccctaacccggtagtaaccgtacggttcccgtccgggtaccggtacccgttaccgtacgggtactaagggacgtaccggtaggtacttacgttacttacgtcgtcgtccgttcgtactacgttacgttacgtccgagttacggtacgtacctaacgttcgttacgtcggtaccgttcggaccgtacgggtacctaccgtcgtaccccgacgttacaccgtacccggccccgtaccggacccccg

SEQ ID NO: 8377 - DNA, 745 bp, Homo sapiens
  misc_feature: GYAE6OF01C8AQN.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaaggacacgagggtcctgggcccagtctcgaccctgactcagcctcgcctccgtgtcgtgggtctcgtggacagtcgatcaccattcctctgcacgtcggaaccagcagtgattaattagtaaacttataacttgtcttcgttacggtaccaacgacgccaaccgaggaaccaaaccgtaccccctaaatcaagttagtacgttttggaggaacggtaacgtaaggtaaccgcccggttaccccgttaggttaaccggggttttacctaacgttcccggtcctttccgtccgttacggtacccttaccgtaaacggttccgttaacggaacccgtaaacccgtacccggtcccttacccgtaagtaaccctaacgttccgtaccgggtcgggacccttaccggaacggtacgtacgggaacggtaccggtaacggttctaggtttaacttttacgtaccgtgtaccgttcgtaaccgttacgtaagttacggtccgtaagggttaccggttactcgttaacctttacgttcgttacgtaccggtaacggtacgtaccggtaacgttaccgtacctacgtactacgtccgaaccgacccgtacgtaaccccg

SEQ ID NO: 8378 - DNA, 676 bp, Homo sapiens
  misc_feature: GYAE6OF01BBBCP.37.36.D03.1.454.CMB.1.raw
  modified_base (272)..(272): a, c, t, g, unknown or other
  misc_feature (272)..(272): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtcttcttgtaccaanacgacacccaggcaaacgcccccaaactcatgatttgtagagacagtaagccggtccctcgtaggggtttactaacgtcgtcttctcgtggtcctccgtaagtcctaggacctaacgacccggtcccttcccgtacgaacctaacttcctacggttcgggtaccctaccgacgggtaccgtacggaacgggacggtaggtaccgttaggtaactttaacgttaacttcgtcctacggccgttctaagtacgttacggacgtaagggtacctacctacgtttaccttacgtcgtttaccggttaacgggtaaccggtaccggggtaaaccgtaaccgggttaccctaacccggttacccgttaaacggtcccaaacccggtaccccgtaacccggaaaccccccg

SEQ ID NO: 8379 - DNA, 807 bp, Homo sapiens
  misc_feature: GYAE6OF01B91DE.37.36.D03.1.454.CMB.1.raw
  modified_base (254)..(254): a, c, t, g, unknown or other
  misc_feature (254)..(254): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgacgggtcctgggcccagtcctcgccctgactcacgcctcgcctccgtgtcgtcgggtctccgtaggacagtcgactcacctatcctcctgacacgtacggaacctgcagtanattaattagtaaacttacttaaccttgtcttacgttacggtaaccaacgtacgaccaaccgacggaaccaaacccgtaaccccaagtctatcggtatttacggaggaacgaacgtaggtaaccgccggtacccgttaggtaacggggtttactaacgtcgtctccgtgtcggtacctacgtaacgtcgtaccgacaaccggtaccgtccctaccgtacgaacgttaacttccgttggtaccgggtacccttaccgggacggttaccggggtaacggacgggggtaacctaaccggggttacttaacggtttaagttttaacccgttacgttaccggttcccgttagtacccttagtaccgtagtaccgtaacgggttcggtttaaccgttcggttaacctttacgtttcggttaccggttaaacccggttccgggggttaaaacggttcccgggtaaaaccggtttacccggtaaacccgtttaaacccggtacccggttttaaaccggaccgaaccccccgggtaaaccggtaaaccccggtaaaccccccg

SEQ ID NO: 8380 - DNA, 645 bp, Homo sapiens
  misc_feature: GYAE6OF01AGG90.37.36.D03.1.454.CMB.1.raw
  modified_base (218)..(218): a, c, t, g, unknown or other
  misc_feature (218)..(218): n is a, c, g, or t
  modified_base (563)..(563): a, c, t, g, unknown or other
  misc_feature (563)..(563): n is a, c, g, or t
tcagtagtgtagatcacgaccggtgctcgatttagctgcgtcacgatctctcgttgggggggggtcacaagaggcagcgctctcgggacgtctccaccatggcctgggctctgctgctcctcactctcctcactcaggacacgagggtcctgggcccagtctcgccctgactcagcctgcctccgtgtctgggtctccgtggacagtcgactccaccntcctcctgccacgtaggaaccagctagtagtaattattaagtaaactttacttaaccttcgttcttcgttacggtaaccaacgacgaccaacccgacggaccaaaccgacccccaactacactgtagttgaggacggagtacgacgccgtccgtacggtacgggttactacgtcgtcttcgtcgtcgtcctactagtcgtcggaccacgccggtccctaccgtacgactactccgtcggtcgggtccctaccggtggtcgaggacgggacggtaggtctagttacttacgtcgtgtcgtcgtactacgtacgtagtacggtacgtacggtacgttacttccgttnttacggttccgttacggttacggacggtacggaccggtacggtacctaccgtactacggtaccacccgaccgaccggacccc

SEQ ID NO: 8381 - DNA, 668 bp, Homo sapiens
  misc_feature: GYAE6OF01AWHI2.37.36.D03.1.454.CMB.1.raw
  modified_base (229)..(229): a, c, t, g, unknown or other
  misc_feature (229)..(229): n is a, c, g, or t
  modified_base (479)..(479): a, c, t, g, unknown or other
  misc_feature (479)..(479): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatcctctgcactcggaaccngcagtgatattagaaacttataaccttgtctcttcggtaccaacacgccaccaggaccaaaccgccccaactcatgtattgagagacagtacgcgcctgtacgggttactatcgtcttctcgtcgtcctacgaagtccgtaggaccaaccgaccggtccctacccgtgaacctacgttcctacggtcgggccctacggacggtcgtacgggacgggaccggtggtacttaggttaactttaacgtttacncgttcgtcgtacttacctaagttacgtacggtacgttaggttaaccgtccttaaacgtttccgtttaaagtccggtttaccggttacggtaaccccgggttacggggaccttaaacccgggttcccctaaccggttaacccggtaaccggtacccgtaaccggacccccgtaaaccggtaacccccccg

SEQ ID NO: 8382 - DNA, 895 bp, Homo sapiens
  misc_feature: GYAE6OF01CVM2C.37.36.D03.1.454.CMB.1.raw
  modified_base (257)..(257): a, c, t, g, unknown or other
  misc_feature (257)..(257): n is a, c, g, or t
tcagtagtgtagatcacgaccggtgctcgatttagctgcgtcacgatctctcgttggggggggtcacaagaggcagcgctcgtcgggacgtctccaccatggcctggctctgctgctctcactctcctcactcaggacacagggtctcccccccccgggcagtctcgccctgactcacgcctcgccctccgtgttcgtgggttcctccgtggacagtcactccaacctatcctcctcgaccgtacgtacggaacccngactaggtagtaatttaagttaacgtaaaacctttaacgttaaccttttcgttaccgtttaccgtttaaccggtaaccaaaccgacggaccccaaacccgaacggaaacccaaaaccccgtaccccctaaacgtctaagttacggtttaagttttcgggacgaaacgggtaaccgttaacggtaaccggccccgggtaccccgttagggtttaaccggggttttacctaacgttcccggttactttccggttcggttacggtacccttaaccggtaacgttccgttacggaaccccgtaacccggtcccgttaccccgtcctaacgtaaccgttaacgtttccggtcccggttaccggggaccctttacccggacggggttaccgtaaggggaaccgggacggtacggtaacgttaggtttaactttaccgtttacgtcgttcccgtacgtttacctacgttaagttagttccggtacggtttaaggtacgtttccttaaccgtttcgttacgttcgttacccgggttaaccgggaaacggttaccgggtaaacccggttaacccggttcccgtaaacccggttacccggttaaaggaccccgtacccggtaaaccccggtaaacccgtaaccccccg

SEQ ID NO: 8383 - DNA, 734 bp, Homo sapiens
  misc_feature: GYAE6OF01BBNJB.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggccagtctcgcctgactcagcctcgcctccgtgtcgtggtctctggacagtcgatcaccactctcctgacacgtacggaaccagacagtagtattattaacgtaaaactttacttaaccttgtcttacgttacggtaaccaacgacgaccaacccgacggaaccaaaaccgacccctaaactactacgttagtacgtttacggtaggaacggacgtaacggtaacggccggtaccgttacggttacggggtttactaacgtcggtcttacgtcgtcggtacctaccgtaacgttcgacggacctaaccggaccggtcctaccgtacgaacttacgttccgtcggtacgggtcctacggcggtacgagggaacgggacggtacggacgtttaagtacttttaacctcgttcgtccgttacgtccttaagtacgttagttaccggtagtacggttactcttacgttacgtttacgttacggtttccggttaaaccgggtacgggttaacgggaaccgttaacggttaccccgtaccgttaaacgtaacgaccggaacccggaaccccgtaccggtaaacccccg

SEQ ID NO: 8384 - DNA, 503 bp, Homo sapiens
  misc_feature: GYAE6OF01DHXI6.37.36.D03.1.454.CMB.1.raw
  modified_base (209)..(209): a, c, t, g, unknown or other
  misc_feature (209)..(209): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccntctcctgcactggaaccagcagtgatattgaaacttataaccttgtctcttggtaccaacagcacccaggcaaagcccccaaatcatgatttcgtgagacagtaacgcggccctcgaggggtttctaatcgcttctctggctccaagtctaggcacacggcctcctgacatcnctggctccagctgaggcgagctgnttatacngactgacctnactatgcgaggtgtcacgttctatgtcgttacggacttcgggactacggtcaccggtcctaagccagcccgaagaccccg

SEQ ID NO: 8385 - DNA, 684 bp, Homo sapiens
  misc_feature: GYAE6OF01ACPVD.37.36.D03.1.454.CMB.1.raw
  modified_base (230)..(230): a, c, t, g, unknown or other
  misc_feature (230)..(230): n is a, c, g, or t
  modified_base (277)..(277): a, c, t, g, unknown or other
  misc_feature (277)..(277): n is a, c, g, or t
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacgagggtcctgggcccagtctgccctgactcacgcctgcctcgtgtctgggtctcctggacagtcgatcaccatcgtctgcactggaaccngcagtcgatattagaacttataaccttgtacttcgttgtaaccaacncgccaccccgaggaaccaaaccgccccctaaaactcaattgtacttttggtagaaggtacaaggtaacgccgtaccgtacggttaggggtttactaagtccgtcttctacgtcggtacctaccgtaagtccgtggtaccaaccgtaccgggtcccctacccgtcgtaacaacgttccgtcgtccggggtctacccgaagggtccgtaggaccgggagtacggtcctagtacgtttacgttaccgtcggtcttcgtacttaccgaagttacgtcgtacggtaggttaacgttctacgtttcgtttaacgtcggttacccgtttacgggaaccggttaccgggaacccttaaacggtccccgaaccgtttaacgacgtacggacccgtaacccgaaaccggtaaccccc

SEQ ID NO: 8386 - DNA, 833 bp, Homo sapiens
  misc_feature: GYAE6OF01BCRNV.37.36.D03.1.454.CMB.1.raw
  modified_base (499)..(499): a, c, t, g, unknown or other
  misc_feature (499)..(499): n is a, c, g, or t
tcagtagtgtagatcacgaccggtgctcgatttagctgcgtcacgatctctcgttggggggggtcacaagaggcagcgctcgtcgggacgtctccaccatggccgtgggctctgctgctcctcactctcctcactcaggacacgaggtccgtcggccctagtctcgccctgactcacgtcctcgcctcgttgtcgtgggtcctcgtaggactagtcgtactcctaacctacgttccttcccgtagaccgtaaccgtaccggaaaccgacggtacgtagtagtaatttaacgtttaaacgttaaaaccttttaactttaaccgtttcggttaccttacggttaaccgtaaaccaaacgtacgaaccccaacccggtaaacggacccgtaaaaaccccgaccccttaaacgtaccgttaacgttagtaacgtttagggaaacgaacgggtactaaacgggtaacggtacccggtaccggtttacgggttaaccgggtttanaaccttcgttacccgttcgttcggtaccgtacctacgtaagttccgaaccgacgtaaacccgccgggtacccttaccaaggtaactaacgtcccggtacgtcgggacccctaacgggtacgtacggtaacgggaaccgggtacgacggttacttaaagttacctttacggtaacgtctaccgtgttaccagttacgtagtcggtaacgttacggtactacgttactttaacgtacggttacgttaccgtaacgggttaactaacggggaacgtaacccgtacctaacgggttactaaaccggaccaaacccgttaacccgaacccgttaacccc

SEQ ID NO: 8387 - DNA, 720 bp, Homo sapiens
  misc_feature: GYAE6OF01BBLZL.37.36.D03.1.454.CMB.1.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (326)..(326): a, c, t, g, unknown or other
  misc_feature (326)..(326): n is a, c, g, or t
tcagtagtgtagatcacgaccggtgctcgatttagctgcgtcacgatctctcgttggggggggtcacaagaggcagtgctctcgggacgtctccaccatggcctgggctctgctgctcctcactctcctcactcaggacacagggtcctgggcccagtctgccctgactcagcctgcctcgtgtctgggtctccgtggacagtcgatcacatcnctgcactggaaccngcagtgatattagaaacttataacttgtcttcttcggtaccaacacgaccaccgaggaccaaacgaccccctaaatcagtagtactttgtacgacganaacggtaacggcgtcccgtacgtacggggtttactaacgtcgtcgttactcgtacggtcctacgaacgttcgtacggacctaaaccgtacgggtaccccttacctttacggaaccctagttccgttaccgtacggggtcctaccggaacgtaccgtacggacgggtaccggtaggtacctagtaacgtttacttacgtacggtctaacggtttacaacgttaagtaacggtacggtaccgtaacccgtactaaacggttttagtacgtttaccgggtaaaccgggtacgggttacgggtaaacccggttacgggttaccggttacccgggttaaacctaacgggttacccaaccggtaaaccccggtaaaccggacccgtaacccccgtaacgg

SEQ ID NO: 8388 - DNA, 787 bp, Homo sapiens
  misc_feature: GYAE6OF01CFI56.37.36.D03.1.454.CMB.1.raw
  modified_base (121)..(121): a, c, t, g, unknown or other
  misc_feature (121)..(121): n is a, c, g, or t
  modified_base (203)..(203): a, c, t, g, unknown or other
  misc_feature (203)..(203): n is a, c, g, or t
tcagtagtgtagatcacgaccggtgctcgatttagctgcgtcacgatctctcgttgggggggtcacaagaggcagcgctcgtcgggacgtcctccaccatggcctgggctctgctgctccncactctcctcactcaggacacgagggtcctggcccagtctcgccctgactcgacgcctcgcctcgtgtcgtcggtcctccgnggactacgtcgactccactactccgtccgtgcctaacgtcggaaccgagacgtagtacgtatttacgttaaccgtaaaactttaccgttaacctttcggttaccgtttcgttaacggtaacccaacgtaccgaccaaccccgagggtaaccctaaaccggtacccctaaaacgtccgtaacgttacgttaaacttttacgtacgggtaacccgttaaccgtaaacccggtaaaccccgggtcccggttaaccgggtaacgggtttacccttaacggttacctaccggttacctttcggttacgttccggtacctaccggttaacgtccggtaaccgaccaccggtacccgtccctaccgtacgtacctactcccgtagggtccgtcccgacgtacggtactacggacgccggtaaggtccctaagttaactttcgttacgacgacgtctactaagtaccgtacaacgcgaactcaagttaccgtcgtttacggggtacggtacgggtcccggtaggggaccccggttacgtaccggttaccgtacgggttcgtacgtaccggcccggttacgtcgtacccccgg

SEQ ID NO: 8389 - DNA, 644 bp, Homo sapiens
  misc_feature: GYAE6OF01CC5QM.37.36.D03.1.454.CMB.1.raw
  modified_base (239)..(239): a, c, t, g, unknown or other
  misc_feature (239)..(239): n is a, c, g, or t
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
  modified_base (519)..(519): a, c, t, g, unknown or other
  misc_feature (519)..(519): n is a, c, g, or t
  modified_base (542)..(542): a, c, t, g, unknown or other
  misc_feature (542)..(542): n is a, c, g, or t
  modified_base (581)..(581): a, c, t, g, unknown or other
  misc_feature (581)..(581): n is a, c, g, or t
  modified_base (616)..(616): a, c, t, g, unknown or other
  misc_feature (616)..(616): n is a, c, g, or t
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
tcagtagtgtagatcacgaccggtgctcgatttagctgcgtcacgatctcgtcgttggggggggtcacaagaggcagcgctctcgggacgtctccaccatggcctgggctctgctgcctcctcactctcctcactcacggaccacgacgggttccgtcgggaccccaggtcctcgcccgtgacctcacgcctcgcctcggttgtcgttcggtcctcgtgactacgtcgtactacacctntcctcctgacctacgtacgaaccagactagtagtaacttattaacgtaaactttaacgttaaccgttcttctacgttaccgtaaccaacgaacncccaaaccggacgaaccgtaaccccaccctaacncgtattagtattacggngaacgagtaacggtacgccgtaccgtacggttacggttactactccgtacttcgtcgtcgacctacgtagccgtacgacctacgccgtacctctacgacttactcgcgtcggaccctcgcgtagacggcgtacgngtatagttactacgtcgtgcgtntacctagtacgtgtacggacgtagttaccgtcttacgtntcgttacgtcggtaacgaggtacgtaccgccgtanaccgtanacganacccgacgcccgtacc

SEQ ID NO: 8390 - DNA, 1031 bp, Homo sapiens
  misc_feature: GYAE6OF01DPPG0.37.36.D03.1.454.CMB.1.raw
tcagtagtgtagatcacgaccggtgctcgatttagctgcgtcacgatctctcgttgggggggtcacaagaggcagcgctctcgggacgtctccaccatggcctgggctctgctgctcctacactctcctacactcgagaccacgacgggtcctcgggccctagtctcgaccctgactcagcctgcctcgtgtcgtggtctcgtggactacggtcgaactccaacccgtacttccgtaccgtacggacctaaccggttacggaaaccctaggtacgtaacggttaggtaactttaacgtttaacgttaaaaccgttttacgttaaacccgttttcggtacctttaaccggtttaaccggtaaacccgaaacgtaccggtaaccccgtaaccccggaacgggtaaacccgtaaaaaccccggtacccccttaaaaacgttccggttaaacggtttaacggttaacggttttacgggtaacggtaaacggtaaccggttaaacgggttaacccggtaccccgggttaaccccggttaacgggtttaaaccggggttttaaccttaaaccgggttcccgtttacccgtttaaccggtacccggtttacgggtaacccgttaccggtaaaccggttcccgggtaaacggtaccccgtaaaacccggtcccgggttaaccccctttccggtaaccggttaaccgttaaacccgtttcccggtaccgggtttaccgggaaccccgttccggtaaccgggtaccggtaacggggtaacccgggtacgttacggttacccgttaacggtttaaacgttttaccgtttaaccggtacggttaccgttaccggttaaccgaccgttaacgggttttaacgcggttaaacggttactttaaccggcctttaacgttcgttaccggttcgtttaccgggtaaaccgggtaccggttaaccggtaacgggtaacccgtttaccgtaaccgttaacccggttaacggaacccggtaacccgtaccccggggaacctaaccccccgg

SEQ ID NO: 8391 - DNA, 713 bp, Homo sapiens
  misc_feature: GYAE6OF01DD4AH.37.36.D03.1.454.CMB.1.raw
  modified_base (187)..(187): a, c, t, g, unknown or other
  misc_feature (187)..(187): n is a, c, g, or t
  modified_base (349)..(349): a, c, t, g, unknown or other
  misc_feature (349)..(349): n is a, c, g, or t
tcagtagtgtagatcacgaccggtgctcgatttagctgcgtcacgatctctcgttgggggagtcagtcccaaccaggacacagcatggacatgagggtccctgctcagctccgtgggctcctgctgctctggcctctcgaggtcgaccagatgtcgacactccagactacgaccctagtcctacccncctcccccctgtctcgctatcgtaggtaggagacagtacgtaccaactactccacgttcgacgacggcgagtacgaaggactggtacgaacttaaactttaagtttaaagttaggtacctacgaacgtaccgaaaacggtaaacccggaacgggtaaacccnccccgtaagtccgtaccgtacggtactacgcgtacgactactaaccggtaagttaacggaaacgtcgaacccgttactaacgtacggtaaggttcgagggtaaggtaagtcggtatacggtacgtacgttattttaccgttttaccttacccgtacgttaacgagtcccgtacgttccgtagtaccgttacgtacaagggtaactacgtaagttacaacgttaactacgtttactaagttacccaaccgtaactcggtaccgtacccgggaaccgtccggaaggtaaactaggtacgaactaccggtaacaacggtaggtccggtacgcgtcgaacccttaactgtacgtccttacggtacccg

SEQ ID NO: 8392 - DNA, 843 bp, Homo sapiens
  misc_feature: GYAE6OF01CK5VA.37.36.D03.1.454.CMB.1.raw
  modified_base (231)..(231): a, c, t, g, unknown or other
  misc_feature (231)..(231): n is a, c, g, or t
tcagtagtgtagatcacgaccggtgctcgatttagctgcgtcacgatctctcgttggggggggtcacaagaggcagcgctcgtcgggacgtctccaccatggcctgggctctgctgctcctcactctcctcactcacggacacgacgggtcctcgggcccagtctcgccctgactcacgcctcgtcctccgttgtcgtcgggttcctccgtggacgacgtcgactcaaccnttcctccgtgacacgacggaaccagcagtagattagttaacgtaaactttactaaccttgttcttacgttacgtaaccaacgccgaccaaccgaacggaaccaaaccgtaacccccaaactctaacgtacgtttagtttacggacggaacgggtaactaaggttaacggccccgggttacccgtaggttaaccgggggttttaactaacggttccgttaccgtttccgtccggttcgggtacctaaccgttaacgggtaccgttacccgggaaacgtaaccccggtaccgggttccccttaccgtaacgtaacccgttaacttccggttaccggtaccggacccgttaccggtacgggtacgtaggaaccgggggtacgaacggtacgtttacgggttaaactttacgtttacggcgtcccttgtaccttacgtaacttcgtacgggttaacgtacggttacttaccgttacccgtttattaaaccggttttcgaaccggtttaaccgggaacccgggtaacgggtacccggttaaacccggtaccgttaccccggtaaccttaacgaaccccgggaaacccggtaaccccctaaacccgggtaaccccccg

SEQ ID NO: 8393 - DNA, 745 bp, Homo sapiens
  misc_feature: GYAE6OF01B9EUA.37.36.D03.1.454.CMB.1.raw
  modified_base (257)..(257): a, c, t, g, unknown or other
  misc_feature (257)..(257): n is a, c, g, or t
  modified_base (332)..(332): a, c, t, g, unknown or other
  misc_feature (332)..(332): n is a, c, g, or t
  modified_base (567)..(567): a, c, t, g, unknown or other
  misc_feature (567)..(567): n is a, c, g, or t
tcagtagtgtagatcacgaccggtgctcgatttagctgcgtcacgatctctcgttgggggggtcacaagaggcagcgctctcgggacgtctccaccatggcctgggctctgctgcctcctcactctcctcactcgaggacacgacgggtccgtcgggcccagtcctcgccctgactcacgcctcgcctcgtgtcgtcggtcctccgtggactacgtcgactccacctatcctccgtcgacgacgtaccggaacccgngtagtgtacggttaggttacggttaataactagtacgttaccttcgttacgtaacctaactactaccaacccaanacctaccgaaccgacgtaccaaaccgtaccccaaatactaattaacttagacgtaacgttaacaaccgttaaccggccttagtaacgttacgttactatccgtctacgtcgtcgacttacgaacgttccgacggaacctaccggacccgttccctaactacgaccctagttccgacggttaccggacctaccgtaacgtcgggaaacggtgaccgtactaggtaacttgttaacncgtctacgtcccgtatacgttacggacggttacgtacggttactaaccttcgggttaactttacccgggtacggtttacccggtaaaccgggttacggtaaccgggtcccgttaaaaccggtccgttaaaaccccggtcgtaaacccggacgtaaaccccgggaccgtaaacccccgg

SEQ ID NO: 8394 - DNA, 848 bp, Homo sapiens
  misc_feature: GYAE6OF01DNXAT.37.36.D03.1.454.CMB.1.raw
  modified_base (105)..(105): a, c, t, g, unknown or other
  misc_feature (105)..(105): n is a, c, g, or t
  modified_base (160)..(160): a, c, t, g, unknown or other
  misc_feature (160)..(160): n is a, c, g, or t
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
tcagtagtgtagatcacgaccggtgctcgatttagctgcgtcacgatctctcggttggggggggtcacaagaggcagcgctctcgggacgtctccaccatggccngggctctgctgctcctcactctcctcactcaggacacgacggtccgtcgggcccngtctcgtcctgactcacgcctcgcctcgtgtcgtcggtctctggacncgtcactcaccnttccgtctcgactacgtcggaaacctagcgtagtcgtaatttaagttacgtaaaacctttacttaactttcgtaccttacgttacggtaaccaacgacgacctaaccggacgggtaacccaaacccgaaccccgtaaactctagtacgttaggtttagaggaaccgtaacgtaacggttacggaccggttacccgttagggttacggttttactaacgttccgttccgtttacgtcccgtagtaccctaaccggtagttcggtaccgacgtaacccgtccggtaccccttaccgacggttacccaacgtttccgtacggtacggtacccgttacgtacgggtacggtacgggacggtacgtacgggttactacggttaacgtttacgtttcgtaacgttcgttacgtaccgttacgtaacgttcggttacgtacggtttaccggtacgtacccgtttaacggtttccgttttaaaccggggtttcgttttaaccccgggtaaacgggtttaaacccgggtaacggggtttaaaccccgttaaaccgggttaacccgtttaaccccggtacggtttaaccccggtacgtaaacccccggtaaccccggtaacccggtaaaacccccccgg

SEQ ID NO: 8395 - DNA, 878 bp, Homo sapiens
  misc_feature: GYAE6OF01BTVLH.37.36.D03.1.454.CMB.1.raw
  modified_base (681)..(681): a, c, t, g, unknown or other
  misc_feature (681)..(681): n is a, c, g, or t
tcagtagtgtagatcacgaccggtgctcgatttagctgcgtcacgatctcgtcgttggggggggtcacaagaggcagcgctcgtcgggacgtctccaccatggcctgggctctgctgctcctcactctcctcactcgagacacgacgggtccgtcggacccagtctcgccctgactcgacgcctcgcctcgtgtcgtggtctcgtagacacgtcgatccacctactcctccgtgccgtaacgtacggaacctagacgtagtataattaagttaacgtaaaactttacgtttaacccgttcgttccgttaccgttaaccggtaaacccaaccggtaccgaaccccaaccccggaacggaaacccctaaaaccccggtacccccctaaaagttacctaacggtttaggttaacgttttacgggaacgggtaaaccgggtaacgtaaacgggtacccgggtaccccggttacccgtttacggggtttaacggtttaaacctccgttaccgttcgttcgtcggtacgtcccttaacgcgtttaccgacggtaaccgaaacccgtcccgggtaccctaccgtaacggtaaccttacctccggtccggttacggtcccgtaccggagggtaacgttcggggaacgtacgggttgtaacccgttagttaacttttccggtaccggttntccgggtacttaaccgttacgtacgtaagtaccggtaacggtaccggttactaaccgttacgtttttcgtaacgggtttaccgtttacccgggaaaccgggtccggttaaaacccggcccgttaaagttcccccgtaacccggtttaactacccgaaacccgtttcccggaaaccccggtaacccgtaaaccccccg

SEQ ID NO: 8396 - DNA, 753 bp, Homo sapiens
  misc_feature: GYAE6OF01BG7CI.37.36.D03.1.454.CMB.1.raw
tcagtagtgtagatcacgaccggtgctcgatttagctgcgtcacgatctctcttgggggagtcagtcccaaccaggacacagcatggacatgagggtcccctgctcagcctcctggggctcctgctgctctggctctcgaggtgcagatgtgacactaccagatcgacccagtctcccacctcccccctgtctcgctatctaggtaaggacgacgaagacgtaccacctatcctaccgttcgaccggagggtacgacgtacggacggaacgttagttggaaccttaaactttaatttaaagtttggtactactaggacaaacggaaacggaaccgggtaaccgaccccgtaacgtccgtaccgttacgggtaccgtaccgtcgtcgtaacctacgtaccgttaaacggttaacggaaacgtacggtacgtacctaagtaaccggtaagttacgtaaggtaggggtaaggtacggtactaggtaacggtactttaagttaccgttttaccttacctaccttacgacgtctacggtcctagcgtaacgtacgtagtaaagccttaagtacctaaaccgtacttaacgtttctttaacgtacgtaaccctaaccgtacctacggtaccgtacccggtacccgtaacggaaaccgttaacggtagtaaaaccgttaccggaaaccgtaaacggtacgtacggttaccgaaccgttcggtaaccttacccttagttacggtaccgtttaccctacccg

SEQ ID NO: 8397 - DNA, 768 bp, Homo sapiens
  misc_feature: GYAE6OF01C860A.37.36.D03.1.454.CMB.1.raw
  modified_base (539)..(539): a, c, t, g, unknown or other
  misc_feature (539)..(539): n is a, c, g, or t
tcagtagtgtagatcacgaccggtgctcgatttagctgcgtcacgatctctcttggggggagtcagtcccaaccaggacacagcatggacatgagggtccctgctcagctccgtggggctcctgctgctctggctctcaggtgccagatggtagacatccagactcgacccagtcctcccacctcccccctgtctgctatcgtggtaggagacaggacgtccaccagtcctacttcggaccgtagggaccggtagtacgaggaacctaggtttacggaactaaacctttaaagtttaaaacgttggtaacttacgaacgaaccaaaacgggtaaaaccggaaccggggtaaaaccgccccctaaaggtcccgtaccggttcggtacctacggaccttggacctactaaccgtaagttacggaaacgtcgtaccgtaccataccggtaagttacgtaagggtacggaaggtggtacgtacggtaagggtaacttacggtttattttaccttaccgtaccttaccgacgtccgtacgcgtnaccggtctacgtaagaatacgtaacttacgtactaacgtcttttacttaacggttaacctacccaaactaccgtacggtaccgaacccgggttccggtaaacgggaacccgttaaaggaccggttaacttaaaccggtaaacccggtaaaccgggtacgttccgggtccggtaaacgtccccgtaacgtttacgtaccggttttacctcccgtttaacgtaacccccgg

SEQ ID NO: 8398 - DNA, 621 bp, Homo sapiens
  misc_feature: GYAE6OF01CBM14.37.36.D03.1.454.CMB.1.raw
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
  modified_base (362)..(362): a, c, t, g, unknown or other
  misc_feature (362)..(362): n is a, c, g, or t
  modified_base (405)..(405): a, c, t, g, unknown or other
  misc_feature (405)..(405): n is a, c, g, or t
  modified_base (468)..(468): a, c, t, g, unknown or other
  misc_feature (468)..(468): n is a, c, g, or t
  modified_base (480)..(480): a, c, t, g, unknown or other
  misc_feature (480)..(480): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgaggtcctggcccagtctgccctgactcacgtcctcgcctccgtgtcgtggtctctggacagtcatcacntcnctgcacncggaacngcagtagatattagtaacttactaacttgtactctagtacacacnccacgacgacaaaccgaccccaatccagtgtacgttgagagtacaaggttaacggccgaccgttacggtacggggttactacgtccgtnttccgtacgtggacctacgaatcgcgaccacgccgtcctccgngtaactaatccttacggtcgcttaccgcggatacggacggtaggcgactaagtactttacgtntaccgtcacgtnactagtacgacgtacgtacgggtcttccgaccgtttattacgttcgttacggttaccgggaagttaccgggtaaacgttcccggtaacccgacggtttaaacccggttacgtaaccgtaaccgccgttaaaccggaccccc

SEQ ID NO: 8399 - DNA, 761 bp, Homo sapiens
  misc_feature: GYAE6OF01E5DWY.37.36.D03.1.454.CMB.1.raw
  modified_base (231)..(231): a, c, t, g, unknown or other
  misc_feature (231)..(231): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtcctgccctgactcgagcctgcctcgtgtctgggtctcctggacagtcgatcaccatctctgcactggaaccngcagtgatattagtaaacttatcgtaccttgtcttcgttggtaaccaacgacggtccaacccgacggaccaaaccgtacccccaaacttctatacggtattttggtaggtaaggactaaggtaacggtccggcccgttaggttacggggtttactaacgttccggtctttaccgtcgtacggtaccgttacccgaacggtttccgtacgggacccaaaccgtacccgggtcccttacccgaggtaaccaacgttccgtacggttcccgggtaccgtaccggtagggtaccggttagaaccggggaacggtggtacgttacggtaacgtttttactaaccgtggttaccgttcgaaccttacgtaacgttgttaccgtagttacggggttaactccttaaccgttctttaacgttcggtttacccggttacggggtaaaccggttacccggggaaaccggttaaccggtacccggtttaacccgacccggtttaaacgggcccaacccgggtaaccccccgtaaaccccgg

SEQ ID NO: 8400 - DNA, 721 bp, Homo sapiens
  misc_feature: GYAE6OF01BT8QT.37.36.D03.1.454.CMB.1.raw
  modified_base (135)..(135): a, c, t, g, unknown or other
  misc_feature (135)..(135): n is a, c, g, or t
  modified_base (176)..(176): a, c, t, g, unknown or other
  misc_feature (176)..(176): n is a, c, g, or t
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
tcagtagtgtagatcacgaccggtgctcgatttagctgcgtcacgatctctcgttgggggggggtcacaagaggcagcgctctcgggacgtctccaccatggcctgggctctgctgctcctcactctcctcactnaggacacgagggtcctgggccagtctcgtccctgactcganccgtcgtcctcgtgtcgtcggtcctcgtgacngtcactcacctatcctactcgcctacgtacggaaccngacgtagtagtaattaacgttaactaaccttacttaaccgttcgtacttacgtacgtaaccaacgaccgtaccaaccggaacgaaccctaacccgtaccctaaactactagttagttagttacggaacggtaacggtaacgtaacggtcgtacccggtaccggttacggttacggttactacgttccgtctcgttaccgtcgtactaccgtacgtacgaccgtaacgtaacccgtccgtaccctaccgtactaccgtactcgtcgtcgtacgtacggagtacggaggacggtacggtacgtacttacgttacttacgtactcgtactgacttacgtagttacggtaccttaaggttacgttactacttacgtttcgtttacgttacggttaccggtaacggttacgacccgggttacgtaccggttaccgaccgttaacgtaccggacccgaacccggaacgtaacccccgtaccg

SEQ ID NO: 8401 - DNA, 735 bp, Homo sapiens
  misc_feature: GYAE6OF01AO0MM.37.36.D03.1.454.CMB.1.raw
  modified_base (215)..(215): a, c, t, g, unknown or other
  misc_feature (215)..(215): n is a, c, g, or t
tcagtagtgtagatcacgaccggtgctcgatttagctgcgtcacgatctctcgttgggggggggtcacaagaggcagcgctctcgggactctccaccatggcctgggctctgctgctcctcactctcctcactcaggacacgagggtcctgggcccagtctcgccctgactcagcctgcctccgtgtctgggtctccgtggacagtcgatccacnctctcctgcactcggaaccagcagtcgtatattagtaaaacgtttaacttaacccttcggttaccttcgtttacgggttaacccaaaccgacgtaccaaaccccgaacggaccaaaaccggaccccccaaaactcctacgttaggttatttaggtaggaacggtaacaacgggtaacggtaccggtcccgtaccggttacgggggttttactaacgtacgttcttcgttcgtacggtcctacgtaacgtcgttacgaccgtaaccgaccggtccctaccgtataacgaacttccgtacgtacgggtccacccggtaacggtcgtacgggaaccgggtacggtaggtacgttacgttaagtttaactacgttccgttactaccggtactcctaagttactacggtaggtacgttacgtacctacttcgttagttcgttacgttaccggtaacgtacgggtaccaaacgggttcccgttacggtaaaccgtcgtaccgaaccgtcccgaaacggtacccccg

SEQ ID NO: 8402 - DNA, 830 bp, Homo sapiens
  misc_feature: GYAE6OF01BJY2V.37.36.D03.1.454.CMB.1.raw
  modified_base (148)..(148): a, c, t, g, unknown or other
  misc_feature (148)..(148): n is a, c, g, or t
  modified_base (609)..(609): a, c, t, g, unknown or other
  misc_feature (609)..(609): n is a, c, g, or t
  modified_base (724)..(724): a, c, t, g, unknown or other
  misc_feature (724)..(724): n is a, c, g, or t
tcagtagtgtagatcacgaccggtgctcgatttagctgcgtcacgatcgtctcgttgggggagtcagtcccaaccaggacacagcatggacatgagggtccctgctcagctccgtgggctcctgctcgtctcgtggctctcgaggtcnccagattgagacatccagatccgaccctagtcctccctacccttccccccgttgtcctacgacctacttcgtaggtacggaacgtacgaacggtactaccaaccctaacttccgtaccgttaccggaccggtacggggaccgtaaggttaccggaacggtaacgttaggttaccggtaaacttaaaacttttaagtttttaaaacggtggttaaactaccgaagtaaaccggaaaaccggaaaccgggaaaaccggggaacccctacccccgaacgttcccggtttaccgtacggttcccgtaacgtcgtactaccgttactaacgttaaggttaccgaaacgtaccggactacccgagttaaccgtaggttcgaaggttacggagttgtacgttcggtaaggtactttacgttttaacgttttaccctccgttaacttacgacgtcggtaactcgtacgngttaacgcgtaacgaaggtaccttgttaacccattaccttatttacgtactaacctaccgtaacctaacgtaccggtacgggtaccccgtaccggtaccggtaaaggttaaccgnggttaaaaccggttaacccaaacggggtaacccttaaggtccgggtaaacttcccgtaaccggtacctacccttaggtttaccccttcgtttcccttaacccccgg

SEQ ID NO: 8403 - DNA, 724 bp, Homo sapiens
  misc_feature: GYAE6OF01AMNYR.37.36.D03.1.454.CMB.1.raw
  modified_base (389)..(389): a, c, t, g, unknown or other
  misc_feature (389)..(389): n is a, c, g, or t
  modified_base (540)..(540): a, c, t, g, unknown or other
  misc_feature (540)..(540): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgccctgactcacgcctcgtcctcgtgtcgtggtctctggacagtcgctcaccatcctctgcactacggacagcagtagtatattacgtaattactaccttgtctcgtacgtaccacacgaccaccgacgaccgaaaccgaccccaatctagttcgtagtttacgagaacggtaaccgagtaaccggtccggtccctacggtacgggtttaacacctcgttcgttccncggttcgaacctacggcgttacgtaccgggaaacgtcccgacccggcccttaccgtaacggaccttacttccggtacggccgggttccccaacgggtacggtcgtacgggacgggtacggacgttacgtatttaacggtttattacccggngtaccgttgacccttacgtaatttcgtaacggtaccggttaggtaccgttaccgtttaacgttcggtttacggttaccgtttaaccggttaccggggtaaacccgtagggttaaccccgttaggttaacccctcccggttacgtaaccgggtacccaccggaacccggtaaccccggtaacccc

SEQ ID NO: 8404 - DNA, 741 bp, Homo sapiens
  misc_feature: GYAE6OF01BIXIP.37.36.D03.1.454.CMB.1.raw
  modified_base (172)..(172): a, c, t, g, unknown or other
  misc_feature (172)..(172): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (335)..(335): a, c, t, g, unknown or other
  misc_feature (335)..(335): n is a, c, g, or t
tcagtagtgtagatcacgaccggtgctcgatttagctgcgtcacgatctctcgttgggggggtcacaagaggcagcgctcgtcgggacgtctccaccatggcctgggctctgctgctcctcactctcctcactcaggacacgagggtcctgggcccagtctcgccctgactnagcctgcctcgtgtcgtggtctcctggacngtcatcacntctcngcactaggaccngcagtagtagtattacgtaaacttacttaccttgtcttcgtacgtaccacgtacgccaccgagaccaaacgtacccccaactcgtaatgtattcggtagagtaacgngtacgcgggtcctaggttacggtttacaagtcgtcttactcggtgtacctacgacgtcgtacgcaaaccgccgtaccctcgtaccggtaactaaccgttcgtacggttcggtacccgtacccgtaagggtccgtaacggggacggtaccggtaacgggttcctttacgtaacgtttttaacgttccgtaacgtaccgggttccctacgtttaaaccgcggtttaacgtccggttaaacgttccgggttaacgtttacccggtaaccgtttttacggttaacgtttcgggttttacccggtaaacggtacccgggttaacgggtaccccggttaacggttacccccgttacgggttaacccctacgggtactaaaccccggtcccggtaaacccgtaacccccccgg

SEQ ID NO: 8405 - DNA, 743 bp, Homo sapiens
  misc_feature: GYAE6OF01BR1NA.37.36.D03.1.454.CMB.1.raw
  modified_base (361)..(361): a, c, t, g, unknown or other
  misc_feature (361)..(361): n is a, c, g, or t
tcagtagtgtagatcacgaccggtgctcgatttagctgcgtcacgatctctcgttgggggggtcacaagaggcagcgctcgtcgggacgtctccaccatggcctgggctctgctgctcctcactctcctcactcgaggacacgacgggtcctcgggcccagtcctcgccctgacctcagtcctcgtccctccgtggttcgtcgggtcctccgtggacgacgtcgactccaccatcctcctcgccacgtacggaaccagcgagtagtattattaacgtaaactttacttaccgtttgtccttacttacgtaccaacgacgaccaaccgacggaaccaaaccgacccctaaatcagttacgtntttgaggacgtaacgtaacgtacgccgtaccgtaggttacggttactagttcctcgtcgtcgtcgtcctaacgcgtcgacgaccaccgtaccggtccttaccgtacgtaacgtacctcgtaccgtcgggtacctaccgggtcggtacgtacgggaacggacggttacgtacgttaacgtttaacgtttcgttacgtcgttaccggttctaaccttaggtacctaggtcccggtaacggtaacgggtttaacctcgtaaccgtttccgtttacgtaccggtttaccggtacggtaaccgggttaacggaacccggtacccgttaaccgtacccggtttaccaacgttaaccccggacccgttaaccgaaacccggtaaccccc

SEQ ID NO: 8406 - DNA, 843 bp, Homo sapiens
  misc_feature: GYAE6OF01EDMTY.37.36.D03.1.454.CMB.1.raw
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (669)..(669): a, c, t, g, unknown or other
  misc_feature (669)..(669): n is a, c, g, or t
  modified_base (732)..(732): a, c, t, g, unknown or other
  misc_feature (732)..(732): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcgagacacgacgggtcctcggacccagtctcgccctagacctcacgccctcgtccgttcgtggttcgttcggtccttccgnggacgngtctactaccacctctctccncgacctaccgacggaacctagcgtaagtacgtatttaacgttaaccgttaaaactttaacgttaccgtttcgtttaccttaccgttaacggaaacccaacgacccggaccccgaaccggaaccggaaaccccaaacccccggtaaccccttaagttacctaaggtttacggttacggtttagggaacggtaaacggtaacgtaaccggggtaccggtcccccggggtttaacccgttaggggtttttaaaccggggttacctttaacccgttccggttttcccttgggtttacccggtacggttaaccccgttacgtaaaccggttcgggtaccaaccccgtaccgtacccgggttaccccttaccgtactaaccgttaccgttcgtacgtccggggtcaacgggtcgtaggtacggacggtacggtntacgttagttacttacgtagtccgatcgtactacgagtcgtagtactcggtttactaccgttnttccgggttattaccgggtttacgaaccgggttacgggttaccggtaaccgttacccgtaccggtttacccgtagtaaccgacccgtaacggtaaccccgccgtaaccccg

SEQ ID NO: 8407 - DNA, 773 bp, Homo sapiens
  misc_feature: GYAE6OF01B11SE.37.36.D03.1.454.CMB.1.raw
  modified_base (272)..(272): a, c, t, g, unknown or other
  misc_feature (272)..(272): n is a, c, g, or t
tcagtagtgtagatcacgaccggtgctcgatttagctgcgtcacgatcgtctcgtgggggggtcacaagaggcagcgctcgtcgggacgtctccaccatcggcctcgggctctgctcgctcctcactcctcctacactcgacgacacgacgggtccgtcgggccacgtcgtcgcctacgactcacgtcctcgccttcgtcgtcgtacggtcctccgagtacacgtcgtacgtaccaacgtcgtccttaccgacgacgaccgtacggaaaccncggactagtactattacggttaaacgttaaacgttacttaacctttgtccgttacgttaccggtaaccaaacgacggaccaaccggtaacggaaaccaaccgaaccccaaaacgttactagtacggttactttaggaacggtaacggtaacaacggtaaccggccgtaccgttacggttacggggtttaactaactcggtacttacgtcgtacggtactacgtacggtcgacgaccgtaaccgccggaccttaccgtacaaccgtaacgttccgtcggtcggtacctacgtaacgggtcgtaagggacgggtaacggcgttacgtaacggttaacttaacgttcgaacttcgtcgtaacgttcaacgttagtaccgtaagttaccggtattaccgtaacttcgttacgtttaacggtccggttaccggaagttaccgggtaaacaccggtaccgtaaccgtacggtaactaccggtaaccaaaccgttacccggaaacccg

SEQ ID NO: 8408 - DNA, 734 bp, Homo sapiens
  misc_feature: GYAE6OF01D8U9T.37.36.D03.1.454.CMB.1.raw
  modified_base (609)..(609): a, c, t, g, unknown or other
  misc_feature (609)..(609): n is a, c, g, or t
  modified_base (720)..(720): a, c, t, g, unknown or other
  misc_feature (720)..(720): n is a, c, g, or t
  modified_base (729)..(729): a, c, t, g, unknown or other
  misc_feature (729)..(729): n is a, c, g, or t
tcagtagtgtagatcacgaccggtgctcgatttagctgcgtcacgatctctcgttgggggatcacgtcccaaccaggacacagcatggacatggacgggtccctgctcacgctccgtggggcctcctgctgctcgtggtcctctcgaggtcaccgagtagtggtacacactaccgagactaccgaacccgtctccctcccgacccttcccccgttgtctcgactacgttcggtaggaaggacacgacgtactacctaccactctcggtccgacggaggtacgacgtacgacgtattagttacgtaacttaaatttaagtttaacgtgaactacgaacgaaccgaaacggaaaccggaaccggaacccacccgtacgtccgtaccgttcgtaccttacggactacgtaactacgttaaccgtaaaggtaacggaaacgacggttacctagaacgttaaggtaacgtacgtacgggtaagaggttacggtacgttacggtacggttaaatttaacgttttaccttttacctaaccgttacgtacacccgtacgtacccgtcgtaactcggtacgttagaaacggtaccttagaccgttactaactaacttntttaaacgtctaccgaacctacgacgttaccgaccggtaccgtagaaccgggtaataaggcttaaaacacgggtacttaaggcgttggacctacgacttacgacttacttnttacccgtntaccc

SEQ ID NO: 8409 - DNA, 526 bp, Homo sapiens
  misc_feature: GYAE6OF01A2S9D.37.36.D03.1.454.CMB.1.raw
  modified_base (228)..(228): a, c, t, g, unknown or other
  misc_feature (228)..(228): n is a, c, g, or t
  modified_base (385)..(385): a, c, t, g, unknown or other
  misc_feature (385)..(385): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccngcagtgacgttggtggttataaatatgtctcttggtaccaacatcaccaacatcacccaggcaaagtccccaaactcataatttatgaggtcactaaacggccctacaggatttcaatcgctttctctggctccaagtctggcaacacggcctcccngaccatctcgtgggcctaccaacctgaggaccgaggcctcactatttattcgacagctcatatacaagcagcgtcacgttgggttcgttcgggcggacgggaccgaccctggtacccgttcgttaggcacgcccgaacggg

SEQ ID NO: 8410 - DNA, 754 bp, Homo sapiens
  misc_feature: GYAE6OF01A03V9.37.36.D03.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (240)..(240): a, c, t, g, unknown or other
  misc_feature (240)..(240): n is a, c, g, or t
tcagtagtgtagatcacgaccggtgctcgatttagctgcgtcacgatctctcgttgggggggtcacaagaggcagcgctctcgggacgtctccaccatggcctgggctctgcctgctcctcactctccctcactcaggacacgagggtcctgggcccagtctcgccctgactcagcctgcctcgtgtcgtggtctccgtggacngtcgatcaccntctcctgccacgtgaccagcgagtnattatagtaaaccttataaccttgtacttcgttacggtaaccaacgtacgaccgaaccccgaacggacccgaaaaccgtacccccaaaacgtctaagttggtactttaggacggaacggtaacgaacgtaacggtccggtacccggttaccggtaacggggttttacctaaactccggttacttccgttacgtacggttaccctaaccgtaacgggtccgttaacggacctaaacccgtacccgggtaccctcccggtaacaaccccgttagtaccccgtttcggtacccggtcccgtaacccgtaacggtcggtaacgggacctaacggtcctaacgtaaccgtttataacgttgacccgagtctactataacgtaccaagcaacgtgtacccgtgttacgggtggtaccgggtacggtcccggtacggtacccttccggtaaccggtaccgtttaaccgggaccggtaaccgtacccccgggaacggtttccccgccccgttaacccccggg

SEQ ID NO: 8411 - DNA, 924 bp, Homo sapiens
  misc_feature: GYAE6OF01EOIQO.37.36.D03.1.454.CMB.1.raw
  modified_base (272)..(272): a, c, t, g, unknown or other
  misc_feature (272)..(272): n is a, c, g, or t
tcagtagtgtagatcacgaccggtgctcgatttagctgcgtcacgatctctcgttggggggggtcacaagaggcagcgctcgtcgggacgtctccaccatggcctgggctctgctgctcctcactctcctcactcaggacacgtacgggtcctcggccctagtctcgcctgactcacgtcctcgccgttcggttcgttccggtcggtacctcgtaggactacgtacgactaccaccgtcttcctccgtacgaccgtaacgtaccgaaaccgnggacgtagtagtaactttaattaacgtaaaacttttacttaaccctttcgttaccctttacggttaacgtaaaccgaaaccgaccgaccccgaaaccccggtaaccggaaaccccgaaaaccccgtaaccccctaaagttaccgtaacgtttacgtttaacggtttaggaacggtaaacggaaaccggtaaacgggtaacccgggtccccggttacccggttaaccgggtacgggtttaacccttaaccggttaaccgtttacccgttccgttttaccggtacccggttaccgggttaacccttaaacccggttacggtttcccggaaccggtaaaaccccgtaaacccgggggtaccccttaacccccgtttaccccgtaaaccggtaccccgtttaccgttcccgggtttacggggttaacccccgtcccgtaaccgggtacggtaaccgtacggggaacccgggtaccgtaaaccgttccgtaaaccgtttactttacggttcgtacgacgtttaactcctaacgtaaacgtccgaaacgcctaagtcgattaaccggttccggttaggttcggggtaccggacgggacgggtaccgtaccggtcgttaaccggtccgttaaggtacccgaccgtaagcccgtacccgg

SEQ ID NO: 8412 - DNA, 735 bp, Homo sapiens
  misc_feature: GYAE6OF01CBNFP.37.36.D03.1.454.CMB.1.raw
  modified_base (266)..(266): a, c, t, g, unknown or other
  misc_feature (266)..(266): n is a, c, g, or t
  modified_base (528)..(528): a, c, t, g, unknown or other
  misc_feature (528)..(528): n is a, c, g, or t
  modified_base (698)..(698): a, c, t, g, unknown or other
  misc_feature (698)..(698): n is a, c, g, or t
tcagtagtgtagatcacgaccggtgctcgatttagctgcgtcacgatctctcgttggggggggtcacaagaggcagcgctcgtcgggacgtctccaccagtggcctgggctctgctcgcctcctcactctccctcgactacgacggacacggtacgggtcctcgggccctagtctcgcctgactcacgcctcgcccgtcgtcgtccgtagggtcctcgtaggactaggtacataccactacctcgtcctgacctaacgacggaacncgctagtgtaacgttaataacgtaaactttacgttaaccgttcgtaccgttacgtaccgaaacctagaccgaccgaaccgaacggaacctaaacccgtaccccctaacgtactaacgttagtacgttaggtaacgacgggtaactaagggtaacgtcccgtaacgtcggttaaggttactacgtcgttcctcgtacgccgtactacgtacgtcgctaacgacctccgtcctcgaacactaccgtgtccggtacggcctacgnggtacgtacgaacggggtcgtactacgttacgtaactttaacgtctacgtcttagacttaacagtttacgacgtaataccggttaccgtacttacgtttacggtaaccgttggttaacccggttagtaaccgggtaaaccggtcggaaacccgttcctaaaacccggttnaacccggttccaaaccgggtcccccaagtaacccccg

SEQ ID NO: 8413 - DNA, 782 bp, Homo sapiens
  misc_feature: GYAE6OF01BGAC0.37.36.D03.1.454.CMB.1.raw
  modified_base (698)..(698): a, c, t, g, unknown or other
  misc_feature (698)..(698): n is a, c, g, or t
tcagtagtgtagatcacgaccggtgctcgatttagctgcgtcacgatctctcgttggggggggtcacaagaggcagcgctctcgggacgtctccacatggcctgggctctgctgctcctcactctcctcactcaggacacgagggtcctgggcccagtctgccctgactcagcctgcctcgtgtcgtggtcctcgtgacagtcgatccactatcctcctgaccacgtagaacctgcgtagtagattagttaacgtaaacgttacttaaccttgttaccttacgttacggtaaccctaacgacgtaccgaacccgaacgggaacccaaaaccccggtacccccctaaaagttaccgtaagtttaccggttaaagttttacgggtaacggaaacgggtaacgtaaacgggttaaccggtcccgggtaccccgtttacgggttacgggggttttaactaaccgttcgttcctttacgtacgtcggtacctacgtacgttccgtacgggacctaaaccgtcccgggtccttaaccgtagaaccgttaccgtaccgttcggtacgggttaccctaccgggtaacggtacggtacgggaacgggtacggtacggttacggtttaacgttaagtttaaccggtttcgtaccgtcgtacggtaccttacgaacgtttacgtcgtaacgttacggtataacccgttntttacgtacgttcgtttacgtacgggtacgtacggacttacgcccttaaccgtcgtaactaccgacgtacccgaccgtaacccc

SEQ ID NO: 8414 - DNA, 885 bp, Homo sapiens
  misc_feature: GYAE6OF01CDMUV.37.36.D03.1.454.CMB.1.raw
  modified_base (254)..(254): a, c, t, g, unknown or other
  misc_feature (254)..(254): n is a, c, g, or t
tcagtagtgtagatcacgaccggtgctcgatttagctgcgtcacgatctctcgttggggggggtcacaagaggcagcgctcgtcgggacgtctccaccatggcctgggctctgctgctcctcactctcctcactcaggacacagggtcctcgggcccagtctgtcctgactcacgcctgcccttccgtgtcgtcgggtcctccgtggacctagtcgactcacctatcctctgacacgtacggaaccagcaggtntattaacttacgtaaaacttaacgttaacctttggttacttcgttacggtaaaccaaacgtacgaccgaaccccgacggaaaccaaaccggtacccccaaaactacctaagtagttaacgttttggacgaacgtaaaccggtaaggtaaacggccccggtacccgttacgggtaacggggttttaccttaacgtaccgttacctttacgttcgttccgggtaccttaacccgtaacggttcccgtaaggtaaccctaaaccggtacccgggtacccttacccgtaagtaaccctacgttacccgttacggtcgggtacctaccggtacggtaccggtaaggtaccggggaacgggtaacgttacgttaacggttaacgtttaacgttacccgtagtttaccggttcggtaacccgttattaaccgtacgttacggtacggttaacgggtttacgttacccttacgtttacgtttaccggttaccggtttacggtaaccggggttaaaccggttaacccgggttaaaccgggtaaacccgggtttaccccggtaaacccggtttaaccgtaaacccgggtaacccccgttaaaccgggtccccccggtaaaaccggtaaaccccccccccgg

SEQ ID NO: 8415 - DNA, 717 bp, Homo sapiens
  misc_feature: GYAE6OF01CI02Y.37.36.D03.1.454.CMB.1.raw
  modified_base (236)..(236): a, c, t, g, unknown or other
  misc_feature (236)..(236): n is a, c, g, or t
tcagtagtgtagatcacgaccggtgctcgatttagctgcgtcacgagtctctcgttgggggggtcacaagaggcagcgctcgtcgggacgtctccaccatggcctgggctctgctgctcctcactctcctcactcaggacacaggtcctggcccagtctcgcctgactcagcctgccgtcgtgtcgtggtcctccgtggacagtcgatcgaccatctccgtgcacgtacggaaccngcagtcgtaatacgttaacgtaaactttaagttaaccgttgttccttcgttacgaaccaaccgacgccctaacccgaggaacccaaaccgtaccccctaaacgtactaactacgttactttacggaggaacggtaacgtaacggtaacggcccggtacccgttacggtaacgggtttactaacgtcgtcgttacgtccgtcggtactaccgaagttcgacgacctaaccgtaccgtcccttaccgtacgaaccgtaacttccgtacggtccggtacctaccgtacggtacgtacgggaacggtacggtacgtcgttaagttactttacgttcgtacgtcgttcgtacccgtagacgttcgtacgtcgttaacggtccgttacgttacttacgttagtccgttaaccgtacggtagtaccggtaccgaacggttaccctaccggtaccgtagaaccctaccggaccctaccgggtaaccccc

SEQ ID NO: 8416 - DNA, 852 bp, Homo sapiens
  misc_feature: GYAE6OF01D4U4O.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgccctgactcacgcctgcctcgtgtcgtggtctcgtggacagtcgataccaccacttcctcctcgaccacgtacggaacctagactagtacgaattattaacgtaaaactttacttaaccgttgtaccttcgttacggtaaccaactacgacctacccgaaggaccaaaaccggaccccctaaactacgtaacgtggtaactttgggtaacggacggtaacgaacgggttaaacggtcccggtacccgttacgggttaacgggggttttaactaaacggttcccgttacgtttccgttacggttaccgtaccgttaaccgtaaacggttccgtaccggtaaccgaaacccggtacccggtaccccgtttacccgtaacgtaaacccgttaaacgttccgtttacggttccggggtaaccctaccgggtacggtacggtaacgggtaacggggaacggtaacgggttaacttaacgggttaacttttaacgttaacgttcgggtccgttacgggttaccctactaacggttacgttacgggacttacggggttaccttaaccgtacgtttacgttaacggttccgttaccggttaaccggggaccggttaacggtaaaccggtaccggttaacaaccccgggtttaacctaacgtacccgtaacccggaccccggtaaacgtaaccccccg

SEQ ID NO: 8417 - DNA, 785 bp, Homo sapiens
  misc_feature: GYAE6OF01DLGUL.37.36.D03.1.454.CMB.1.raw
  modified_base (704)..(704): a, c, t, g, unknown or other
  misc_feature (704)..(704): n is a, c, g, or t
tcagtagtgtagatcacgaccggtgctcgatttagctgcgtcacgatctctcgttgggggagtcagtcccaaccaggacacagcatggacatgagggtccctgctcagctccgtggggctcctgctgctctggctctcgaggtgccagtatgtgacatccagatcgacccagtcctccaccgtcccccctgtcctcgcattcgtaggtaacgggacaaccgagtacgtaccaacccatcctaacgttcggccgacgggcgtacggtacgaggacgtagttaggaaccttaaacttaattttaaagtggtactacgaacgacgaaaacggtaaaccggaaccggggaaacccgacccctaacggacccttaccggtacgggtaccttaccggctacggacctaactaaccgttaaaggtttaacggaaacggtaccgggtaactacccgtaagtacggtaagggtacgtaagggtaggtaaaggtcggtaagtccggtacggtaactaacgttttactttaacctttacctaccgtacgacgtaccgtacggtcctaagtaccgtacgtactaagggaaaccgttagttaacgttccggaaacttaacctttaagtttacccgttttaagtacccgtaaccgtaaacccaaccgtaacggttcccggtaaccggggttacccgtaacggtaaacccgtaaacggngttaaacgtaaccggtaaacaaaacggttcggtaaaccgtggtaccacgtaccgtaactggttacttcttaccgttacccg

SEQ ID NO: 8418 - DNA, 726 bp, Homo sapiens
  misc_feature: GYAE6OF01DUI0W.37.36.D03.1.454.CMB.1.raw
  modified_base (172)..(172): a, c, t, g, unknown or other
  misc_feature (172)..(172): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgcctgactcncgcctcgcctcgtgtcgtggtctcgtgacngtcgatcacntctctgcacgtacgacngcagtgatattataacttacgtaacttgtcttacgtcgaaccacagccaccgacggaccaaaccgaccctaactcgtactagtacgttggtagacggtaacgaggtaccgccggtacccgttacggtacggggtttactaacgttccgtaccttcggtccgttcggtacctaccggtaacgtcgtaacggacccgtaaccgtaccccggtcccttccgtaacgtaacctacgtttccgtacggtacggtaccctaccggaggtaccggtggaacgggtacgtggttactagttaacgttacgttacgtcgtcgtacgttacctacgttacgtagttacgacgttacgggttacctacgttaccgtttacgttcggttaccgttaccgggttaaccgggtaaccggttaccggggtacccgtaacccgggtttccgtaacccccggttaagtaacccggaccgtaaccccggtaacccggaccccggtaaaccccccg

SEQ ID NO: 8419 - DNA, 767 bp, Homo sapiens
  misc_feature: GYAE6OF01DUIY1.37.36.D03.1.454.CMB.1.raw
  modified_base (205)..(205): a, c, t, g, unknown or other
  misc_feature (205)..(205): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgccctgactcacgcctcgcctccgtgtcgtggtctcgtggacngtcgatccacctattcctcgtcgaccacgtacgaaccagcgagtagtaattaacttaacgtaaactttacttaaccttgtaccttacgttacggtaaaccaacgtacgacccaacccgaacgaaccgaaaacccgaaccccctaaacgtcgtacgttacgtagttttaggacggtaacgggtaactaacgggtaaccggccccgggttaccgttaggttacgggggtttactaacgtccgttcttaccgtcgtcggtaaccttcgtaacgtcggtacgaaccaccggtaccgtcctaccgtaagacctacgtccgtcgtcggcccgtacggacggtacgtaggacgggtacggtacggtacgtaagtttaacgtttacgtacggttcgtcgttacgtaccgttaacacgttagacggttacggttaacggtccgttacttaccgttagttaccggttgttaacccggttaacggtaaccggttaccgggaacgttaaccgggtccctaaaccgggttaccgtaacgccggaaaccccgtaaccggtaaccccggtaaccccg

SEQ ID NO: 8420 - DNA, 490 bp, Homo sapiens
  misc_feature: GYAE6OF02IX934.37.36.D03.1.454.CMB.1.raw
  modified_base (364)..(364): a, c, t, g, unknown or other
  misc_feature (364)..(364): n is a, c, g, or t
tcagtagtgtagatcacgaccggtgctcgatttagctgcgtcacgatctctcttggggggtcacaagagacagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaactcatgatttgtgaggacagtaagcgtccctcaggggtttctaatcgcttctctggctcaagtctggcaacncggcctcctgacaatctctgggctccaggctgaggacgaggctgattattactgctgctcatatgcaggtatcactcttatgtcttcggaactgggaccaggtcaccgtctaagtcagccaggccc

SEQ ID NO: 8421 - DNA, 477 bp, Homo sapiens
  misc_feature: GYAE6OF02IRTRN.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatccccctgtctgcatctgtaggagacagagtcaccatcacttgccaggcgagtcaggacattggcaactatttaaattggtatcagcagaaaccagggaaagccccaagctcctggtctacgctgcatccaatttgaaacaggagtcccatcaaggtttcagtggaagtggatctgggacagattttacttcacctttcagcagcctgcagtctgaagacattgcaacatcttattgtacaacaccatgacggcctgggaccaagtggatagtcaaacgactgtagctgcaccatctgtcttac

SEQ ID NO: 8422 - DNA, 488 bp, Homo sapiens
  misc_feature: GYAE6OF02HB7BN.37.36.D03.1.454.CMB.1.raw
  modified_base (417)..(417): a, c, t, g, unknown or other
  misc_feature (417)..(417): n is a, c, g, or t
tcagtagtgtagatcacgaccggtgctcgatttagctgcgtcacgatctctcttggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaaactcatgatttgtgaggacagtaagcggccctcaggggtttctaatcgcttctctggctccaagtctggcaacacggcttccctgacaatctctgggctccaggctgagacgaggctgattattacngctgctcatatgcaggtagtcactcttatgtcttcggaactgggaccaggtcacgtctagcagccaggccc

SEQ ID NO: 8423 - DNA, 499 bp, Homo sapiens
  misc_feature: GYAE6OF02JQKSV.37.36.D03.1.454.CMB.1.raw
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
tcagtagtgtagatcacgaccggtgctcgatttagctgcgtcacgatctctcttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgcccccaaatcaatgatttgtgaggacagtaagccggccctcgaggggtttctaatcgcttctctggcctcaagtctggcaacncggcctcctgacatctctgggctcgaggctggaggcgaggctgattatacngctgctcatntgcaggtatcactcttatgtcgtcggaactgggaacctaggtccaccgtctaagtcacgtccaacgtccc

SEQ ID NO: 8424 - DNA, 495 bp, Homo sapiens
  misc_feature: GYAE6OF02HOQR1.37.36.D03.1.454.CMB.1.raw
  modified_base (228)..(228): a, c, t, g, unknown or other
  misc_feature (228)..(228): n is a, c, g, or t
  modified_base (442)..(442): a, c, t, g, unknown or other
  misc_feature (442)..(442): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacactgggtcctgggcccagtctgccctgactcagcctgcctccgtgtctgggtctcctggacagtcgatcaccatctcctgcactggaaccngcagtgatattgaaacttataaccttgtctcttggtaccaacagcacccaggcaaagcccccaaaactcatgatttgtgaggacagtaagcggccctcaggggtttctaatcgcttctctggctcaagtctggcaacacggcctccctgacaatctctgggctccaggctgagacgaggctgattatactgctgctcatatgcaggtatcactnttatgtcttcggaactgggaccaggtcaccgtccaagtcacgcccaggacccc

SEQ ID NO: 8425 - DNA, 503 bp, Homo sapiens
  misc_feature: GYAE6OF02I4IAG.37.36.D03.1.454.CMB.1.raw
tcagtagtgtagatcacgaccggtgctcgatttagctgcgtcacgatctctcttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggccctcagggtctctaatcgcttctctggctcaagtctggcaacacggcctcctgacccatctctgggctccaggctgacgacgaggctcactattattgcagctcatatacaagcagcatcacttgggtgttcggcggagggaccgaccgtgacccgttcgttaggtcacggcccaaggtcccg

SEQ ID NO: 8426 - DNA, 524 bp, Homo sapiens
  misc_feature: GYAE6OF02JEK92.37.36.D03.1.454.CMB.1.raw
tcagtagtgtagatcacgaccggtgctcgatttagctgcgtcacgatctctcttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaactcatgatttgtgaggacagtaagcggccctcgaggggtttctaatcgtcttctctggctccaagtctggcaacacgcctcctgaccatctctgggcctccaactgaggacgaggctcactattatgcagctcatatacaagcagctcacgttgggtgttcggcggtaacgggacccgaccgtcggaccgttcgttacggtccaggccccgaagggtcctccggtccccccg

SEQ ID NO: 8427 - DNA, 497 bp, Homo sapiens
  misc_feature: GYAE6OF02JJ2ND.37.36.D03.1.454.CMB.1.raw
  modified_base (234)..(234): a, c, t, g, unknown or other
  misc_feature (234)..(234): n is a, c, g, or t
  modified_base (445)..(445): a, c, t, g, unknown or other
  misc_feature (445)..(445): n is a, c, g, or t
tcagtagtgtagatcacgaccggtgctcgatttagctgcgtcacgagtcgtctcttgggggggtcacaaggaggcaggtcggctctcgggacgtctccacccatggcctgggctctgctgctcctcactctcctcactcaggacacagggtcctgggcccagtctgccctgactcagcctgcctcgtgtctgggtctcctggacagtcgatcaccatctcctgcactggaaccngcagtgatattgaaacttataaccttgtctcttggtaccaacagcacccaggcaaacgcccccaaactcaatgatttgtgaggacagtaacgcggccctctaggggttctaatcgcttctctggctcaagtctggcaacacggcctcctgacatctctggctcagctgagcgaggctgattattactgctgctcatatgcagtgtcacttntatgtcgtcggaatcggaactagtcaccgttcaagtccacgaccaggacccc

SEQ ID NO: 8428 - DNA, 515 bp, Homo sapiens
  misc_feature: GYAE6OF02HNMNO.37.36.D03.1.454.CMB.1.raw
  modified_base (385)..(385): a, c, t, g, unknown or other
  misc_feature (385)..(385): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcaccaggcaaacgcccccaaactcatgatttgtgaggacagtaagcggccctcgaggggtttctaatcgcttctctggctcaagtctggcaacacggcctcctgacaatctcngggctccgaggctgaggacgaggctgtattatactgctgctcatatgcgtaggtatctactcttatgttcgttcgagtacggacgtaacgtacgtaccgtaccgtacgtacgacgacccgaccgtacccg

SEQ ID NO: 8429 - DNA, 640 bp, Homo sapiens
  misc_feature: GYAE6OF02J3W9H.37.36.D03.1.454.CMB.1.raw
  modified_base (231)..(231): a, c, t, g, unknown or other
  misc_feature (231)..(231): n is a, c, g, or t
  modified_base (553)..(553): a, c, t, g, unknown or other
  misc_feature (553)..(553): n is a, c, g, or t
tcagtagtgtagatcacgaccggtgctcgatttagctgcgtcacgatctctcgttgggggggtcacaagaggcagcgctctcgggacgtctccaccatggcctgggctctgctgctcctcactctcctcactcaggacacagggtcctgggcccagtctgccctgactcagcctgcctccgtgtcgtggtctcctggacagtcgatcaccatcctcctgcacgtggaaccngcagtagatattacgaaacttactaaccttgtctacgttacgtaaccaacgcgaccaacccacggaaccaaccgaccccaaatcagtgtagtttgaggaagacaggtaccgccggtacctaggttacgggtttactacgtccgtcttcacgtcgcctacgacgtctggacccacgtccgtccctacgtacgtaacctagtccgtcggtaccggtctaccggaggtaccgtacggaacgggtaccgtaggttaccttaaggtaactttacgttacgcgtctacgtacctagtatacggtcgaccgtagttacgtcttaccgtntttacgtccggtacgttaaccggacgtaaccggtaaccgtacgtaccgtaccgtacgaccgtacacccggtacctaaccgtaccccg

SEQ ID NO: 8430 - DNA, 470 bp, Homo sapiens
  misc_feature: GYAE6OF02IO4LO.37.36.D03.1.454.CMB.1.raw
  modified_base (468)..(468): a, c, t, g, unknown or other
  misc_feature (468)..(468): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatccccctgtctgcatctgtaggagacagagtcaccatcacttgccaggcgagtcaggacattggcaactatttaaattggtatcagcagaaaccagggaaagccccaagctcctggtctacgctgcatccaatttggaaacaggagtcccatcaaggttcagtggaagtgatctgggacagtattttacttcaccttcagcagcctgcagtctgaagacattgacaacatcttattgtcaacacatgacggcctagggaccaagtgatatcaaacgatgtgctgcaccatctgtntc

SEQ ID NO: 8431 - DNA, 502 bp, Homo sapiens
  misc_feature: GYAE6OF02GCHDO.37.36.D03.1.454.CMB.1.raw
  modified_base (365)..(365): a, c, t, g, unknown or other
  misc_feature (365)..(365): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcccctgcactggaaccagtagtgacgttgatgattatgactatgtctcctggtttcaacaacacccagacaaagcccccaaactcatcatttttgaggtcactaatcggccctcaggaatttcttctcgcttctctgcctcaagtctggcaacncgcctcctgaccatctctgggctccagactgaggacgaggctgattatactgctagttcatatagagcgaccacacttatgtcttcggaagtgggaccaggtcgtcgtccgtagtcagcccaacggcccaccctacg

SEQ ID NO: 8432 - DNA, 508 bp, Homo sapiens
  misc_feature: GYAE6OF02GY9N0.37.36.D03.1.454.CMB.1.raw
  modified_base (491)..(491): a, c, t, g, unknown or other
  misc_feature (491)..(491): n is a, c, g, or t
tcagtagtgtagatcacgaccggtgctcgatttagctgcgtcacgatctctcttgggggggtcacaagaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacgcctcctgaccatctctgggcctccaacctgaggacgaggctcactattattgcagctcatatacaagcagcgtcacgttgggtgttcggcggagggacccgacgtgacccgttnttacggtccagtacccg

SEQ ID NO: 8433 - DNA, 710 bp, Homo sapiens
  misc_feature: GYAE6OF02IV099.37.36.D03.1.454.CMB.1.raw
  modified_base (256)..(256): a, c, t, g, unknown or other
  misc_feature (256)..(256): n is a, c, g, or t
  modified_base (591)..(591): a, c, t, g, unknown or other
  misc_feature (591)..(591): n is a, c, g, or t
tcagtagtgtagatcacgaccggtgctcgatttagctgcgtcacgagtctactcttagggggggtacacaagaggcagcgctactcgggaacgtctccacatggccctggggctcgtcgctgtctcctcactctccttcacctcaggacacaaggtcctggcctagtctcgcctgactcaggcctaggcctcgtgtcgtcggtcctcctggacctcgtcgagtccaactcgttccttccctgccacctcggaaccncgacgagtcgacttacttcgggaaacttactaaaccgttcggtccttcggttcgtacctaacctacggtaccaacccgaacggtacctaaaccgtaccccccgtaaaacttcctaacttcgtacgttttggtacgggacgggtaacgtaacggtaaacggccgggacccttacggtaagggggtttctaaacgtcgtacttcgtctgggtctaccgtaagtcgtaggcaaacgaccgggtccctacctacgactaaatccgtcgtcgggcctccaaggtcctaggacggacgaggtcctagtactttaagttactcgtcttcgcttctaaacttntacggtaccgaaggggttactaacctactttaccgttatcggtttaccttacgggtacgttaccgggaactaacggtccgtacccgttactaacgctaccgtacccgacggtaaccccc

SEQ ID NO: 8434 - DNA, 330 bp, Homo sapiens
  misc_feature: GYAE6OF02F0IZL.37.36.D03.1.454.CMB.1.raw
  modified_base (323)..(330): a, c, t, g, unknown or other
  misc_feature (323)..(330): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgccctggaaccagcagtgacgttggtcagcccaaggctgccccctcggtcactctgttccccgcctcctcatctacactactgagcgggctggcaagggcgcatagnnnnnnnn

SEQ ID NO: 8435 - DNA, 476 bp, Homo sapiens
  misc_feature: GYAE6OF02HZMXT.37.36.D03.1.454.CMB.1.raw
  modified_base (321)..(321): a, c, t, g, unknown or other
  misc_feature (321)..(321): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaactcatgattgtgagacagtaagcgcctnagggttctaatcgcttctctgctcaagtctggcacacgcctcctgacaatctctggctcgaggctgagacgagctgattatactgctgctcatntgcaggtancactcttatgtctcggactggacctagtcacgtctaagtcacgcccagaccc

SEQ ID NO: 8436 - DNA, 533 bp, Homo sapiens
  misc_feature: GYAE6OF02FFW90.37.36.D03.1.454.CMB.1.raw
  modified_base (228)..(228): a, c, t, g, unknown or other
  misc_feature (228)..(228): n is a, c, g, or t
  modified_base (328)..(328): a, c, t, g, unknown or other
  misc_feature (328)..(328): n is a, c, g, or t
tcagtagtgtagatcacgaccggtgctcgatttagctgcgtcacgatctctcttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgcactggaaccngcagtgacgttggtgttataaatatgtctcttggtaccaacatcaccaacatcaccagcaaagtccccaaatcataattatgaggtcactaaacggcctnaggtagtttcaatcgcttctctgctccaagtctggcaacgaccggcctccctgaccctatcctcgtcgggcctaccaacctggacggaccgaggcctcgtactattacgttgcagctacattaatacaagcagccgtcacgttggggtgttccgggcgggagggacccgaccgtggaccgttcgttaggtctacggccctaacgg

SEQ ID NO: 8437 - DNA, 505 bp, Homo sapiens
  misc_feature: GYAE6OF02HXKHN.37.36.D03.1.454.CMB.1.raw
  modified_base (227)..(227): a, c, t, g, unknown or other
  misc_feature (227)..(227): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgatattgaaacttataaccttgtctcttggtaccaacagcacccaggcaaagcccccaaactcatgatttgtgaggacagtaagcgccctgaggggtttcaatcgcttctctggctccaagtctggcaacacggcctcctgacaatctctggctccaggctgagacgaggctgattatactgntgctnatatgcaggtactctacttcttatgtccgttacggactagggaacctaggtccacgtcctaaagtccacgtcccgaaggtacccc

SEQ ID NO: 8438 - DNA, 532 bp, Homo sapiens
  misc_feature: GYAE6OF02IRG45.37.36.D03.1.454.CMB.1.raw
  modified_base (322)..(322): a, c, t, g, unknown or other
  misc_feature (322)..(322): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgcccccaaactcatcattttgagtcactaatcgcctnagatttctctcgcttctctgtcctcctaagtctggaccaaccaccggtccctccttacgacctatcctcgtcgggctccagactgaggacgaggctgattattactgctagttcatatagagcgaccactacttatgtcttacggaggtacggaccgtaggtcgtacgtaccgtaacgtacacgtacccgaacggtcccaacccctaccg

SEQ ID NO: 8439 - DNA, 519 bp, Homo sapiens
  misc_feature: GYAE6OF02FXD23.37.36.D03.1.454.CMB.1.raw
  modified_base (232)..(232): a, c, t, g, unknown or other
  misc_feature (232)..(232): n is a, c, g, or t
tcagtagtgtagatcacgaccggtgctcgatttagctgcgtcacgagtctctcttcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccgnagtgacgttggtggttataactatgtctcttggtaccaacatcaccccaggcaaagtccccaaactcatgatttatgaggtcactaaacggcctcaggggtctctaatcgcttctctggctccaagtctggcaacacggcctccctgaccatctctgggctccaggctgacgacgaggctcactattattgcagctcatatacaagcagcaatcacttgggtgttcggcggacggaccggaccgtcgaccgttcgttacggtaccgacgtacccgaaggctccccgg

SEQ ID NO: 8440 - DNA, 528 bp, Homo sapiens
  misc_feature: GYAE6OF02IPDDC.37.36.D03.1.454.CMB.1.raw
  modified_base (306)..(306): a, c, t, g, unknown or other
  misc_feature (306)..(306): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgcccccaaactcatgatttgngagacagtaagcggcctcgaggggtttctaatcgtcttctctggctcaagtctggcaacgacgcctcctgacaatctcgtcgggctcgaggctggaggacgaggctagattatactgctgctcatatcgcgtaggtatcacttcttatgttccgtacggtaacgtcgggaacctaagggttccaccggttacctaacgtccgacgtacccgaacggtacccc

SEQ ID NO: 8441 - DNA, 480 bp, Homo sapiens
  misc_feature: GYAE6OF02GSUAU.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcagaaaccagggaaagccccaagctcctggtctacgctgcatccaatttggaaacaggagtcccatcaaggtttcagtggaagtggatcgtgggactagtattttactttcacctttcagcagcctgcagtctgaagacattgacaacatcttattgtcaacaccatcgacgcctaggaccaagtgatatcaaacgactgtagctgcaccatctgtctac

SEQ ID NO: 8442 - DNA, 510 bp, Homo sapiens
  misc_feature: GYAE6OF02H48IZ.37.36.D03.1.454.CMB.1.raw
  modified_base (366)..(366): a, c, t, g, unknown or other
  misc_feature (366)..(366): n is a, c, g, or t
  modified_base (419)..(419): a, c, t, g, unknown or other
  misc_feature (419)..(419): n is a, c, g, or t
tcagtagtgtagatcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgcccccaaactcatgatttgtgaggacagtaagcggccctcgagggtttcaatcgctttctctggctcaagtctggcaacncggcctcctgacatctcgtggctccgaggtctgaggcgaggctgattattacngctgctcatagtgcgaggtcgtcacttcttatcggttcgttacggaactgggaccaaggtcctaccggtccgtaagtccacgcccaaccgg

SEQ ID NO: 8443 - DNA, 543 bp, Homo sapiens
  misc_feature: GYAE6OF02F5TXQ.37.36.D03.1.454.CMB.1.raw
  modified_base (278)..(278): a, c, t, g, unknown or other
  misc_feature (278)..(278): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaacttatttaaatggtatcagcaagaaaccagggaaacncccccaagcctcctggtctacgctgcatcctaattggaaacaggacgtccatcaaggttcaggtggaagtgatcgtgggacagtattttacttctaccttcagcacgcctgactagtctagaagactagttcgacaactattacttattagtacaaccactatacggacccggtccgtaagggaacccaaaggttcggaattaacgtaaccgaaacgtacgtcgtaggaccttacgaccaaccgtattaccgttagtaccttacc

SEQ ID NO: 8444 - DNA, 536 bp, Homo sapiens
  misc_feature: GYAE6OF02GITMO.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccactcccccctgtctgcatctgtaggagacagagtcaccatcacttgccaggcgagtcaggacattggcaactatttaaattggtatcagcagaaaccagggaaacgcccccaagctcctggtctacgctgcatccaattggaacaggatccatcaaggttcagtggaagtggatcgtgggactagtattttacttcaccttcactcagtcctgctagtctagaagactattgacaactattctttattacgtactaacaccagtacgaccggtccctagggaaccaaaggtggaattaacgtaactaaaaccggtaacgttaggtacggcgtacgacctaccgtactacgttacgttcttaccg

SEQ ID NO: 8445 - DNA, 506 bp, Homo sapiens
  misc_feature: GYAE6OF02F2DY7.37.36.D03.1.454.CMB.1.raw
  modified_base (229)..(229): a, c, t, g, unknown or other
  misc_feature (229)..(229): n is a, c, g, or t
  modified_base (308)..(308): a, c, t, g, unknown or other
  misc_feature (308)..(308): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcgactggaaccngcagtgatattgaaacttataaccttgtctcttggtaccaacagcacccaggccaaacgcccccaaaatcatgatttgngaggacagtaagcggccctgagggtttcaatcgcttctctggctcaatctgcacacgcctcctgacatctctggctcgaggctgaggacgagctgattatactgctgctcatatgcgtagtagtcacttcttagtcgttcttacggaacgtcgggaacctaggtcctaccgtaccgtaagtcacgacccacgtacccc

SEQ ID NO: 8446 - DNA, 539 bp, Homo sapiens
  misc_feature: GYAE6OF02IF97Q.37.36.D03.1.454.CMB.1.raw
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaatcatgatttgtgagacagtaagcggccctgaggggtttcaagtcgcttctctggctccaagtctggcaacacggcctcctgactaatctcgtgggctccgaggctggaggacgaggtctgatttattacgtgtctgcttcattagtgcgtaggtacgtctacttcttagtcgttacgttacggaacgtcggggaacctaagggtcctaccggttacctaagtccgacgtacccgaaggtacccccg

SEQ ID NO: 8447 - DNA, 519 bp, Homo sapiens
  misc_feature: GYAE6OF02IR8AW.37.36.D03.1.454.CMB.1.raw
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (437)..(437): a, c, t, g, unknown or other
  misc_feature (437)..(437): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaaacttataaccttgtctcttggtaccaacagcacccaggacaaactcccccaaaactccatgatttgtgaggacagtaagcggccctcaggggtttctaaatcgcttctctggctcagtctgcaacacgcctccngacaatctctgggctccnggctgacgacgagctcactattatgcagctacatatacaancagcatccagtttgggtcgttcgggacggacgggacccgtaccgtgtaccggtcttacgggtcacggtacccgaaggtcccg

SEQ ID NO: 8448 - DNA, 702 bp, Homo sapiens
  misc_feature: GYAE6OF02HUS23.37.36.D03.1.454.CMB.1.raw
  modified_base (226)..(226): a, c, t, g, unknown or other
  misc_feature (226)..(226): n is a, c, g, or t
  modified_base (307)..(307): a, c, t, g, unknown or other
  misc_feature (307)..(307): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctctgcactggaaccngcagtgatattagaaacttataaccttgtctcttggtaccaacagcacccaggacaaacgcccccaaactcatgtatttgngaggacagtaacgcgcctcgtagggttctaatcgcttctctggctcaagtctggcaacgcggccctcctgactaatctcgtggctccgaggctaggacggacgaggtcctaggttaattacttacgtcgtacgttcgtaccttactaagttacgttacggacgttaacgggttaacgttacccgtaaccgttttaccgtttaacgttttccggtttacccggttttaacccggggtaaaccgggtttacccggggggtaaaacccccggttaaaacccgggggtttaccccgttaaaccccccgggtttaacccggtttaaaacccggggtttaccccggtaaaaccccggggtaccccccccggtaaaaccgggggttaaaccccccccccccg

SEQ ID NO: 8449 - DNA, 480 bp, Homo sapiens
  misc_feature: GYAE6OF02FML3O.37.36.D03.1.454.CMB.1.raw
  modified_base (314)..(314): a, c, t, g, unknown or other
  misc_feature (314)..(314): n is a, c, g, or t
  modified_base (464)..(464): a, c, t, g, unknown or other
  misc_feature (464)..(464): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcagaaccagggaagccccaagctcctggtctacgctgcatccaatttggaaacnggatcccatcaaggttcagtggaagtggatctgggacagtattttactttcacctttcagcagcctgcagtctgaagacattgcaacattcttaattgtacaactaccatcgacgccctagggaccaagtgatatacaaacgactgtagntcgcaccatctgtctc

SEQ ID NO: 8450 - DNA, 502 bp, Homo sapiens
  misc_feature: GYAE6OF02IKVB7.37.36.D03.1.454.CMB.1.raw
  modified_base (300)..(300): a, c, t, g, unknown or other
  misc_feature (300)..(300): n is a, c, g, or t
  modified_base (415)..(415): a, c, t, g, unknown or other
  misc_feature (415)..(415): n is a, c, g, or t
tcagtagtgtagatcacgaccggtgctcgatttagctgcgtcacgatctctcttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataacttgtctctgtacaacagcaccagcaaacgcccccaaaactcatgatttgngaggacagtaagcggcctcgagggtttctaatcgcttctctggctaccaagtctggcaacgacggcctccagacaatctctgggctccaggctgaggacgaggctagattatacngctgctcaatatgcaaggtatcacttctatgtcgttacggaactcgggaacaacggtcaccgttacaacgtcacgtcccgaagaccc

SEQ ID NO: 8451 - DNA, 624 bp, Homo sapiens
  misc_feature: GYAE6OF02F574T.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggacaacttatttaaatggtatcagcagaaaccagggaaacgccccaagcctcctggtctacgctgcatcctaattggaaacaggatcccatacaaggtcagtaggaagtggatcgtagggactagtattttacttacaccttcagcagcctagcctagtctaggaacactagttcgactaaactacttactttaattacgtacctaaaacctacccgtaacttacgggaacccgggtccccgttaacgggggtaaaccctaaagggttacggggtaaacctttaacgtaacccggtaaaaacccggtaaacgttccgggttaacgggtaccgtttacggaccctaaacccgttaacgtttacccgttacggtttaccctttaacccg

SEQ ID NO: 8452 - DNA, 521 bp, Homo sapiens
  misc_feature: GYAE6OF02H9B1N.37.36.D03.1.454.CMB.1.raw
  modified_base (228)..(228): a, c, t, g, unknown or other
  misc_feature (228)..(228): n is a, c, g, or t
  modified_base (366)..(366): a, c, t, g, unknown or other
  misc_feature (366)..(366): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccagacaaacgcccccaaaactcatgatttgtgaggacagtaagcggcctcaggggtttcaatcgtcttctctgctccaagtctggcaacncggccctcctgacatctctgggctcaggctgaggacgagctgattatactgctgctcatatgacgtaggtacgtcacgttactttatcgtcgtttcggaacctcgggaacctaaggtcctaccgtacctaagtccacggaccccgaaggaccccc

SEQ ID NO: 8453 - DNA, 583 bp, Homo sapiens
  misc_feature: GYAE6OF02HEAYP.37.36.D03.1.454.CMB.1.raw
  modified_base (239)..(239): a, c, t, g, unknown or other
  misc_feature (239)..(239): n is a, c, g, or t
tcagtagtgtagatcacgaccggtgctcgatttagctgcgtcacgagtctctcgttgggggggtcacaagtaggcagcgcttctcggggacgtctccaccatggccttgggctctgctgcgtcctcactctcctcacttcaggacacagggtaccgtaggggcccagtctgcctgacgtcagcctgcctccgtgtctggtctcctggacagtcgatcaccatctcctgcactggaaccngcagtgatattgaaacttataaccttgtctcttggtaccaacagcacccaggacaaacgcccccaaaactcatgatttgtgagacagtaagcggcctgtaggggtttctaatcgtcttctctggcctaccgtaagtctcggacaacgaccggccctcctagactaactcttcgtgggcctcgacggtctggacggacgaggtcttaggactttatacgtgctcgctacattacgtgcgttaaggtcgtcctacgttcttatgtttaccgttaacggtacgtacgggaacctaacggttccgaaccgttaccgtaacgttccgacgacccgaaccggtaaccccc

SEQ ID NO: 8454 - DNA, 516 bp, Homo sapiens
  misc_feature: GYAE6OF02G4YBK.37.36.D03.1.454.CMB.1.raw
  modified_base (306)..(306): a, c, t, g, unknown or other
  misc_feature (306)..(306): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataacccttgtctcttggtaccaacagcacccaggcaaagcccccaaactcatgatttgngaggacagtaagcggccctcgaggggtttctaatcgcttctctggctccaagtctggcacacggcctccngacaatcnctgggctcaggctgagacgagctgattattacngctgctnattangacaggtactcacttcttatcgttcgttcggaacttcgggacctaaggtccaccggttcctaagtccacgtacccgaaggtaccccc

SEQ ID NO: 8455 - DNA, 532 bp, Homo sapiens
  misc_feature: GYAE6OF02GS2WV.37.36.D03.1.454.CMB.1.raw
  modified_base (230)..(230): a, c, t, g, unknown or other
  misc_feature (230)..(230): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccactcccctgcactggaaccngcagtgatattgaaacttataacttgtctcttggtaccaacagccacccaggacaaacgcccccaaaactcatgatttgtgaggacagtaagcggcctgagggtttcaatcgcttctctgctcaagtcngcacncgcctccngacatctcgtcggctcgngctgaggacgaggctgtatttatactgctgctacatatgacgtaggttacgtctacttcttagtcgttcgtacgggaacgtcgggaacctaaggtcctacccgttacgtaacgtccacggacccgaacggcccctaaccccg

SEQ ID NO: 8456 - DNA, 531 bp, Homo sapiens
  misc_feature: GYAE6OF02G6720.37.36.D03.1.454.CMB.1.raw
  modified_base (305)..(305): a, c, t, g, unknown or other
  misc_feature (305)..(305): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgatattgaaacttataaccttgtctcttggtaccaacagcaccaggacaaacgcccccaaatcatgtatttgngaggacagtaacggcggccctcgaggggtttctaagtcgcttctcgtggctcaagtctggacacacggcctcctgacatctcgtgggcctcgagtctggagacggaggctagtattacttacngctgctnatgtgctaggtctactacttcttatcgttacgttcggaacgtcgggaaccaaggttccaccgttaccgtaacgtaccacggacccaacggtacccc

SEQ ID NO: 8457 - DNA, 644 bp, Homo sapiens
  misc_feature: GYAE6OF02JC47F.37.36.D03.1.454.CMB.1.raw
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggacagtcgatcaccatctcctgcactggaaccagcagtgatattagaaacttataaccttgtctcttaggtaccaacagcacccaggacaaacgccccaaactcatacgtatttgtagaaggacaagtaacgccggacctcgtacggggtttctaagtcgtcttctcgtgactaccaagttcacgacaaccgaccgggtaccctcccgtagaacctaacttccgtcgtcgggcctaccggacggtctacggacggtaccggaacggtcgtagtattacttacgtcgtcgtgaccttacagttaagtcgacgtaagggtacgttacctacgtttaccttagttcggttaccggttaccgggtaaccgttcggggtaacccgtaacggttcccgtaacccggttaccgttaacggtacccgaaccggtaccccgtaacggtaaccccccg

SEQ ID NO: 8458 - DNA, 496 bp, Homo sapiens
  misc_feature: GYAE6OF02IG9BM.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcagaaaccagggaaacgcccccaagcctcctggtcctacgctgcatccaatttggaaacaggacgtcccatcaaggttcaggtggaagtggatctgggacagtattttacttcaccttcagcagcctgctagtctgaagtacattgcaacattcttattcgtacaacacctatcgacggccctagggaaccaagtgaatagtacgaaacgactgtaggctgccaccatctgtctac

SEQ ID NO: 8459 - DNA, 496 bp, Homo sapiens
  misc_feature: GYAE6OF02F8KP2.37.36.D03.1.454.CMB.1.raw
  modified_base (317)..(317): a, c, t, g, unknown or other
  misc_feature (317)..(317): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcagaaaccagggaaacgcccccaagctcctggtctacgctgcatccaattggaaacnggatccatcaaggttcagtggaagtggatcgtgggacagtattttacttcaccttcagcagcctgcagtctaggaagacagttgacaaactattactttattcgtacaaacacctatcgaccgccctagggaaccaaggtgatatacaaacgtactgtgactgccaccatctgtcttac

SEQ ID NO: 8460 - DNA, 539 bp, Homo sapiens
  misc_feature: GYAE6OF02HO8SA.37.36.D03.1.454.CMB.1.raw
  modified_base (306)..(306): a, c, t, g, unknown or other
  misc_feature (306)..(306): n is a, c, g, or t
  modified_base (420)..(420): a, c, t, g, unknown or other
  misc_feature (420)..(420): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtactcttggtaccaacagcacccaggcaaagcccccaaactcatgatttgngaggacagtaagcggcctcgaggggtttcaatcgcttctctggctccaagtctggcaacacggcctcctgacaatctctgggctacgaggctgaggacgaggctgtattatacngctgactcatatcgctaggtctcacttcgttatcgttacgttacggaacgttcgggaacctaacgggtcctaacccggttacctaaggttcccgaacggtaccccgaaaggtacccccg

SEQ ID NO: 8461 - DNA, 715 bp, Homo sapiens
  misc_feature: GYAE6OF02HEVXM.37.36.D03.1.454.CMB.1.raw
  modified_base (237)..(237): a, c, t, g, unknown or other
  misc_feature (237)..(237): n is a, c, g, or t
  modified_base (321)..(321): a, c, t, g, unknown or other
  misc_feature (321)..(321): n is a, c, g, or t
  modified_base (570)..(570): a, c, t, g, unknown or other
  misc_feature (570)..(570): n is a, c, g, or t
tcagtagtgtagatcacgaccggtgctcgatttagctgcgtcacgtagttcgggtctcgttgggggggggtcccacaacgtagggctacgacgcttctcgggtacgtctccaaccatgggcctggggactctgcgtgcctaccctcacgtcttccgtcactcaggacacttacgggtcctgggcccagtcttagccctgactcagcgtgcctcgtgtcgtgggtccggtcctggacngtcggactcacctatcctcctgaccactggaacctgccagtgaatattggaaacttagtaaccttgtcttcgtcggtaccaacncgacgacccgaggacgaaacggtacccccgtaaagtccaagttaacgtaagttttggtagggtagggaaccaggtaacgaccggtcccgttcggtacggggtttacctaagtccgtcgttacctcgtcggtcctaccaagttcctaggaaccaacgaccgggtacccttacccgtagaacctaaacgtccttacgtgggttcctccgagggctaggaacgggtacgaggtcctagtacttagttaccgngtactgacctctagttaacttcgacgttacggtagttaccgacgttacgtttatcggttaccgttacggtaacgttcgggaaacccttagggtacccgtacccggtacggtaaccgtccgaccggtaccccgaaccggtaccccc

SEQ ID NO: 8462 - DNA, 497 bp, Homo sapiens
  misc_feature: GYAE6OF02FOK3L.37.36.D03.1.454.CMB.1.raw
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaanagcacccaggcaaagcccccaaatcatgatttgngaggacagtaagcggccctcgaggggtttctaatcgcttctctggctcaagtctggcaacacggcctcctgacatctctgggctcaggctgaggacgagctgattatactgctgctcatatgcaggtactcacttcttatgtcttacggaactcgggaccaggtcaccgtctaagtcacgcccaaggtacccc

SEQ ID NO: 8463 - DNA, 522 bp, Homo sapiens
  misc_feature: GYAE6OF02IWUPN.37.36.D03.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
  modified_base (415)..(415): a, c, t, g, unknown or other
  misc_feature (415)..(415): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggacaaacgccccaaactcatgatttgngaggacagtaagcggccctcgaggggtttactaagtcgcttctctgctcagtctgcacncgcctcctgacatctcgtggctcagctgaggacgagctgtattattacngctgcttacatagtgacgtaggtatctacttactttacgtcgttcgttacggaacgtcgggaacctaaggtcctaccggttctaacgtcacgacccgaacgtacccc

SEQ ID NO: 8464 - DNA, 692 bp, Homo sapiens
  misc_feature: GYAE6OF02GOJ1S.37.36.D03.1.454.CMB.1.raw
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgcacgtggaaccagcagtgatattagaaacttataaccttgtctcgttacgtaccaacacgaccaaccgacggacaaaccgacccccaaatctagtgtagtttggaggacggacgtaaggtaacggccggtaccctacggtacggggtttactaacgtccgtacttccgtcgtcggtacctaccgaacgtcgtacggacctaaccgacccgtcctaccgtacgaactacgttcgtcggtcggtacctaccggaggtcgtacgggaacggtacggtacggtacttaggttaactttacgttacgtcgtacctagtacctacgtagtacggtcgtacgttaacggttaccttacgttaccgtttacgttacgttacggttaccggttaaacggtaccggtaaccggtaacccgttaaccgtacccgtaacccggtaacgtaccgaccgtaacccggaacccgtacccgtaacccccg

SEQ ID NO: 8465 - DNA, 778 bp, Homo sapiens
  misc_feature: GYAE6OF02FZ8DG.37.36.D03.1.454.CMB.1.raw
tcagtagtgtagatcacgaccggtgctcgatttagctgcgtcacgatctctcggttggggggggtcacgaagacgggcagcgctctcgggacgtctccaccatggcctgggcttctgctgcgtcctcactctccgtcactcacggacacgaggggtcctgggcccagtctgccctgactcagcctgcctccgtgtctggtctcctggacagtcgactcaccgatcctcctgccacgtggaacccagtccaaggtcgattattagaaacttataaccttgtacttcgttaggtaccaacagccaacccaggaccaaaccgtccccgaaaactcaatcgtattttgtaggaggacaagttaacggcggtacccgtacggtaacggggtttactaactccgtactttacggtcgtacgggaccttaccgtaaacggtccgttacggggacctaaacccgaccgggtcccttcccgtacggaacctaaagttccctacggtcgggtcccttacccggagggtcctacggacgggtaaccgaagggccttaggtaactttaacgttaccgtacgtaccgttacggccttacgtaacgtttacggtccgtaccggttaaacgggtttacggttacccttaaccgtttccgtttaacgttccggttaaccggttttaacccggaaacgtttaaccgggggtaaacccttaacgggggttaaccctaaccccgggtttaccttaaaacgggttcccaaccgggtacccccggaacggtaacccccc

SEQ ID NO: 8466 - DNA, 526 bp, Homo sapiens
  misc_feature: GYAE6OF02IT7AN.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccactcccccctgtctgcatctgtaggagacagagtcaccatcacttgccaggcgagtcaggacattggcaactatttaaatggtatcagcagaaaccagggaaacgccccaagctcctggtctacgctgcatccaattggaaacaggactcccatcgaaggtttcaggtggaagtggatcgtgggactagtattttactttctaccttcagcagcctgcagtctagaagactattgactaacattctttaattcgtacaacctacattacgaccggtaccctgggaaccaaaggtggaatacgtaacaaacgtactagtacggactcggacctaaccgtatcttcgttcttaccg

SEQ ID NO: 8467 - DNA, 543 bp, Homo sapiens
  misc_feature: GYAE6OF02IPWLR.37.36.D03.1.454.CMB.1.raw
  modified_base (318)..(318): a, c, t, g, unknown or other
  misc_feature (318)..(318): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcagaaaccagggaaacgcccccaagctcctggtctacgctgcatccaatttggaaacnggagtcccatcaaggttcagtggaagtggatcgtgggacagtattttactttcacctttcagcagcctagctagtctagaacgacattcgactaaacattaccttattacgtaccaactaccaacttcgaccggtaccctagggaacccaaaggtacggaataacgtacaaaaccggtaactacgtacggactacggactaccgtacttcgttacgtcgtttacc

SEQ ID NO: 8468 - DNA, 540 bp, Homo sapiens
  misc_feature: GYAE6OF02GTRFB.37.36.D03.1.454.CMB.1.raw
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcaatggaaccagcagtgatattgaaacttataaccttgtctcttggtaccaacagcacccagcaaagcccccaaatcatgatttgtgaggacagtaagcggccctgaggggtttctaatcgtcttctctggctccaagtctggcaacacggcctccctgacaatctctgggcctccaggcctggacggacgaggctgatttattactgcttgctcgatagtgctagggtatcacttcttatcgttcttaccgggaacttcggggaaccctaacgggttaccacccggttacctaaagttccgaaccgtcccgtaacggaccccc

SEQ ID NO: 8469 - DNA, 846 bp, Homo sapiens
  misc_feature: GYAE6OF02HN20P.37.36.D03.1.454.CMB.1.raw
  modified_base (229)..(229): a, c, t, g, unknown or other
  misc_feature (229)..(229): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgacgttggtggttataaatatgtctcttggtaccaacatcaaccaacatcacccaggaccaaacgtccccaaactcaattaatttatgacggtacaaccgtaaaaccggccctacgaggtacgttttactaaacgttccgtacctttccttcgtcgggtacccttacccgaaacggttccgtacgggaccctaaaccgaacccgggtccccctttaccccgtacggaacccctaacgttcccgttaccggttccgggggtacccttaaccccgtaaaccccggttgggaaaccgggggtaacccgggtaaccggggttaccccttaacccgttaaaccgttttaaccgttttaacggttttccgggaacccgttaaccgggtccctttaaccgtaaactttaaacgttaaacccgaaaacggaccgttaaacgggtacccggttacccgttaaccgggttttttccggggggtacggggttttacccggggggaccggggggtaaacccggggggtaacccccgttaacccccgggtttacgggttaaccccccgggtttaccgttttaaaccgggggtcccctaaccggggtaccccccgtaaaccggggg

SEQ ID NO: 8470 - DNA, 496 bp, Homo sapiens
  misc_feature: GYAE6OF02HN65U.37.36.D03.1.454.CMB.1.raw
  modified_base (228)..(228): a, c, t, g, unknown or other
  misc_feature (228)..(228): n is a, c, g, or t
  modified_base (376)..(376): a, c, t, g, unknown or other
  misc_feature (376)..(376): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggcaaacgcccccaaactcatgatttgtgaggacagtaagccggccctcgaggggtttcaatcgtcttctctggctccaagtctggcacacgcctccngacatctctgggctccgaggctgaggacgaggctgtattatactgtctgctcatatgcaggtanctactntatgtcgtcggactggaccaggtccaccgtctaagtcacgccaggacccc

SEQ ID NO: 8471 - DNA, 629 bp, Homo sapiens
  misc_feature: GYAE6OF02IIOQR.37.36.D03.1.454.CMB.1.raw
  modified_base (353)..(353): a, c, t, g, unknown or other
  misc_feature (353)..(353): n is a, c, g, or t
  modified_base (445)..(445): a, c, t, g, unknown or other
  misc_feature (445)..(445): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacagtcgatcaccatcctcctgacactggaaccagcagtgatattgaaacttataaccttgtctcttaggtaccaacagcacccaggacaaacgcccccaaaatcatgtatttgagaggacaggtaagccggcctcgtagggtttctaatcgtcttcncgttggctacgagtctaggccaacgaccgcctccctagacaacttcactcgggctccaggtctgacggacgcggtctagtatttacttacgngtcgttagccttactagttagtcggtacgtacgggttaactcctaaccgtttactttacggttacgtttaccggtttaaccggaaacgggtttaccggggaaacccgttaaaccgggttaccgaccccggtttaaccgttaaagggttcccgaaaccggttacccccgaaacgggtaacccccc

SEQ ID NO: 8472 - DNA, 504 bp, Homo sapiens
  misc_feature: GYAE6OF02JB8FB.37.36.D03.1.454.CMB.1.raw
  modified_base (365)..(365): a, c, t, g, unknown or other
  misc_feature (365)..(365): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaacgccccaaactcatgatttgtgaggacagtaagcggccctcgaggggtttctaatcgcttctctgctcaagtctggcaacncggcctcctgacatctcgtggctcgaggctgaggacgagctgattattactgctgctcatatgcaggtacgtcacttcttatgttcgttcggaactcgggaacctaggtccaccgttctagtcacgcccaaggtacccc

SEQ ID NO: 8473 - DNA, 509 bp, Homo sapiens
  misc_feature: GYAE6OF02IX8FA.37.36.D03.1.454.CMB.1.raw
  modified_base (229)..(229): a, c, t, g, unknown or other
  misc_feature (229)..(229): n is a, c, g, or t
  modified_base (372)..(372): a, c, t, g, unknown or other
  misc_feature (372)..(372): n is a, c, g, or t
  modified_base (421)..(421): a, c, t, g, unknown or other
  misc_feature (421)..(421): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggcaaacgcccccaaactcatgatttgtgaggacagtaagcggcctcgaggggtttctaatcgcttctctggctcagtctgcacacgcctccngacatctctggctcgagctgagacgagctgattatactgtctgctcatntgactaggtacgtctacttcttagtcgttcgttacggacgttgggaacctaacggtccaccgttcctaagtcacgacccgaggacccc

SEQ ID NO: 8474 - DNA, 536 bp, Homo sapiens
  misc_feature: GYAE6OF02FQOH1.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggatacagagtcaccatcacttgccaggcgagtcaggacattggcaactattaaattggtatcagcagaaaccagggaaacgcccccaagcctacctggtctacgctgcatccaattggaaacaggatccatcaaggttcagtgaagtgatcgtggactagtattttactttcacctttcagtcagcctgcagtctagaagactattgactaacattactttattacgtaccaaactacccagtcgaccggtaccctagggaacctaaaggtcggaattaacgtaaccaaaacggtacgttggtacggtcgtacgaccaccgtatccgttacgtccttaccg

SEQ ID NO: 8475 - DNA, 499 bp, Homo sapiens
  misc_feature: GYAE6OF02GSOOV.37.36.D03.1.454.CMB.1.raw
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaaccttgtctcttggtaccaacagcacccaggcaaagcccccaaactcatgatttgtgaggacagtaagcggccctcaggggtttctaatcgcttctctggctccaagtctggcaacacggcctccctgacaatctctgggctccaggctgaggacgaggctgattatactgctgctcatatgcaggtagtcactcttatcgtcttcggaactgggaaccaggtcaccgtctaagtcagtcccaggcccc

SEQ ID NO: 8476 - DNA, 556 bp, Homo sapiens
  misc_feature: GYAE6OF02GN5YZ.37.36.D03.1.454.CMB.1.raw
  modified_base (305)..(305): a, c, t, g, unknown or other
  misc_feature (305)..(305): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaatcatgatttgngagacagtaagcggccctcgaggggtttctaatcgcttctctggctcaagtctggcaacgaccggccctccctgaaccaatcctcgtgggcctccgaggctggacggacgaggctgattattactgctgctcattatgcgtaggtacgtctaccttctttagtcgttccgttacgggtaaccgttcggggaacctaacgggtctaacccggttcctaaacggtacctacggtaccccgaaggtaacccccc

SEQ ID NO: 8477 - DNA, 529 bp, Homo sapiens
  misc_feature: GYAE6OF02IQSUE.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggacaaagcccccaaactcatgatttgtgagacagtaagcggccctcaggggtttctaagtcgtcttctctggctccaagtctggcaacacggcctcctgacaatctctgggcctccgaggctggacgggacgaggctgtaattattacctgtctgcttcatatgactaggtatccattcttatgtacgttcggaacgtgggaacctaggtccaaccgttacctaacgtcacgccccgaaggtaaccccc

SEQ ID NO: 8478 - DNA, 547 bp, Homo sapiens
  misc_feature: GYAE6OF02HF8UC.37.36.D03.1.454.CMB.1.raw
  modified_base (229)..(229): a, c, t, g, unknown or other
  misc_feature (229)..(229): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggacaaacgcccccaaactcatgatttgtgaggacagtaacgccggccctcgaggggtttctaatcgtcttctcgtggctccaagtctggcaacgccgcctcctgacatctctggctcgaggctaggaggacgaggtctagtattattactgctgctctatagtgactaggtacgtctacttcttagttgttccgttacggaacgttcgggaaccctagggtacccaccggttacctaagtccgaacgtacccgaacggtaacccccg

SEQ ID NO: 8479 - DNA, 509 bp, Homo sapiens
  misc_feature: GYAE6OF02FTQC8.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaatcatgatttgtgaggacagtaagcggccctgaggggtttctaatcgcttctctggctccaagtctggcaacacggcctcctgacaatctctgggctccaggctgaggacgaggctgattattactgctgctctatagtgcaggtagtcacttcttatcgtcttacggaagtcgggaacctaggtcctaccgtctaagtcacgtaccgaggacccc

SEQ ID NO: 8480 - DNA, 503 bp, Homo sapiens
  misc_feature: GYAE6OF02F9B9C.37.36.D03.1.454.CMB.1.raw
  modified_base (426)..(426): a, c, t, g, unknown or other
  misc_feature (426)..(426): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggcaaagcccccaaactcatgatttgtgaggacagtaagcggccctcaggggtttctaatcgcttctctggctcaagtctggcaacacggcctcctgacaatctctgggctccgaggctgaggacgaggctgattattactgctgctnatatgcaggtatcacttcttatcgtcttcggaacttcgggaacctaggtccaccgtctaagtcacgcccaggacccc

SEQ ID NO: 8481 - DNA, 513 bp, Homo sapiens
  misc_feature: GYAE6OF02I545A.37.36.D03.1.454.CMB.1.raw
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatctcctgcactggaaccagcagtgatattgaaacttataaccttgtctcgttggtaccaacagcacccaggcaaacgcccccaaatcatgatttgtgaggacagtaagcggccctcgaggggttctaatcgtctctctggctcaagtctggacacaccggcctcctgacatctctgggcctcgaggctaggagacgaggctgattatacngctgactcatntgactaggtcnctattcttatcgttcgtacggactcgggaacctacggtctaccgtctaagtcgacgtacccaaggtacccc

SEQ ID NO: 8482 - DNA, 671 bp, Homo sapiens
  misc_feature: GYAE6OF02HC9V5.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcgaggacacgacgggtccgtcgggcccagtctcgccctgactcagcctgcctcgtgtcgtgggtctccgtggacagtcgatcacctactcctcctgcacgtacggaaccagcagtgatattagtaaacttactaacctttgtcttcgttacggtaaccaacacgaccaacccgacggaccaaaccggacccccaaactcatcgtagtttggagaaggacaagtaacggcccggtacctacggtacggggtttactaacgtcgtcttactcgtcggtcctacgtaagtcgtacggaccaaccgaccggtcccttccgtacgaacctaacgttccgtcggtccgggtacctccggacggtcgtagggaacggacggtaggtcctaggttaactttacgttacgtcgtctcgtaccttagtaacgtagtcgacgttaggttactactacttgttacgttcgttacggttaccggtaacggtcgggaaccgttacggtaccgtaccgttacgtacgtaccgacgtacccgaacggtaaccccc

SEQ ID NO: 8483 - DNA, 547 bp, Homo sapiens
  misc_feature: GYAE6OF02F7JWI.37.36.D03.1.454.CMB.1.raw
  modified_base (447)..(447): a, c, t, g, unknown or other
  misc_feature (447)..(447): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtcttcttggtaccaacagccacccaggacaaacgcccccaaactcatgattgtgagacagtaagcggcctcgtaggggtttactaatcgtcttctcgtgctccaagtcgtgacaacgaccggcctcctgacaatctcgtcggcctccgaggctaggacgacggagcgtagtattatactgctgctacatntgactaggtatctacttcttatcgtcgttacggacgtacgggtaaccgtaagttaccgtaccgtacgttaacggtccaccgtacccgaacgtaacccccg

SEQ ID NO: 8484 - DNA, 559 bp, Homo sapiens
  misc_feature: GYAE6OF02GCKZM.37.36.D03.1.454.CMB.1.raw
tcagtagtgtagatcacgaccggtgctcgatttagctgcgtcacgatctctcttggggggggtcacaagaggcagcgctctcgggaccgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagcacccaggacaaacgcccccaaactcatgatttgtgaggacagtaacgcggccctcgtaggggtttctaatcgtcttctctggctccaagtctggacacgacgcctcctgacatcctcgtgggcctccgaggctggaggacggacggctagtattattactgctgctcgtatagtgcgtaggtatcctacttcttagtcgttccgttacggaacgttcgggtaaccgtaacggttccgtacccggttaccttaacggtcctaaccggacccgaacggtaaccccc

SEQ ID NO: 8485 - DNA, 550 bp, Homo sapiens
  misc_feature: GYAE6OF02JB349.37.36.D03.1.454.CMB.1.raw
  modified_base (228)..(228): a, c, t, g, unknown or other
  misc_feature (228)..(228): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggcaaacgccccaaactcatgatttgtgaggacagtaagcggccctcgtaggggttctaatcgcttctctggctcaagtctggcaacgacgcctcctgacaatctctgggctcaggctgaggacgaggctagattattactgctgctcatagtcgacaggttacgtactacttcttagttcgtccgtttcgggaaccttggggaaccctaagggttcccgtaacccggttaccttaacggtccgaaccggtaccccgaacgggtaacccccc

SEQ ID NO: 8486 - DNA, 608 bp, Homo sapiens
  misc_feature: GYAE6OF02IYVIF.37.36.D03.1.454.CMB.1.raw
  modified_base (313)..(313): a, c, t, g, unknown or other
  misc_feature (313)..(313): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagtaaacttataaccttgtctcttcggtaccaacagccacccaggacaaacgcccccaaactcatgtatttgngaggacagtaacgcggcctcgtaggggtttctaatcgtcttctcgtcggctaccaagtctggaccaacgccgccctcccgtgaactaactcctcgtcgggcctacgacggtctaggacgggacggaggcttagtactttacttacgtcgtctcgtctactatagtgacgtaaggttacgtactacttacgtttagttcggtttaccgttacgggtaaccgttcggggaaccctaacggttcccgtaacccgttccgtaaacggtcccgaaccggtaccccgaaccgtaacccccg

SEQ ID NO: 8487 - DNA, 777 bp, Homo sapiens
  misc_feature: GYAE6OF02GUG3E.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttggtaccaacagcacccaggacaaacgcccccaaactcatgatttgtgaggacagtaagccggcctcgtaggggtttactaagtcgtacttctacgtcggaccttaccgaagttcgtacggaccaaaccgacccgggtaccccttacccgtacggtaacctaaacgttccgttaccggtacggggtacccttacccggaacgggtaccgtttacggggaaaccggggtaaccgggtaacgggtaccgtttacgggtaaactttttaaccgtttaaccggtttcggtaaccgtttcggtacccgtttaaccgtaaacgtttaacgttaccgggttaaccggttaaacggggtttaaccgttaccgttaaccgtttacgttttaacgttccgggttttacccgttaccggggtaaaaccgtttccgggggtaaaccccgtaacgggttaccccgtaacccggtttacccgttaaccggtaccgaacccggttacccccgaaaccgggtaaccccccc

SEQ ID NO: 8488 - DNA, 526 bp, Homo sapiens
  misc_feature: GYAE6OF02IJYZL.37.36.D03.1.454.CMB.1.raw
  modified_base (307)..(307): a, c, t, g, unknown or other
  misc_feature (307)..(307): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccagcagtgatattgaaacttataaccttgtctcttggtaccaacagcacccagcaaacgcccccaaactcatgatttgngaggacagtaagcgcctcgagggtttctaatcgcttctctggctcagtctgcaacacggcctccctgacaatctactgggctccgaggctggacggacgaggctgattattactgtctgctcattatcgacaggtgtaccacttcttatgttaccgttcggtaaccgtgggaaccctaaggtacctaccgtactaacgtcgaacgtcccgagaaccccc

SEQ ID NO: 8489 - DNA, 565 bp, Homo sapiens
  misc_feature: GYAE6OF02IQOQ9.37.36.D03.1.454.CMB.1.raw
  modified_base (229)..(229): a, c, t, g, unknown or other
  misc_feature (229)..(229): n is a, c, g, or t
  modified_base (388)..(388): a, c, t, g, unknown or other
  misc_feature (388)..(388): n is a, c, g, or t
  modified_base (428)..(428): a, c, t, g, unknown or other
  misc_feature (428)..(428): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggacaaacgcccccaaaatcatgatttgagagacagtaagcggcctgtaggggtttactaatcgcttctcgtgctcaagtctggacacgacgcctcctgacaatctacncggctcaggctaggacgacgaggtctagatttaacgtacngtctagctactagttatcgtacgaggttactctacttcttagttggttccgttaacgggtaacgtacggggtaacctaacggttcccgtaacccgttaccgtaaaggtcccaacggttaccccgaaggtaacccccc

SEQ ID NO: 8490 - DNA, 500 bp, Homo sapiens
  misc_feature: GYAE6OF02FKBV0.37.36.D03.1.454.CMB.1.raw
  modified_base (228)..(228): a, c, t, g, unknown or other
  misc_feature (228)..(228): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattgaaacttataaccttgtctcttggtaccaacagcacccaggcaaagcccccaaaactcatgatttgtgaggacagtaagcggccctcaggggtttctaatcgcttctctggctccaagtctggcaacacggcctcctgacatctctgggctccaggctgaggacgaggctgattattactgctgctcatatgcaggtagtcactcttatgtcttcggaactgggacctaaggtcaccgtctaagtcacgcccaaggacccc

SEQ ID NO: 8491 - DNA, 675 bp, Homo sapiens
  misc_feature: GYAE6OF02JXFUX.37.36.D03.1.454.CMB.1.raw
  modified_base (136)..(136): a, c, t, g, unknown or other
  misc_feature (136)..(136): n is a, c, g, or t
  modified_base (186)..(186): a, c, t, g, unknown or other
  misc_feature (186)..(186): n is a, c, g, or t
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (258)..(259): a, c, t, g, unknown or other
  misc_feature (258)..(259): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (568)..(568): a, c, t, g, unknown or other
  misc_feature (568)..(568): n is a, c, g, or t
  modified_base (604)..(604): a, c, t, g, unknown or other
  misc_feature (604)..(604): n is a, c, g, or t
tcagtagtgtagatcacgaccggtgctcgatttagctgcgtcacgatctctcttgggggggtcacgagaggcagcgctctcgggacgtctccaccatcggcctgggctctgctgctcctcactctcccctactccncggacgaccaggtccggttcgggcccgaccgtcgtcgccgtaccgcgtcncgcctcgccgtcccgtcgcgtcggtcgtcctacggcgacgttgctnacccatctccnctagactcgacgacnncgagtatattcgtaacgtaacttaacctacgttctcttacgttaccgactacgcaacccacggacaacggacccccaacctntaacgngtagtttcgtgtacggaacgtacgtaacgcggtcccgtaccgtcgggtttacgtaactcgtacgttcttccgtggtactcccgtagtacctggtacccaactccggactcccgtagaccgtaactaccgttcgtcggacgtccgacggtccgtagtaccgggacggtcggtacgtggtactttattaaccgtagtccgggtaatccgtacctagttaacgnggtccgaaggttccggtactcgttacctggtttacncgtttacggcgtaaccggttagaaccgttcgaccgttcctacgtacgtaccgacgacccgtacctacccgg

SEQ ID NO: 8492 - DNA, 742 bp, Homo sapiens
  misc_feature: GYAE6OF02HO4ZA.37.36.D03.1.454.CMB.1.raw
tcagtagtgtagatcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataatatgtctcttggtaccaacatcaaccaacatccacccaggacaaagtccccaaactcataatttatgaggtcaactaaaccggccctacgaggtagtttactaatcggtctttcgttctcgggtcctaccctaaaggttcgttacgggacctaaaccgacccgggtccccttccccgtacggaacccctattccgttcgttcggggacccttaccctaaacccgttggaacgggaccggtaacgggtccttaccgtaacctttaatttaacgtttcggacctaacggtcccttactaacgtttaacttaaaccgaaacggccgtaacggtcccggtttaccgttaaccgggttttcggggggttaccgggttttacccgggggaccggggggtaacccgggggttaacccccggtaaccccggtttacgggtaacccccggtttaccgggttttaaccgggtttacccgaacccggggttaaccccccggg

SEQ ID NO: 8493 - DNA, 596 bp, Homo sapiens
  misc_feature: GYAE6OF02G1DNO.37.36.D03.1.454.CMB.1.raw
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctctgcacgtggaaccngcagtgatattgaaacttataaccttgtctcttggtaccaacngcaccaggcaaacgcccccaaaatcactgatttgtgaggacagtaagccggcctcgagggtttctaatcgtattcctcgtggcttccaagtcgtcggacaacgccggcctaccgtgaacgaatctcgtcgggtcctaccgacggtctaggtacgggacggtaggctagtattacttacgtcgcgttaggccttacagttagtcgacgtaagggtctacctacgttactttagtcgttaccggttaccggaacgttcgggtaaacctaacggtcccgtaaccggttcttaaccggttacgaaccggttacccaacgggtacccccc

SEQ ID NO: 8494 - DNA, 541 bp, Homo sapiens
  misc_feature: GYAE6OF02IMAJF.37.36.D03.1.454.CMB.1.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaacccncagtgacgttggtggttataactatgtctcttggtaccaacatcacccaggcaaagtcccccaaactcatgatttangaggtcactaaacggccctcagggtctctaatcgcttctctggctccaagtctggcaacaccggcctccctgaccatctctgggcctccaacctgaggacgaggctcacttattattgcacgctacataatacaagcaagcgtacacgttgggtcgttcgggccgggagggaacccgtaccgtggacccgttcgttaaggtccacggccccgaaggcctccggcccccttccggg

SEQ ID NO: 8495 - DNA, 630 bp, Homo sapiens
  misc_feature: GYAE6OF02GVL5K.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtcgtgggtcctccgtggacagtcgatccaccatcctctgcactggaaccagcagtgatattagaaacttataaccttgtctcgttgtaaccaacagccacccgaggacaaaccgacccccaaactcatcgtatttgagacgacgaagtaacggccggtccctacggtaggggtttacctaagttccgtacttcttcgtggccttaccgtaacgttctacggaccaaccggacccggtccctacccgtagtaacctaactcgttccgtcgggtccttccgacggtccgtaggacggtacggacggtcgttagtagtttaacttacgtgtccgtacgtcctatattacgtgtacgtaggtactactacgttacttagtcgttccggtaacggacgtacggtaactaccgtccgtaccgtacgtaacgtccacgacccgtacgtaccccg

SEQ ID NO: 8496 - DNA, 601 bp, Homo sapiens
  misc_feature: GYAE6OF02IJF6U.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcatcatcacttgccgggcaagtcagggcattaagaaatgatttaggctggtatcagcaagaaaccgagggaaacgcccctaagcctcctcatctatggtgcatcctagtttacaaacgttcggggtacccaatttaagattcgaacgcggactaggtaggatcgtggacacgaaggtacttttccacttcctactaaccatcacgccagccctgcgacgtcctagtaagttattttagaccttaactttatttacgtagttacctaacaaagttacttaaccgtaacttacccgttaaccggttaccgtttaccgggaacccgtaaacggggtaacccgtaaaggggttacggtaaacggttaaccgaaaaccggtaacgttagggtcggtaaccg

SEQ ID NO: 8497 - DNA, 518 bp, Homo sapiens
  misc_feature: GYAE6OF02F0D9C.37.36.D03.1.454.CMB.1.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattagaaacttataaccttgtctcttggtaccaacagcacccaggacaaacgcccccaaactcatgatttgngagacagtaagcggcctgagggtttctaatcgcttctctggctcaagtctggcaacgacgcctcctgacatctcgtgggctccgaggctggaggacgaggctgtattattcgtgctgctacatagtgtacgagtacgtctacttcttatcgttcgttcggaacgtcggacctaaggtccaccgttcgtaacgcacgacccaaggacccc

SEQ ID NO: 8498 - DNA, 876 bp, Homo sapiens
  misc_feature: GYAE6OF02IU5QD.37.36.D03.1.454.CMB.1.raw
  modified_base (237)..(237): a, c, t, g, unknown or other
  misc_feature (237)..(237): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcacggacacagggtcctgggcccagtctgccctgactcagcctgcctcgtgtctgggtactcgtggactacgtcgactcacctattctcctgctacgtcggaaccngctaggtcatacttacgaaacttacgtaaccttgtaccttcgttacggtaaccaacgtcgacctacccgaggtaccaaaccggtccccctaaaacgtccgtaacgttccgtaacgttttcggacgtaacgggtaacgtaacggtttaaccggaccggggtacccttaaccggttaacggggggttttaccctaaaacgggttcccggtttaccgtttacccgttacggttaccggtacccgtttaaacccggtaaacggtttcccggttaacgggtaacccgtaaacccggttacccgggtccccgtttaaccccgtaaggtaaaccccgttaaacgtttcccgttacccggttacggggtaaccctttacccggaacgggttacccggttacgggtaaccggggtaaccggttaccgggttacccgttaaggttaaccgtttaaacgtttaccgtaacgtccggtttacggtacctttaacggtactttaacgggtccgttaacggtaccggttaacgtaccgttaccgtttacgttacgtaccggttacgttaccgggtaacgttacgggaaccgttaaccggtccttaaccggtacttaaccggtaccgtaaccgtaccggtaacccgtaaccccg

SEQ ID NO: 8499 - DNA, 558 bp, Homo sapiens
  misc_feature: GYAE6OF02GIBND.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcagaaaccagggaaacgccccaagctcctggtctacgctgcatccaatttcggaaacaggatcccatcaaggttcagtggaagtggatcgtggacagtattttacttctaccttcagcagcctgcagtctagaagactattcgcaaactattacttattacgtaccaaacacctaatcggtaccggacccgttacgggaacccgtaaaggttcggaacttaacgtaaccgaaaacggtaaccgttagggtacggtaccgttacggacctaaaccctagtccgttacggttacttaccg

SEQ ID NO: 8500 - DNA, 666 bp, Homo sapiens
  misc_feature: GYAE6OF02H1TZD.37.36.D03.1.454.CMB.1.raw
  modified_base (229)..(229): a, c, t, g, unknown or other
  misc_feature (229)..(229): n is a, c, g, or t
tcagtagtgtagatcacgaccggtgctcgatttagctgcgtcacgatctctcttggggggggtcacaagaggcagcgctctcaggacatctccaccatggcctgggctctgctgctcctcaccctcctcactcagggcacgagggtcctgggcccagtctgccctgactcagcctgcctccgtgtctgggtctctggacagtcgatcaccatctctgcactggaacccnagtgacgttggtaggttataactatgtctcttggtacaacatcacccaggacaaacgtaccccaaactcatgtatttagtgagtacaacgtaacggccctacgagggtctactaactcgtacttctcttggcctacctaagtcctggaccaaccgaccggtccctcccgtagtacccgattccgtacgtcggggtcctaccgaggtccgtcggaaccggacggtacggtaccttccgtaacttagtttacgtcgactacgtacctacctaattaacgtaaccgtaacgtaccgaacgaccttagtaccgttaacggtttcggggttaccggttaccggggaccgggttaaaccggggaccccgtaacccggttacgggtacccgggttaccggttaacgggttacccggaaccggtccccggtaaacggttccccgg

SEQ ID NO: 8501 - DNA, 641 bp, Homo sapiens
  misc_feature: GYAE6OF02GACIS.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatccaccatctcctgcacgtggaaccagccagtgatattagaaacttactaaccttgtcttcttggtaaccaacacgcacccaggacaaacgaccccaaactcatcgtatttgagagacagtacgcggcctcgtagggtttacaagtcgtcttctcgtcggctaccgaagtcgtcggacacgccgtcctccgtcgaactactcgtcgtcggtctccgagtcctggacggtacggacgcttagtagtttacttacgtcgtacgtcgacttactagttacgtcggacgttaaggttacgtccttaacgtttccgttagttcggtttacccggtttaaccggggtaacggttaccggggaaacccgttacggttaacccgttacccggttacccgttaaaccggttaccgacccggttacccccggaacggtaacccccc

SEQ ID NO: 8502 - DNA, 574 bp, Homo sapiens
  misc_feature: GYAE6OF02GNVYL.37.36.D03.1.454.CMB.1.raw
  modified_base (258)..(258): a, c, t, g, unknown or other
  misc_feature (258)..(258): n is a, c, g, or t
  modified_base (458)..(458): a, c, t, g, unknown or other
  misc_feature (458)..(458): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcgtggacagtcgatcaccatctcctgcactggaaccagcagtgatattgaaacttatacttgtctntgtacacagcaccagcaaacgaccccaaactcatgtattgtagaggacagtacgcggcctcgtagggttactaagtcgcttcgtctggctcaagtctggacaacgaccggcctcctagactaactcgtcgtcgggcctaccgaggtcgtaggacggacggacggcttagtattaagttcctagtctacgtctacattagngtacgtaaggtacgttacacttacttagttcgttccgttaacggtaacgtaccggggtaactaacggtacccgacccgtaccgtaacgtccgaaccgtaccggtaaccgtaccccg

SEQ ID NO: 8503 - DNA, 675 bp, Homo sapiens
  misc_feature: GYAE6OF02I9R5E.37.36.D03.1.454.CMB.1.raw
  modified_base (385)..(385): a, c, t, g, unknown or other
  misc_feature (385)..(385): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgccactggaacccagcagtgatattagaaacttataacctttgtcttcttggtaacccaacacgccaacccaggaccaaaccgcccccaaactccatgatttgtagaggacagtaagccggtccctgtacggggtttctaatccgtcttctcgtgctaccaagttcnggccaacgccgcctccctagacaactctcgtcgggcctcgacggctggacgggacggtaggtcctaggtaatttacgttacgtcgtcgtacgtccttacaagttgtagtaccgtaaagggtttaccgttacctacgtttccgtttattccggtttaccggtttaaccggggaaaccgtttacgggggaaaccccgttaaaccggggttaccccgtaaccccgggtttacccgttaaacgggttaccccgtaacccgggtaaccccccggtaacccggtaaaccccccccg

SEQ ID NO: 8504 - DNA, 681 bp, Homo sapiens
  misc_feature: GYAE6OF02HXNWH.37.36.D03.1.454.CMB.1.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccngcagtgatattagaaacttataaccttgtctcttggtaaccaacagcacccaggacaaacggcccccaaactnagtagatttgtcgaggaaccagtaacgaccggccctggacggggtttactaagtcgtcctttactcctggtcctacctagttctacggcaaaccgaccgggcccttccccaggtaaccaacttcctccggtacgggtcctaccgtacgggcgtacggaaacgggaccgtaacggggtctacgggtaacttttaagttacccttcgggtccttcgtaccttacgtaaccttaggttcgtacgtaagggtttaacgtctaaccgttctttacgttcggtttaccgtacgggtaaaccgttaccgggggtaaaccctaacgggttacccgtacccggttactaaccggtactaacccggtaccccgaaccggtaacccccc

SEQ ID NO: 8505 - DNA, 696 bp, Homo sapiens
  misc_feature: GYAE6OF02IZ8HL.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgccctgactcagcctgcctccgtgtctgggtctcctggacagtcgatcacatctctgcactaggaaccagcagtgattattagtaaacttactaaccttgtcttcttacggtaaccaacagccaacccgaggaccaaacgaccccctaaactcaatgtactttaggtagaacggtacaacggtaacgccggtaccctacggtaacggggtttactaacgtcgtcttcgtcgtcggtactaccgaagttcgtacggaccaaaccgaccgggtcccttacccgtagtaaacctacttccgttcggtacgggtccttaccgacggtcgtagggaacggtaccggtacggcttacggtacttttaactcgtcgtcctcgtactcgtaatgtacgtacgtaacggtacttaccacgtttacttacgttcggttaccggtttacggtaaccggtacgggtaaacccgttaacgggttcccttaaccccggttaaccgtaacgtaccggtaaccccggtacccgtaacccggtaacccccg

SEQ ID NO: 8506 - DNA, 543 bp, Homo sapiens
  misc_feature: GYAE6OF02HNTFZ.37.36.D03.1.454.CMB.1.raw
  modified_base (302)..(302): a, c, t, g, unknown or other
  misc_feature (302)..(302): n is a, c, g, or t
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
tcagtagtgtagatcacgaccggtgctcgatttagctgcgtcacgatctctcttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttgtaccaacagccaccaggacaacgacccccaaatcatntattgtgagacagtagccggccctcgtaggggtttactaatcgcttctctcgctcagtctgcacgacgcctcngactatctcgtggccncgcggtctgaggacgnggctagtattactcgtgtcngtctatagtatcgtacgtaggtacgtcttacttcttagtcgtttaccgttaggaccgtagggaacctacggtcctacccgttacgtaacgtaccgaacgacccgtaacgaaccccc

SEQ ID NO: 8507 - DNA, 672 bp, Homo sapiens
  misc_feature: GYAE6OF02I6SZU.37.36.D03.1.454.CMB.1.raw
  modified_base (183)..(183): a, c, t, g, unknown or other
  misc_feature (183)..(183): n is a, c, g, or t
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccggtntctgggtcctcctggacngtcgatcaccattcncctgccatggaaccngcagtgatatagaaacttataaccttgtctcgttggtaccaatacgccaacccgaggaccaaacggacccccaaacgtcaagtcgtaagtttcggtagacggtaccgtaagtaacggcccgggtccctacggttacgggggttttactaaagttccggtacttcgtcgtcggtactaccgaagttccgtagtaccaaccgtaccggcccttcccggtagaaccctaagtcccgtacgtcggggaccttacccggtaaggtccgttaggaaccgggaccgggtacggacgttaggtaactttacgttacgcggttccgtgttaccctagacgtttaacgtgaccgttaaggtcgtacctacgttcttatcgttacggtaccggtacgttaggaacctaggtcccgtacctacgtacgaccgtacgaccccgtagtacccccg

SEQ ID NO: 8508 - DNA, 540 bp, Homo sapiens
  misc_feature: GYAE6OF02FLOSJ.37.36.D03.1.454.CMB.1.raw
  modified_base (365)..(365): a, c, t, g, unknown or other
  misc_feature (365)..(365): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccagcagtgatattagaaacttataaccttgccttcttggtaccaacagccacccaggacaaacgcccccaaactcatgattgtgaggacagtaagcggccctgaggggtttctaatcgcttctctggctccaagtcnggcaacgcgtccctccctagacaactctcgtcgggcctaccgaggctggacggacgaggctgacttgttacngtctnctcatntgtcgagtacgtcacttcttagtcgttcgttcggtacgtacgggacctaaggtccaaccgttcctaagtccgaccgtacccgacgtaacccc

SEQ ID NO: 8509 - DNA, 765 bp, Homo sapiens
  misc_feature: GYAE6OF02H0XZE.37.36.D03.1.454.CMB.1.raw
  modified_base (242)..(242): a, c, t, g, unknown or other
  misc_feature (242)..(242): n is a, c, g, or t
tcagtagtgtagatcacgaccggtgctcgatttagctgcgtcacgatctctcttggggggtcgacgaagaggcagcgctctcggacgtctccaccactggcctgggctctgctgctcctcactctcctcactcaggacacacggtcctggcccagtctcgccctgacctcacgcctgccctcgtgtctcgggtctccgtggacgagtcgatcaccacttcctctcgcactcggaaccacgtnacgtgtaactattagtaaacttaacttaacttgttactacgttagtaacctaacgacgtacaacccgagaaccgtaaaccgaaccccctaaaaccgtaccaacgttacgtaacgttttacggtacggtaaacggtaccgtaaacggtaaacggtaccccgggtacccgtaaccggtttacgggggtttaaaccttaaccggttaaccgttacccgtttccgttaaccgtttcgggtaccctaccggttaaaccgtcgttacggaccgtaaccgacccgtcctacccgtagacctacgtacgtctacgggcttaccgacggtacgtcggaagaccggacggtctacggtaacttacgtaactcgctacgtcctacgtaactgtcgagtacggtacgtacgttaccttacgttacgttacgtttaccgtacggggtaaccttacggggtaaaccgtaaccggttaccgtacccggtaccttaacgggttaacccgaacccggtacccggtaacccgtaacccccg

SEQ ID NO: 8510 - DNA, 701 bp, Homo sapiens
  misc_feature: GYAE6OF02IXYS4.37.36.D03.1.454.CMB.1.raw
  modified_base (315)..(315): a, c, t, g, unknown or other
  misc_feature (315)..(315): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcctggacagtcgatcaccatcctctgcactcggaaccagcagtgattattagaaacttataaccttgtctcttacggtaccaacacgacaccgagacaaacgtcccaaactctaataattanagacgtacaacgtaaacgcctacgaggtactttacaacgtcgtacttctcgtacgactacgaacgttacgtacggaccaaccgaccggtaccctcccgtagtaacccacttccgtacgtcgggtaccctaccaaccgtacggaacgggaccgtacggtccttaacgtaacttaagtttacgttacggactacggtaccttaactaagttaacctaaacgtaacggtaccaacgggtccgttaaccgtaaccggtttacggggttcggttaccggggacgggtaacccgggtaacccgtacggtaccgggttaaccgttaccggttaacggtaccgtaaccggtacccccggtaaggtcccgttaccccgggtcccccgttaaccgg

SEQ ID NO: 8511 - DNA, 624 bp, Homo sapiens
  misc_feature: GYAE6OF02HBU1K.37.36.D03.1.454.CMB.1.raw
  modified_base (284)..(284): a, c, t, g, unknown or other
  misc_feature (284)..(284): n is a, c, g, or t
  modified_base (322)..(322): a, c, t, g, unknown or other
  misc_feature (322)..(322): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcacgtacggaaccagcagtgattattagtaaacttactaaccttgtcttcttcggtaaccaacanccaccaggaccaaaccgaccccaaactcatgtatttgngagacagtaacgccgcctgtacgggtttactaacgtcgtacttcctcgtcggtctacgtagtcgtcggaccaacgccggtccctcccgtagactaactcgtacgtcgggtcctaccgacgcgtaggacggacggacggtctaggtaactttagttacgtcgtctcgacctacgtattacgtgacgtaggtactcctacgttcgtttagttcgttacgttaccgggtaacgtacgggtaaccgtaacggttcccgtaaccgtacgttaacgtccgacccggtacccgtaaccgtaaccccccg

SEQ ID NO: 8512 - DNA, 592 bp, Homo sapiens
  misc_feature: GYAE6OF02FV0A2.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacagccacccaggacaaacgcccccaaactcatgatttgtgaggacagtaacgcggccctcgtaggggtttctaagtcgtcttctcgtcggtctaccgaagtcgtaggaccaaccgacccgggtccctcccgtagaacctaaacttcctacgtcggggtcctcccgagggtccgtagggaacgggtacggaggccttagtaactttacgttactcgtacgtgcttcgatacgtgacgtaggtactctacttctttatcgttacgttacggaacgtcgggaacctaaggtcctaccgtctaacgtcacgacccgacgtaacccc

SEQ ID NO: 8513 - DNA, 572 bp, Homo sapiens
  misc_feature: GYAE6OF02HAJ6N.37.36.D03.1.454.CMB.1.raw
  modified_base (197)..(197): a, c, t, g, unknown or other
  misc_feature (197)..(197): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatccccctgtctgcatctgtagganacagagtcacctattacttgccaggcgagtcaaggacattggactaacttatttaaattggtatcagcagaaaccgagggaaacgccccaagcctctggtctacgctgctatccaatttacggaaacgtagacgtcccatacgtaaggttcaggtacggaagtggatcgtagggactaggttacttttactttactaccttcacgtcacgtcctgacgtagtactagaagtactattacgaacttactctttattacgtaccaacctaccgaccgtaccggaccgtacggtaacgtaacgtacgtatacgtacaacgtaacgtcgtacgtcgtacgactacgtacgtactacgtacttactactcccgttacccg

SEQ ID NO: 8514 - DNA, 633 bp, Homo sapiens
  misc_feature: GYAE6OF02HIGT0.37.36.D03.1.454.CMB.1.raw
  modified_base (229)..(229): a, c, t, g, unknown or other
  misc_feature (229)..(229): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatattagaaacttataaccttgtctcttgtaccaacagccacccaggaccaaacgacccccaaactcatgtatttgagaggacaagtaacgccggccctcgtaggggtttacaagtcgtcttctcgtcggctaccaagtcgtcggacaacgaccggccctcctagacctaattcctacgtcgggcctaccgaggtctaggacggacgacggtctagtacttacttacgtcgtctcgtccttactagttagtcgtacgtaagggttactccgtacctttacgtttagtccggtttaccggttaaccgggaaccggttcggggtaaacccgtaacggttacccgttaacccggttaccgtaaccggtccgaacccggtacccgaaccgggtaaccccccc

SEQ ID NO: 8515 - DNA, 566 bp, Homo sapiens
  misc_feature: GYAE6OF02FU4GC.37.36.D03.1.454.CMB.1.raw
  modified_base (232)..(232): a, c, t, g, unknown or other
  misc_feature (232)..(232): n is a, c, g, or t
  modified_base (312)..(312): a, c, t, g, unknown or other
  misc_feature (312)..(312): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (454)..(454): a, c, t, g, unknown or other
  misc_feature (454)..(454): n is a, c, g, or t
tcagtagtgtagatcacgaccggtgctcgatttagctgcgtcacgagtctctcttgggggggtcacaagaggcagcgctctcgggacgtctccaccatggcctgggctcgtgctgctcctcactctcctcactcaggacacagggtcctgggcccagtctgccctgactcagcctgcctcgtgtctgggtctcctggacagtcgatcaccatctcctgccactggaacccgnagtgacgttggtggttataactatgtctcgttggtaccaacgatcacccagggccaaagtcccccaaatcaatgatttangaggtcaacttaaacggccctanaggggtctcgtaatcgctttcnctggctcaagtctggcaacncggcctccgtgaccctatctcgtgggctccaggcctaggaccgacgaggcttacacgttattagttgactagtctanactagtacaagcaaggctaagtcctaacgtttgggtacgtttccgggacggacgggtacccaccgttcgacccggttcgttaacggtccaacggcccctaaggcctacccgg

SEQ ID NO: 8516 - DNA, 631 bp, Homo sapiens
  misc_feature: GYAE6OF02HSV1S.37.36.D03.1.454.CMB.1.raw
  modified_base (195)..(195): a, c, t, g, unknown or other
  misc_feature (195)..(195): n is a, c, g, or t
  modified_base (402)..(402): a, c, t, g, unknown or other
  misc_feature (402)..(402): n is a, c, g, or t
  modified_base (453)..(453): a, c, t, g, unknown or other
  misc_feature (453)..(453): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctccgnggacagtcgatcaccatctcctgacacgtaggaaccagcagtgatattagaaacttataacttgtctcttaggtaccaacagccaaccgagacctaaacgcccccaaaacgtcagtgtacttgtagacgacagtaacgcggtcctgtacggggtttctaacgtcgtcgttctctcggcttaccaagtctggactaaccgaccgtccncctgaactaactcgtctcgggcctacgacggctaggacgggacgtacggtntagtaacttaagtcgttgacgtcgtcttacgacttagttcgtacctaagggttacgacctacgttacgttagttccggttacgtttaccggggaacgttaccgggaaaccgttaacgggttacccaccggttaaccgtaaggtacccgtaaccggaacccgtaaccgggtaacccccc

SEQ ID NO: 8517 - DNA, 527 bp, Homo sapiens
  misc_feature: GYAE6OF02HA7LX.37.36.D03.1.454.CMB.1.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (310)..(310): a, c, t, g, unknown or other
  misc_feature (310)..(310): n is a, c, g, or t
  modified_base (364)..(364): a, c, t, g, unknown or other
  misc_feature (364)..(364): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtnatattgaaacttataaccttgtctcttggtaccaacagccacccaggacaaacgcccccaaactcatgtatttgngaggacagtaagccgcctgagggtttcaatcgcttctctgctcaagtctgcacnccggcctccgtgactactctcgtcggctcgaggctggacgacgagctagtattatactgctgctcatntcgngtagtactcacttcttagttcgtaccgttcggaacgttacgggaaccgtaacggtccacccgttactaacgcaccgacccgtaggaccccc

SEQ ID NO: 8518 - DNA, 616 bp, Homo sapiens
  misc_feature: GYAE6OF02FW7ZO.37.36.D03.1.454.CMB.1.raw
  modified_base (239)..(239): a, c, t, g, unknown or other
  misc_feature (239)..(239): n is a, c, g, or t
  modified_base (336)..(336): a, c, t, g, unknown or other
  misc_feature (336)..(336): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacgagggtcctgggcccagtctcgccctgactcagcctgcctcgtgtcgtgggtcctccgtggacagtcgatccaccatcctcctgccacgtaggaaaccngctagtgattattagaaacttataaccttgtacttcgttaggtaacccaacagacccaacccgaggaaccaaaccgacccccaaatcatgtatttgngagacaagtaaggccgtcctagtacggggtttacaatcgtcttctcgtcggtcctaccgaagttctggaccaacgccggtccctccgtagactaactctcggtcggacctccgacgtcgtggacggacggagtctagtattacttacgtgtctgacttactagtagtcgacgtaggttactctacttacttacgttgttccgttacggtaacgtacgggtaaccgtacgttaccgtaccgttaaccgtaacgttccgaccgtacccgtacggtaaccccc

SEQ ID NO: 8519 - DNA, 652 bp, Homo sapiens
  misc_feature: GYAE6OF02H0QTS.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctctgcacgtcggaacagcagtgatattagaaacttataacctgtctcttagtacaacacgcaaccaggacaaacgacccccaaactcatgtattgtgagacagtaagcgccgtcgagggtttactaactcgtacttcgtactggtctaccgtaagtcgtacggaccaacgaccggtccccttacccgtacgtaacctaaacttccgttcgtacggggtcctaccggtacggcgtacgggaacgggtaacggacggtcgttagttaatttaacttaccgtacggtctacgtctactaagtacgtcgtacgtaggttacgtacctacttacgtttatcggttacgttaacggtaaccggtcgggtaaaccgttaacgggtaccctaaccggttacccgtaacggttacccgaaccggtaccccgaaccggtaaccccccg

SEQ ID NO: 8520 - DNA, 565 bp, Homo sapiens
  misc_feature: GYAE6OF02HC1KD.37.36.D03.1.454.CMB.1.raw
  modified_base (284)..(284): a, c, t, g, unknown or other
  misc_feature (284)..(284): n is a, c, g, or t
tcagtagtgtagatcacgaccggtgctcgatttagctgcgtcacgagtctctcttgggggagtcagttcccaaccaggacacagcatggacatgagggtccctgctcagctcctggggctcctgctgctctggctctcaggtgccagatgtgacatccagatgacccagtctccactcccccctgtctgcatctgtaggagacagagtcaccatcacttgccaggcgagtcaggacagttggacaacttatttaaattggtaatcagcaagaaaccagggaacnccccaagcctcctggtctacgctgcatccaagttggaaacaggactcccagtacaaggttcaggtggaagtggatcgtggactagtacttttacttcacctttcacgtcagtcctgcgtagtctagaagactattacgactaactattacttattcgtacaacactacgtacgaccggtcccgtaagggtaaccctaaggtacggtaataacgtaaccgaaacgtacgtacggtacggaccgttacggaccctaccgtacgttccgttacttccttaaccg

SEQ ID NO: 8521 - DNA, 525 bp, Homo sapiens
  misc_feature: GYAE6OF02I3DC4.37.36.D03.1.454.CMB.1.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (400)..(400): a, c, t, g, unknown or other
  misc_feature (400)..(400): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggacagtcgatcaccatctcctgcacgtggaaccngcagtgatatagaacttanaaccttgtctcttggtaccacagcaccaggacaacgaccccaaactcatgatttgngagacagtaacgcggcctacgtaggggtttctaagtcgtcttctctgctcaagtctggcaacgcggcctcctgaactactctcgtacggtctccgngctaggaggcgagtctgtattacttctgctagctcattagtgactaggtntacnctttactattcgtacgtcggtaactcgggaactacggtctaccgtcgtaacgcacggtacccacggtaccc

SEQ ID NO: 8522 - DNA, 654 bp, Homo sapiens
  misc_feature: GYAE6OF02G66PG.37.36.D03.1.454.CMB.1.raw
  modified_base (236)..(236): a, c, t, g, unknown or other
  misc_feature (236)..(236): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatccaccatcctcctgcactggaaccagcagtnatattagaaacttataaccttgtctcgttaggtaccaacagccacccaggaccaaaccgacccccaaaactcctactagtactttgaggtaaggacgaagtaacggccggtaccctacggtacgggggtttactaacgtccggtactttcctacgttacggtcctaccgtaacgtcgtacgggaccaaacccgtccggtccccttaccgtacgaaccctaactccgttcgtcgggacccttccgacggtccgtggaacggacgggtaggtcgttagttaactttaacgttctacggtctgtccgtatacgttaagtcgagttacgggtactcttacctatttcgtacgttcgtaacgggtactacggaccgtacggtctaaccgtcgttaacgccgaccgtacccgaccgtaaccccg

SEQ ID NO: 8523 - DNA, 869 bp, Homo sapiens
  misc_feature: GYAE6OF02IDVXW.37.36.D03.1.454.CMB.1.raw
  modified_base (231)..(231): a, c, t, g, unknown or other
  misc_feature (231)..(231): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgccctcgtgtcgtgggtcctctggacagtcgatcaccatctctgcacgtcggaacngcagtgatatagtaaacttataaccttgtctcgtagtaccaacagcaacccgaggaccaaaccgaccccaaactacatgttattgtagacggacaacggtaacgccggtacccgttacggtaacggggtttacctaacgttccggtactttaccgtcgtccgggtacctaaccgtaaggttaccgtacggtacctaaacccggtacccgggtacccctttacccgttaacgtaaccgtaaaccgtttacccgttaccgggttaccgggtaccgttacccggaacgggtaccggtacggggtaacgggtaaccgggtaacgggttaaccgtttacggttaaaccttttaaacgttttaccggtaaccgttaccggttacgttacccgttaaccgtttaaacgtttaacgtaccggttaaccgtaacggggttaaaccgttaacccgttaaccgttttaacgttttaccgtttaccggggggggtttaaccctttaacccgggggtaaaccgggtttaaccggggtaaaacccggtttaaaccgggtaacccgtttaaccccgggttaacccgtttaaacccgggttaaccccggtaaacccggttaaccccccggtaaacccgggttaaaccccccccg

SEQ ID NO: 8524 - DNA, 699 bp, Homo sapiens
  misc_feature: GYAE6OF02GSQHQ.37.36.D03.1.454.CMB.1.raw
  modified_base (237)..(237): a, c, t, g, unknown or other
  misc_feature (237)..(237): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtcgtgggtctcgtggacagtcgatcaccatctcctgcactaggaaccagcagtnatatagtaaacttataaccttgtctcttacggtaaccaactagccacccgaggacaaacgcccccaaactcatgtattgtagaggacagtaacgccgcctgtaggggtttctaagtcgtacttctcgtcggtcctaccgtagtcgtaggaccaaccgtaccggtaccctccgtagtaacctaacttccgtcggtacgggtacctccgacgggtacgtacggaacgggtacggacgtccgtaggttaactttaacggttacgtcggtaccgttacgtacccgttacgtaattacggtacgtacgtaacgggttactacccgttaaccgtttctttacgttccggttaccggttaacccgggtaaaccggttcgggggtaaaccccttaacgggttacccgttaccccggttaaccggttaaccggtacccggaaaccggtacccccgaaccggtaaccccccc

SEQ ID NO: 8525 - DNA, 633 bp, Homo sapiens
  misc_feature: GYAE6OF02IGY14.37.36.D03.1.454.CMB.1.raw
  modified_base (234)..(234): a, c, t, g, unknown or other
  misc_feature (234)..(234): n is a, c, g, or t
  modified_base (318)..(318): a, c, t, g, unknown or other
  misc_feature (318)..(318): n is a, c, g, or t
  modified_base (391)..(391): a, c, t, g, unknown or other
  misc_feature (391)..(391): n is a, c, g, or t
  modified_base (425)..(425): a, c, t, g, unknown or other
  misc_feature (425)..(425): n is a, c, g, or t
tcagtagtgtagatcacgaccggtgctcgatttagctgcgtcacgagtctctcttggggggggtcacaagaggcagcgctactcgggacgtctccaccatggcctgggctctgctgctcctcactctcctcactcaggcacagggtcctgggcccagtctgcccttgactcagcctgcctcgtgtctgggtctcctggacagtcgatccaccatcctcctgcacctggaacccngacagtgaattattggaaactttataacctttggtcttcttggacctaacagcacccagccaaacgccccaaatcatgatttgngagacagtagcggcctgagggtttcaatcgcttactctggtcaccgtaagtctggacacgacgggtcctaccngacctaactctacgtcgggtactccgacggtccnggtacggaccggtaaggcgttggaacgttttactacgtagtcgtagtcctacgagttaacgtggacgtaagggtcgtcgttaacgttccgttacgttcggttaccgtttacgggtaacccgttcggggaaaccccgttacggttacccgtacccggttacccgttaagggttaccctaacggtacccccgtaaacgggtaaccccccc

SEQ ID NO: 8526 - DNA, 624 bp, Homo sapiens
  misc_feature: GYAE6OF02HDV67.37.36.D03.1.454.CMB.1.raw
  modified_base (236)..(236): a, c, t, g, unknown or other
  misc_feature (236)..(236): n is a, c, g, or t
  modified_base (323)..(323): a, c, t, g, unknown or other
  misc_feature (323)..(323): n is a, c, g, or t
  modified_base (383)..(383): a, c, t, g, unknown or other
  misc_feature (383)..(383): n is a, c, g, or t
  modified_base (436)..(436): a, c, t, g, unknown or other
  misc_feature (436)..(436): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctcgccctgactcagcctgcctcgtgtctgggtctcctggacagtcgatcaccatcctcctgcactggaaccagcagtnatattagaaacttataaccttgtaccttcttacggtaccaaccagaccacccgaggaccaaacgacccccaaaactcatgtatttgngagacaagtacgcggtccctcgaggggtttctaactcgtcttctctgctaccgaagttcnggaccaacgccgtccctccgtcgaactatcctacgtcgggcctccaggtccgnggacggacggtagcgtgtaatttagtactgtcgtgtaccttcgaattagtaggtaacgttacgtaccgtacttacgtttaagtcggtttacgttaccgggtaacggttaccgggtaaacctaacgggttaccctaccggttaccgtaacggtccaacccggacccgtaaccggtacccctaaaccccg

SEQ ID NO: 8527 - DNA, 601 bp, Homo sapiens
  misc_feature: GYAE6OF02I25CX.37.36.D03.1.454.CMB.1.raw
  modified_base (228)..(228): a, c, t, g, unknown or other
  misc_feature (228)..(228): n is a, c, g, or t
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccngcagtgatattagaaacttataaccttgtctcttaggtaccaanacgacaccgaggaccaaacgacccccaaatcatgattgngagacagtaagccggcctgtagggttactaatcgtcttcgtctggctaccgaagtctacggaccaacgaccggccctccgtagaacctaattccgcgtcgggcctacgacggtctacggacggtacgaggtcttagtactttactaacgtggtctgacctacgtatagtcgacgtaaggtactacctacgttcgttactcggttacgtaccggtaaccgtacgggtaacccgtaacggttcctaacccgttcgtaaaccggtccaaccggtacccgaacggtaacccccc

SEQ ID NO: 8528 - DNA, 708 bp, Homo sapiens
  misc_feature: GYAE6OF02I1PGW.37.36.D03.1.454.CMB.1.raw
  modified_base (226)..(226): a, c, t, g, unknown or other
  misc_feature (226)..(226): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctggtctcctggacagtcgatcacatctcctgcactgaaccngcagtgatattagaaacttataaccttgtctcttggtaaccaactagccacccaggacaaacgcccccaaaactcatcgatttgtgagacagtaagcgcctgtagggtttactaacgtcgtacttcgtcgtcggctaccgaagtccttggactaaaccgaccgggtccctacccgtacggtaacctaaacttcgtacctacgggggtccctccggaacggtcgtacggaacggaacgggtacgccgttaggtaatttaacgttaccgtcggtaccgttggtaccctacggttaaattacgtacggtaccgttaaacggggttaccttaaccgtacttaccgtttttaaggtccgtttaccggtttaaccgggtaaacggtttcccggggtaaaaccgtaaccgggttacccgttaaccccggtttaaccgttaaaccggttaccctaacccgggaaccccgtaacccgggtaaacccccccg

SEQ ID NO: 8529 - DNA, 878 bp, Homo sapiens
  misc_feature: GYAE6OF02JNCSJ.37.36.D03.1.454.CMB.1.raw
tcagtagtgtagatcacgaccggtgctcgatttagctgcgtcacgatctctcttgggggggtcgacgagaggcagcgctctcgggacgtctcaccatggcctgggctctgctgctcctcactctcctcactcaggacacaggtcctggcccagtctgccctgactcagcctgcctccgtgtctgggtcctccgtggactagtcgatcaccatcgtccctgaccgtactggaacccaggtcaaggttctaagtaatttacggtaaaacctttacttaaaccgtttacggtttacttaccgtttacggtaaccctaacttaacggaccaccccgtaacggtacccgaaaaccgaccccccgtaaaaccctacccaacgttacgtacttttacggttacggtaacggaaccgtaacggttaaacgtacccggggtaccccgttaacttaccgggggggtttacctttaaaacggtacccgggttactttcccggttaccgtttacgggttacccgtaccgtaaacgggtttccgttacgggaacccgtaaacccggtacccgggtccccgttaccccgtttaccgggtaacctaaacgttcccgtttacccggttacggggtacccttacccgggtaaccgggtccggtttacgggaaccggggtaaccgggtacgggttaccgtacggggtaacctttacgttaccctagggttcccgttacggtcctacggtacttaacggttcgtaccgtaacgggttaacgttccaacgtttccgtttacgttaccgttcgtttaacccggggttaatccgggggtaaacctaacgggttacctacccggttacgtaaccgtcgaacgacccgtaaccgggtaaccc

SEQ ID NO: 8530 - DNA, 569 bp, Homo sapiens
  misc_feature: GYAE6OF02GPJYP.37.36.D03.1.454.CMB.1.raw
  modified_base (410)..(410): a, c, t, g, unknown or other
  misc_feature (410)..(410): n is a, c, g, or t
  modified_base (462)..(462): a, c, t, g, unknown or other
  misc_feature (462)..(462): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcaccctctcactcagggcacagggtcctgggcccagtctgccctgactcagcctgcctccgtgtctgggtctcctggacagtcgatcacatctcctgcactggaaccagcagtgatattagaaacttataaccttgtctcttggtaccaacagccaccgaggacaaacgcccccaaactcatgattgtagaggacagtaagcggccctgagggtttctaagtctcttctctgctcagtctggacaacacgcctcctgactaatctcgtcggtctccaggctaggaggacgnggctagtattaacgtacgtctcgtgtctctactatgacgtagtagtctactnttagtcgttacgttacggaacgtacggggtaacccgtaaaggttcctaacccggttacccgttaaggtccgtaaccggaacccgtaaccgggaccccctaaccccgg

SEQ ID NO: 8531 - DNA, 558 bp, Homo sapiens
  misc_feature: GYAE6OF02HARQ0.37.36.D03.1.454.CMB.1.raw
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccgaggcgagtcaggacagttggactaacttatttaaatggtatcgagacaagaaaccgagggaaaccncccccaagccttccgnggtcacgctgcatccaagttaggaacnggactccatcgaaggttcgagtggaagtggatcgtagggatagttacttttactttcaccttnacgcacgccgtncgagtcgtagaacgtntattgacacgtattcttagtactacaaccacagtaccgaccggtaccgtacgggaactaagggtcgaacttaacgaacggtaaaaccgtacgtggtacggccttacgaccctaccgtacgtttcttcgttacttaccc

SEQ ID NO: 8532 - DNA, 779 bp, Homo sapiens
  misc_feature: GYAE6OF02IGXG1.37.36.D03.1.454.CMB.1.raw
  modified_base (216)..(216): a, c, t, g, unknown or other
  misc_feature (216)..(216): n is a, c, g, or t
  modified_base (237)..(237): a, c, t, g, unknown or other
  misc_feature (237)..(237): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcgaggacacagggtcctgggcccagtctgccctgactcagcctgcctccgtgtcgtcgggtctccgtgacacgtcgatcaaccnctcctcctgcacgtggaaccngcagtgaatatagtaaacttactaacttgtctcgttacggaacctaacgacgtccaacccgaacggaccaaaaacccgtacccccctaaaacgtacctaacgttaggttaacgttttggtacgggtaaacggtaaaccgtaaacgggttaaccggccccggggttaaccccgttacgggtttaaacgggggttttaccttaaacgttcccggttacgtttccgttccgttcggtacccttaccgtaacggttcctacgggaccaacccggtaccggcccttacccgtgtaactacgtaccgttacggtcggtccttaccggaggttccgagggaacgacgggtagtcgttagtaacttaagttaccgcgtacgtctacgtacgttaagtacgtacgtacgttaacgggttactacccggttacttacctttagggttcccttacgggttaaccggaccgggttaaccggaacccgttaaacggttcccgtacccgttaaacggtcccgtaaccgtaacccggtcccgaaacccggtaccccc

SEQ ID NO: 8533 - DNA, 614 bp, Homo sapiens
  misc_feature: GYAE6OF02GV2ZA.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggacaactatttaaattggtatcagcaaggaaaccagggaaacgtcccccaagctccgtggtcctagctcggctacgtacctaacgtttggaaaacgtcggaagtaccccaattaccgtaaagggtttccaaggttacgggaaagtgggtactcgtaggggaacctaggttactttttaccgtttacacctttcgacgtcaagtctgaccacgtcgtagaacgtactagttcgaactagtattacttagttaccgtactaaaccgcctaagtccgaaccggtcctaacgggaaccaaagtcggtaataacggtaactaaacgaccgttacgtacggtactacggtacctaaccgtacgttccgttacgtaccttaccg

SEQ ID NO: 8534 - DNA, 732 bp, Homo sapiens
  misc_feature: GYAE6OF02HQ4QS.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctcgggccctagtctcgccctgactcagcctcgcctcgtgtcgtcgggtcctccgtggacagtcgactccacctactcctcctcgaccacgtacggaaccagctaggtagtattagttaacgtaaactttacgttaaccgttgtccttacgttacggaccaacgacgtaccgacccgtaacggaaccaaacccgaacccctaaccgtactagtgttagttgtacggaggaacgtaacgtacggtccggtaccgttacggttacgggtttactacgtccgttacttccgtcgttacggtcctacgtagtccgacggtaaccgaccgtaccggtcccttacgacgacgtactcgtcgtcggtcctcgacggtcggtacggacgggacgtacgtacgttagttacttaacgttcacgtcttgtacctataagtcgtacgtacgtaacggtcgtaccttcgttacgttacgttcgttaaccgggttaccgggtaacccgtaacggggtaacccgttaccgggttaaccttacccgggttacctaaaccggttcccggtaaccccgtaacccggtaaccccgaaccccc

SEQ ID NO: 8535 - DNA, 788 bp, Homo sapiens
  misc_feature: GYAE6OF02G8CPI.37.36.D03.1.454.CMB.1.raw
tcagtagtgtagatcacgaccggtgctcgatttagctgcgtcacgatctctcttgggggggggtcacaagaggcagcgctctcgggacgtctccaccatggcctgggctctgctgctcctcactctcctcactcaggacacgagggtccgtcgggcccagtctcgccctgactcagcctcgcctccggtgtcgtgggtcctcctggacacggtcatccaacctattcctcctggactaccgtacggaaccagacagtagtattaagttaacgtaaaacttaacttaacctttgttacttacgttacggtaacccaaacacgaccaaccgaacgaacaaaccgtaccccaaactacactagtattgagagaacagaacgccgccgtagtagggtttactaacgcgtcttctcgtcgcctacaagttcgacggaccaaccgacccggtcctacccgtacgaactaaacttccgtacggtcgggtccctacgtagggacctaagggaaccgggacgaacgggtacttacggttaaatttaaccgttacgtacgtcgttaccgtacgttaacgtaaacttcggttaacgaccggttaaacggggtacttaacccgttaacgtttcccgttaagtttaccgggtttacccggttttaaacccgggtaaacgggttaccggggtaaacccgttaaacccgggttaaccgttaaacccccgggtttaaccgtttaaaccgggtaacccggtaaaccccgttaacccccggtaaaacccggggttaaacccccccg

SEQ ID NO: 8536 - DNA, 711 bp, Homo sapiens
  misc_feature: GYAE6OF02F73DY.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctcgccctgactcagcctgcctccgtgtctgggtctcctggacagtcgatcaccatcctcctgcacgtggaaccagcagtgatattagaaaactttataaacctttgtacttcgttacggtaacccaacagtccacccaagggaccaaaaccggaccccccaaatcatcgtatttgtagaggaacagtaacgccggcctagagtaacttttctctcgtcttctctcgcctaccgaagtcgtcggaccaaccgtaccggtcccttcccgtttacggaaccctacgttccgtttaccgtcggggtcccttacccgaaggtaccgtcgggaacggaacgggacggtcgttaaggtaacttttacgttaacgttcggtacgttaaggtttaccaagttagtaacgggaaccgtaccggaaaccctaagttaccttttagtaccggtttaccggttacggggtaaaggttccggggaaaccgtaacggggttcccgttaccggttaaccgttaacggtaccgtacccggaaccccggtaccggtaaccccctaaccccg

SEQ ID NO: 8537 - DNA, 665 bp, Homo sapiens
  misc_feature: GYAE6OF02GR5VE.37.36.D03.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (429)..(429): a, c, t, g, unknown or other
  misc_feature (429)..(429): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacgagggtcctcgggcccaggtctcgccctgactcagcctgcctcgtgtctggtctccgtggacagtcgatccacntctccngcactgaacaggcagtcaatatagaaacttattaacttgttcttcttacggttaaccaanacgcaaccgagaccaacgacccctaaaacncactnactttgtagacggaactagacggtccggacctcgtaacgggtttactaacgtccgtcttccttcgcggtctcctaagtcgtacgggctaaaccgccgtcctaccctagactaacnccgttacgtccggctaccgtagggtcagggaacggtacggacggtacctagggttaactttaacgttacgtcgtcgtacgtaccgttactagtaacgtcgacgttacgggtaaccttcgtaactttaccgttgttaccgtttaggtaccggttaaccggttacgggaacgtttaaccggccgttaacccgtttacgttaacgtcccgtaaccggtaccccgaagggtaaacccccc

SEQ ID NO: 8538 - DNA, 627 bp, Homo sapiens
  misc_feature: GYAE6OF02G86JQ.37.36.D03.1.454.CMB.1.raw
  modified_base (273)..(273): a, c, t, g, unknown or other
  misc_feature (273)..(273): n is a, c, g, or t
  modified_base (309)..(309): a, c, t, g, unknown or other
  misc_feature (309)..(309): n is a, c, g, or t
tcagtagtgtagatcacgaccggtgctcgatttagctgcgtcacgatctctcttggggggggtcacaagaggcagcgctctcgggacgtcctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaacngccaccaggacaaacgcccccaaactcatgatttgngagacaagtaacgccggtccctcgtaggggtttactaagtccgtctttctcgtggtcctaccaagtccgtaggaccgaaccgaccgggtccctaccctagacctaactccgtcgtacgggtcctacgacggcgtaggacggacggacggtctagtatttagttacgtgtactagttaccatagtacggtacgggacccgtaacctacctaacgttagttacgtacgttacgggtaacgggtacgggaacccgtaagggttccgtccggttacctaacggtccgaacgtaccccggaaccggtacccaacccccgtacg

SEQ ID NO: 8539 - DNA, 545 bp, Homo sapiens
  misc_feature: GYAE6OF02JW53H.37.36.D03.1.454.CMB.1.raw
  modified_base (233)..(233): a, c, t, g, unknown or other
  misc_feature (233)..(233): n is a, c, g, or t
  modified_base (312)..(312): a, c, t, g, unknown or other
  misc_feature (312)..(312): n is a, c, g, or t
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
tcagtagtgtagatcacgaccggtgctcgatttagctgcgtcacgatctctcttggggggggtcacaagaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgccactcggaacccgnagtgtacgttggtggttataactatgtctcttggtaccactatcacccaggacaaacgtcccaaactcactgtatttangtacggtacaaccgtaaacggccctcgagggtctacgtaatcgtcttctcgtgctcaagtctgacaacncggtcctcctcactactcncgtgtcnccgagctacgacgacgcgctactctattntgcagctnatnacgaagcacgctgtacgttgggtcgttcggcgggtaacgtaccgtaccgtacgtaccggttcgttacggtacctacgacccggtacgtccgtacccgg

SEQ ID NO: 8540 - DNA, 577 bp, Homo sapiens
  misc_feature: GYAE6OF02GWAQF.37.36.D03.1.454.CMB.1.raw
  modified_base (228)..(228): a, c, t, g, unknown or other
  misc_feature (228)..(228): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactggaaccngcagtgatattgaaacttataacttgtctctgtacaacagcaaccagacaacgaccccaaatcatntattgngagacaagtagcgacctgagggtttctaacgtcgtacttctcgtggctacgaagtcgtcggacaacgccgtcctccctagaactactcgtcgtggcctacgagcgtaggaggtacgacgtctagtaattgtactgtctgctanattanacgtctaaggtactccgtaacttcttacgttcgtaccgtttaacgggtaacctacggggtaaccctaacggttacccgaacccgttaccgttaacgttaccgaaccgtaccccgaaggtaacccccccg

SEQ ID NO: 8541 - DNA, 803 bp, Homo sapiens
  misc_feature: GYAE6OF02HUKFH.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatcaccatcctcctgcacgtcggaaccagcagtgatattacgtaaacttataaccttgtctcgttacggtaccaacacgccaacccgaggaccaaaccgaccccaaactcagtgtatttgtagaggacaaggtacgccggacctcgtaggggtttactaacgtcgtacttctcgtcgtactaccgtaacgtcgtacgaccgtaaccgacccgggtcccttacccgtacggtaacctaaccgtttcccgtaccggttacggggtacccttccggtaacgggtccggttacggggaacggggtaaccggtaccggggttaccgttacggttaaaccgttttaacgttttaacggttccgggttacgttaccggtacccgtttaccgtaacggttacgttacgggtaccgtttaaacggggttacttacccgttaaccgttttaccgtttacggtttacggtttacccggtttaaaccggggttaacccggttaaccggggaacccgtttaaacccgggtacccggttaccccgggtttaaccgttaaaccggttacccgtaaacccgggtaccccggtaaaacccggttaacccccccg

SEQ ID NO: 8542 - DNA, 682 bp, Homo sapiens
  misc_feature: GYAE6OF02I7Y5B.37.36.D03.1.454.CMB.1.raw
  modified_base (236)..(236): a, c, t, g, unknown or other
  misc_feature (236)..(236): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgacctcagcctcgcctccgtgtcgtgggtcctcctggacagtcgactccaccatctcctgcacgtggaaccngcacgtgatattagaaaacttataaccttgtccttcttacggtaacccaacgtacgaccacccgaggacaaaccgacccccaaagtcatagtatttgacgacggacaaggtaacgccggtcctcggtacgggtttactaacgtccgtcttcgtcgtgtcctaccgaagttccgacggaacctaaccggtaccggcctacccgtagaactaacgtccgttcggtaccggacttccggaaggtccgtagggaacggaccgcgggtactaggtactttactacgtgtcctacggtaccctatacgttgacgacgttaaggtacttacctactttccgtttagtcggtttaccgttaacgggtaaccgttacggggtaaccctaaccggggttcccgtaacccgttacgtaacccggttaccaacccggtaccctaacccggtaaccccc

SEQ ID NO: 8543 - DNA, 540 bp, Homo sapiens
  misc_feature: GYAE6OF02JJ4T2.37.36.D03.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (369)..(369): a, c, t, g, unknown or other
  misc_feature (369)..(369): n is a, c, g, or t
  modified_base (426)..(426): a, c, t, g, unknown or other
  misc_feature (426)..(426): n is a, c, g, or t
  modified_base (463)..(463): a, c, t, g, unknown or other
  misc_feature (463)..(463): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccntctcctgcactggaaccngcagtnatnttgaacttataaccttgtctnttgtaccaacngcacccaggacaaacgcccccaaatcatcgatttgtgagacagtaacgcgccctagtaggggtttctatcgtacttcgtctggctctaagtcgtgcaacnccggctccctgaactactctcgtcggctcgagtctgagacgagctagtattattacngtctgctatatatgactaggtacgtactacttcgttnttcgcgtttcggaacgttacgggtaacctaaggttccaccgttacgtaacgttccaacggtacccaacggtaccccc

SEQ ID NO: 8544 - DNA, 749 bp, Homo sapiens
  misc_feature: GYAE6OF02G1HLC.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacgagggtcctgggcccagtctcgccctgactcagcctgcctccgtgtcgtgggtcctccgtggacagtcgatcaccatcctcctgcacgtcggaaccagcagtagattagtacgtaaacttacttaaccttgtaccttacgttacgtaaccaacgtacaccaacccgaggaccaaaccgtaccccctaaagtactagtagtacgtttaggacggaacggactaaggtaacggcccggtacccttagggttaccgggtttaactacgtaccgtctttacgtcgtacggtaccctacgacggttccaacgggaccaaaccggtcccgtacccttacccgtagaacctaacgttccgtaccggtcgggtccctaccggacggtcggtacggacggtacggtacgggtcgttaagtacgtttaattacgtcgtccgtttcgaccttacgtaagttacgtcggtacggtaacggttcgtaaccgttaccgtttaccgtttagttacgggtttacccggttacgggtaaccggtacgggtaacccgttaaccggtacccgttaaccggttacgtaaccgtcccggtaacccggtacccgtaacccggtaacccccg

SEQ ID NO: 8545 - DNA, 669 bp, Homo sapiens
  misc_feature: GYAE6OF02FM0OY.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatatgaaacttataaccttgtctcttggtaccaacagcacccaggacaaacgaccccaaactcatgatttgtgagacagtaagcggcctcgtaggggtttactacgtcgtacttcctcgtcggctccgtaagtcgtcggacaacgaccggccctccgtacgtaactaacgttccgtacgtacgggtcctacccgacgggtcctacgggtaacgggaaccggtacgggtacgtaggttaactttaacgtttacgtcggtacgttcggaccttaccgtaattacgtcggtaccgtaacgggttacgtaccgtaacctttcgtttacgttcgttaccggtttaccggtaaccggttacggggtaaccctaacgggttacccgtaacccggttaccgttaaacggttccgaaccgtaccccgaacccggtaacccccg

SEQ ID NO: 8546 - DNA, 720 bp, Homo sapiens
  misc_feature: GYAE6OF02IE6EQ.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctgccctgactcagcctgcctccgtgtcgtcgggtctccgtggacagtcgatccacatcctcctgcacgtacggaaccagcgagtgaattaattaacgtaaaactttacttaaaccttgttaccttcgttacggtaaccaacgaacgccgaacccgaacggaaccaaaaccccgacccctaaaacctcaagtacgtattttcggaggtacggaacgaaggtaacggcccggtaccgttacggtacgggtttactaactcgtcttacgtcgtcggtaccttacgaacgtcgcggaccaaccgtaccggtcccttacccgtagtaccgtattccgttcggtcggtaccgtccgacggtacgtcgggaacggacggtacgtacgttacgtatttacgtcgtacgtcgtcgtacgtacgtaatcgtagacgttacggtactacgttaccttacgttacgttacgttccggtaaacgggtaccggtaaccgggtaaccgttaacccggtaccttacccggtaaccgtaaccggtaccggaacccgtacccgaacccggtaaccccg

SEQ ID NO: 8547 - DNA, 536 bp, Homo sapiens
  misc_feature: GYAE6OF02JXRPS.37.36.D03.1.454.CMB.1.raw
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtctcttggtaccaactagcacccaggacaaacgccccaaactcatgattgtgagacagtagcgcctcgtacgggttactagtcgtcttctcgtggctacaagtctggacaacnccgcctcctgacaatctacgtggctcgngtcagagtacgagtctgattatacngtctagtcctanattancgcgtagtacgtacaccgttnttagtgttaccgtcggtaagtcggtaaccgtagttccgtaccgtaccgttaagccgacgacccaaccggtaccccg

SEQ ID NO: 8548 - DNA, 589 bp, Homo sapiens
  misc_feature: GYAE6OF02GENKH.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagtaaacttataaccttgtctcgttggtaaccaacagccacccgaggacaaacgcccccaaatcatgtatttgagagacagtaagcggcctgtacgggttctaatcgcttctctggctcagtctggcaacgccgcctccgtgaacctaactcgtcgtcgggtctccgacggtctacggaggaacggaggtctaggttatttaacgttacgtgcgtacgttcagttaagtaggacggtccgaaccactaacttagtcttcgttacgggaggttacgggaaccgtaacgggtccgttaccgtaaccgttacgtaccgaaccgtacccgaacggaccccctaacccgtaccg

SEQ ID NO: 8549 - DNA, 638 bp, Homo sapiens
  misc_feature: GYAE6OF02HSLJD.37.36.D03.1.454.CMB.1.raw
  modified_base (201)..(201): a, c, t, g, unknown or other
  misc_feature (201)..(201): n is a, c, g, or t
  modified_base (230)..(231): a, c, t, g, unknown or other
  misc_feature (230)..(231): n is a, c, g, or t
  modified_base (321)..(321): a, c, t, g, unknown or other
  misc_feature (321)..(321): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctggcccagtctgccctgactcagcctgcctccgtgtctgggtcctccgtggacngtcgatcacatcctctgcacgtggaaccnncgagtagatattagaaacttactaacttgtctcgttacggtaaccaacacgaccacccgacggaaccgaaaccacccccaaactactatntacttgtagagacagtacgcgcctcgtaggttactagtctcttcgtctcgtctaccgtagtcgtgaccaacgcgtaccctccgtacgacctacttcgtcgacggtcctacctaacgcggacggaacgcggtacctactaacgttattaacgttcacctacgtacctactaacgtaactaacgaacgcgtaacgcgttacgtacggttgggttacggttccgggacgggtaaccggtaccggtaaccgtccggttaacccgttcggttaacggtccgtaaccggacccggtaacggtcccgtacccggttcccccggg

SEQ ID NO: 8550 - DNA, 707 bp, Homo sapiens
  misc_feature: GYAE6OF02F1AWK.37.36.D03.1.454.CMB.1.raw
  modified_base (199)..(199): a, c, t, g, unknown or other
  misc_feature (199)..(199): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatcgacccagtctccactccccctgtctgcatctgtagganacagacgtccaccatcacttgccgaggcgagtcgaggactagttgggactaaacgtttaattttaaagttggtactcgaacgtacgaacgaaaacggtacgggaaaccgcccccaaaggtcccttaccgtaggtacctaaccgctaggacctactacccgtaagttacggaaacgacggtacgtacccaagttacgaagggtttacgaggttagggaaagttagggtacttacggtagggtaactaaggttttattttaccgtttacacctttacgacgtccgtaacggtccgttacgtacgtacgttccggtaagtaaacgtacgttaagttccggtaacttaaacttacgttaactttagttacgaaacctaaccgtaccaggttaccgaccggtaccgttaccgggaaacgtaacggttagtaacgtaacgttaaccggaaaacgttacgcggttacggaccgttacggacccttacgacgttaccgtttcggtacctttacccg

SEQ ID NO: 8551 - DNA, 731 bp, Homo sapiens
  misc_feature: GYAE6OF02G4B1B.37.36.D03.1.454.CMB.1.raw
  modified_base (231)..(231): a, c, t, g, unknown or other
  misc_feature (231)..(231): n is a, c, g, or t
  modified_base (324)..(324): a, c, t, g, unknown or other
  misc_feature (324)..(324): n is a, c, g, or t
tcagtagtgtagatcacgaccggtgctcgatttagctgcgtcacgatctctcttgggggggtcacaagaggcagcgctctcgggacgtcgtccaccatggcctgggctctgctgctcctcactctcctcactcaggacacagggtcctggggcccagtctgccctgactcagcctgcctccgtgtctgggtctcctggacagtcgatcaccatctcctgccactggaaccngcagtgatattgaaacttataaccttgtctcttaggtacctaacacggcaacccgagggacaaaacggcccccaaaactccatcgattttggngaaggactagtaagccggaccctacgaggggtttctaaagtccgtacttctacgtcggccttaccgaaagttcgttacgggaccctaaaccgtaccgggtcccttaccccgtggtaaccctaaacgtttcccgtaccgtcggggtaccttaccgtaaggggccttaggaacggggaccggtaacgggtcctttaggtaactttaacgtttaccgtacggtccttggtacccttacgtaactttacggttacgtaccgtaagggttaccgttaacctaaccgtttctttaacgttcgtttaccggtttaacggggtaacctttacgggggaaccccttaaagggttccctaacccggtttccgttaaacggtaccctaaccggggtaccccaacgggtaacccccccg

SEQ ID NO: 8552 - DNA, 632 bp, Homo sapiens
  misc_feature: GYAE6OF02H8TVM.37.36.D03.1.454.CMB.1.raw
  modified_base (143)..(143): a, c, t, g, unknown or other
  misc_feature (143)..(143): n is a, c, g, or t
  modified_base (293)..(293): a, c, t, g, unknown or other
  misc_feature (293)..(293): n is a, c, g, or t
  modified_base (385)..(385): a, c, t, g, unknown or other
  misc_feature (385)..(385): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgngggtcctgggcccagtctcgccctgactcagcctcgcctcgtgtcgtggtctccgtggacagtcgatccaaccatcctccgtgacaccgtaggaaccagcagtgattattagtaaacttactaccttcgtcttcgttacggtaaccaacncgaccacccgaacgaaccaaacccgaccccaactcagtgtatttgagagaacaggtacgccggccttacggtacggtttacaacgtccgttnttcgtcgtacggtcctacgtacgtcgtacggaccaaccgccggtcctcctagacctacgtcgtcgtcggtacctcgaggtcgnggacggacgngtactagtaacgttactctagtctgtctactagtcgtcgagttaggtactactactttcttacgttcgtaccggttaacggaaccggttacggaaccggtaaccgtaccttacggtaaccgtaacgcccgtaaccggacccgtaacggcccccg

SEQ ID NO: 8553 - DNA, 766 bp, Homo sapiens
  misc_feature: GYAE6OF02JZU29.37.36.D03.1.454.CMB.1.raw
tcagtagtgtagatcacgaccggtgctcgatttagctgcgtcacgatctctcgttgggggggtcacgaagaggcagcgctcgtcgggacgtcctccaccagtcggcctggggcctctgccttcgtcctcctcacctcctcctcactacacggacacgacggtccgtcggccagtcctcgccctcgactccacgccctcgtccgtcggttctggggtcctcctgggaccaggtccactcgacctactcgtacctggcaactggaaccctaggtccaagttgacttaatttcgaaaaccttttagtaacccttgtcttaccttacgtaccaaactaccgaccaaccgacgtaaccgaaccgacccctaaactcaacgttattccgggaatcggacgtaggaacggtccgtaacctggttacggtaccttacgctacgttcgctttcgacctcaacggtcctacggtcacctacccgcgtacctggaccctacggtcaccccggtttaggacggcccgtaggaccgttacgaagggtcctaaggtaacgttccggttacgttacttacgtacgtcctcggaacttacgtaacgaccgtttacggtacttacggtttacgtacccgtttaaaggacccgtttacgttacccggtagttaccccggttaaacggccgggttacccggaaaccgttaacggttaccccgtaacggtaccccgtaaccggttccgaaccccccgttaaccgtaccggtacccccctaaccccg

SEQ ID NO: 8554 - DNA, 719 bp, Homo sapiens
  misc_feature: GYAE6OF02H6IS2.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctccgtggggctcctgctgctctggctctcaggtgccagatgtgacatccagatgacccagtctccactccccctgtctgcatctgtaggagacagagtcaccatcacttcgccgaggcgagtcaggactagttggactaaacttaatttaaagttggtatcaagacaagaaaccgaagggaaaccgaccccgaagcccgtaccgtggtacctaacggcttcgacctaacgtacccgtaaagtttacggaaacgtacggtaaccgtacctaagttaaccgtaagggtttacgaagggtacggtaagggtggtaacgttacggtacggggaactaacgtaacttaccaccttaccgtacctaaccgacttacgaacgttaccgacgtacgtacgtacggcccgttaggtaacttggttaacttttacggaacctttaacgtttaactttaccgttagttaccgtaacgtacgttaaaccgtttaaagtaaacggttacgggtaagttaacggtttacccggggacgggttaaccggggaacggtacggggtttacggaagtaacccgtaacggtaaaccggtagttacggtacgggtacgtacgacctaaccg

SEQ ID NO: 8555 - DNA, 814 bp, Homo sapiens
  misc_feature: GYAE6OF02H300Q.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcgaggacacgagggtcctcgggcccagtctcgccctgactcacgcctcgtcccgtcgtgtcgtcggtcctccgtggactacgtcgactaccaccgtactcctccgtcgaccgtaccgtacggaaccacggacgtagtagtaagttacttaacgtaaaactttaaccgttaaccgttcgttaccttacgttacggtaaccaacgacgacccaaccgaacggaacccaaacccgtaaccccctaaactctaacgttagttacgtttacggacggtaaacgaacggtaacggtaaccggccccggttaccgttacgggttaacggggtttaacctaacggttccgttccgttacgttccgtaccggtacccgttaaccgtaccggtacgtaaccggaccctaccgtacccgtccctaccgtaacgtaactacgttccgtcggtacggtaccgtacggacgtacggtagggaacggtacggtcgtaacgttacgttaacgttacgtacgtacgtcgttacgtacttacgtacgttcgtacgtacgttaacgttactaccgttaacttcgttaccggttcggttaaccgttcgggtaaccggttacggaacccggttaaccggtaccggttacccgtaacggtacccgtaaccggaacccgttaccccgggaaccgttaacccccg

SEQ ID NO: 8556 - DNA, 710 bp, Homo sapiens
  misc_feature: GYAE6OF02GJDWI.37.36.D03.1.454.CMB.1.raw
  modified_base (183)..(183): a, c, t, g, unknown or other
  misc_feature (183)..(183): n is a, c, g, or t
  modified_base (338)..(338): a, c, t, g, unknown or other
  misc_feature (338)..(338): n is a, c, g, or t
tcagtagtgtagatcacgaccggtgctcgatttagctgcgtcacgatctctcttgggggagtcagtcccaaccaggacacagcatggacatgagggtccctgctcagtctccgtgggctcctgtcgtgctctcggcttctacgtaggtcgccagatgtcgacagtccagatcgacccagtccncctacgtccccctgtctcgctactcgtcggtaacggactacgacgagtacctacactactacgttcgccgtaggacgaggtaccaggactaggttcgaactaacgttaatttaacgtggtaactcaacggactaacgaaaccgtacgggaaaccnccccgtaagccttaccgtacggtactaccgacgttcgacctacttaccgtaagtttaacggaaactacggtacgttcccaagttacctaagggtttcgaacgggtagtaaacgtcggtaagtacgtacggtaacttacgtttacttttaccgtctacgttcgaacgtcgacgtctcgaagtcgtacgtggaactacttaagttccgacttaactacgtttacgttacgacgttaccgtaaccacgtacgtacgggaaccctacggttaacgggaacgtaacgggtactaacgttaacgggtaacttaacgggtacttcgggtaacgtacctaacggtcccttaacgtcgttaacccgttttaccggttaccc

SEQ ID NO: 8557 - DNA, 775 bp, Homo sapiens
  misc_feature: GYAE6OF02G0IHM.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcagggtgccagatgtcgacatccagatcgaccagtcctccacctccccctgtcctgcatcgtggtaggacgacagacgtccaacgtactctacttacggccgagggtctaggtacgaggactagttacggactaaactttaagtttaaagttggtactacgaacgacaaaaccgggaaaaccggaacgggaaacccgacccccgtaaacggtccgtccgttacgggtaacccttgtaccgtagtacctacgtaaccgtaaagttacggaaaacgtacggtaaccgtacctagttaacggtaaggttacgtaaggtagggtaagtacggtagttccgtaggggtaacttagtttacttttacgttaactaccgtttacgaacgtacgtacggtccgtacggtacgtacgttacgtaacggaaccgttacttaaggttacctaaactaacgtttaactttacttaacgttaccgttaacccgtaaaccgtaaccgtaagtaccgggttaaacccgtacccggtaacggtaaaccgttaagggttagtaaaccgttaaacggaaccgtaaaaccggttagtaacgggtaccgtaccggtaccgtacctaaccggttacttaccgttacggttaccttacccgg

SEQ ID NO: 8558 - DNA, 574 bp, Homo sapiens
  misc_feature: GYAE6OF02G4MA8.37.36.D03.1.454.CMB.1.raw
  modified_base (210)..(210): a, c, t, g, unknown or other
  misc_feature (210)..(210): n is a, c, g, or t
  modified_base (462)..(462): a, c, t, g, unknown or other
  misc_feature (462)..(462): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccntcctcctgcactggaaccagcagtgatattagaaacttataaccttgtctcttgtaccaacagccacccagcaaacgcccccaaactcatgtatttgtggagacgagtaacgccggccctcgaggggtttactagtcgtcttctctggtcctacagtcgtggccaacgccgtcctcctgacatcctgtcgggtcctcgacggtcgtcggaggaccgaggccttaggtactttagtacctgctgtctactatntgcgtaggtactcgtacttcttattcgttcgttaccggtaacgtcgggtaaccgtacggtcccgtacccggttacgtaacgtccgaaccggtacccgtaaccggtaaccccc

SEQ ID NO: 8559 - DNA, 553 bp, Homo sapiens
  misc_feature: GYAE6OF02I089V.37.36.D03.1.454.CMB.1.raw
  modified_base (319)..(319): a, c, t, g, unknown or other
  misc_feature (319)..(319): n is a, c, g, or t
  modified_base (419)..(419): a, c, t, g, unknown or other
  misc_feature (419)..(419): n is a, c, g, or t
  modified_base (453)..(453): a, c, t, g, unknown or other
  misc_feature (453)..(453): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctgccctgactcagcctgcctccgtgtcgtggtctcctggacagtcgatcaccactccctgcacgtcggaaccagtagtgacgttgatgattatgactatgtctctgttcaacacaccagacaacgcccaatcatactatttgagtcactactcgacctnagtactttctctcgtcttctctcgcctacagtcacgaccaacgaccgtcccttcgtacgacctctctctcggctacgagacgtacggacggacgacggtntagtactttactacgtcgtctacgttctaagtanaggtacgcgaaccataactgtagtacgttacggaacggttcgaacggtacggttacgtcgttaccgtaacgtcgaaccgccaaccggccctaacctaccg

SEQ ID NO: 8560 - DNA, 760 bp, Homo sapiens
  misc_feature: GYAE6OF02HR23G.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcgaggacacgacgggtcctcgggcccagtctcgtccctgacctcacgcctcgccgtccggtgtccgtgggtcctccgtaggacctagtcgactacacctactcctcctgaccacgtacggaaccagcgtagtagtacttagttaaacgtaactttaaactttaaccgtttggttacctccgttaacggtaaaccccaacgtaccggacccaacccggaacggtaacccgaaacccgaacccctaaactacgtagttagttacgtttggacggaacggacgtaacgggtaccgtacccggtacccgtacggttacgggtttactaccggttcctctttccgtccggttacggtcctaccgtacgtccgaccggtaacccaaccggaccgttccctaccgtaacgaactacgtaccttcgggtccgtaccgtcgaccggtggacggacggtacggtaacggtaccgtagttaattacctagtcgtactcgtacttagaacttcgagtacgtacggtactcgtaacctttgttacggttaccgttaccggtaaccgtaccggtaacggtaacgtaaccgttccgtaccgtaaaccgtcggtaacccgaccgtacccggtacctaaccccg

SEQ ID NO: 8561 - DNA, 539 bp, Homo sapiens
  misc_feature: GYAE6OF02GL6U3.37.36.D03.1.454.CMB.1.raw
  modified_base (384)..(384): a, c, t, g, unknown or other
  misc_feature (384)..(384): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactggaaccagcagtgatattgaaacttataaccttgtctcttcggtaccaacagccacccaggcaaaacgccccccaaaatcatgatttgtgaggacagtaagccggccctcgaggggtttctaatcgcttctctggctccaagtctggacaacgccggcctccngacactctcgtggcctcgagtctggacggacggtaggcgttagatttacgtactgtcgtgctacaattagcgtagtagtacgtctacttcttattcgtcgttcggaacgtcgggaaccacggttcacccgtactacgcacgcccgaagacccccg

SEQ ID NO: 8562 - DNA, 843 bp, Homo sapiens
  misc_feature: GYAE6OF02F77RZ.37.36.D03.1.454.CMB.1.raw
  modified_base (250)..(250): a, c, t, g, unknown or other
  misc_feature (250)..(250): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtccttggcccagtctcgccctgactcacgcctcgcctccgtgtcgtggtctccgtggactacggtcgatccaaccacttcctcctgacctaccgtaggaacccngcgtagtgaattatacgtaaactttagttaaccttgttaccttcgttacggtaaacccaaacgacggtacccaaccccgaagggaaccctaaaaccccgacccccctaaaatcctaagtttagtaacgtttttgggaacggtaaacgggaaacgaacggttaaaccgggccccggtacccgttacgggtaccgggggtttactaaccttaacgttccgtccgttttcctaccggtacggtaccctaacgtaaacgttcccgttaacgggacccttaaacccgccccggttacccctttaccccggtaacaccccgttaacttcccgtccgggttaggggcccctaccggggtaggtcccgttaacgggaccggtaaccgggtcgaccgttaaccttaacgttacttttacgacggtaccacgttaccgtaaacctaagtaacctaagaaccgactaaccggtaccttaggttaccgtttaaccggggtttacgggtttcccggggtaacggaccggggtaaaccgcccgggttaaaccgttcggttaacccgtttacgttaccgggaaccctaccggacccgttaacccgggg

SEQ ID NO: 8563 - DNA, 626 bp, Homo sapiens
  misc_feature: GYAE6OF02G37I3.37.36.D03.1.454.CMB.1.raw
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (259)..(259): a, c, t, g, unknown or other
  misc_feature (259)..(259): n is a, c, g, or t
  modified_base (474)..(474): a, c, t, g, unknown or other
  misc_feature (474)..(474): n is a, c, g, or t
tcagtagtgtagatcacgaccggtgctcgatttagctgcgtcacgatctctcttggggggggtcacaagaggcagcgctctcgggacgtctccgaccatggcctgggactctgctgctcctcactctcctcactcaggacacagggtcctggggcccaggtctgccctgactcagcctgcctcgtgtctgggtctcctggcagtcgatcacntctctgcactggacngctagtgactattgaacttataaccttgtctnttcgtaccacagcacccgagacaacggcccccaaagtcatcgtattcgtagagacagtaagccgcctcgtacggggtttacaagtcgtcttctcgtaggctaccgaagttcgtcggtacaaccgccggtaccctcccgtagacctaatccgtacgtcgggtctccgaggctacgggaggacgtggcttagtacttactacgtggtactggcctanacgttatacgcgtaggtacgttaccactttagttacgtcggttaccgttaaccgggtaacgtccggggtaaaaccctagggtacccttaacccgggtttaccgttaaaccgggttccggtaacccggacccgtaaacccgggtaaccccccc

SEQ ID NO: 8564 - DNA, 707 bp, Homo sapiens
  misc_feature: GYAE6OF02FF9T2.37.36.D03.1.454.CMB.1.raw
  modified_base (127)..(127): a, c, t, g, unknown or other
  misc_feature (127)..(127): n is a, c, g, or t
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctccncactcaggacacgagggtcctcgggcccagtctcgccctgacctcacgcctcgcctcggtgtctcgggtcctcgtggacagtcgatccaacnctcctccctgaccncgtacggaaccngtccgagtgacttaacttacgaaaccgtttataaccgtttgcttcgttacgacctaaacgcgccaacccgacggaccaaaccgaccccaaatacgtatacgtagtttgtacggaacggtaacaacgtaaccggccggtaccctagggttacggggttaccttaacgccgttacttccgtacgtcggtcctaccgaagttcgtacggaccctaaccgtcccggtccctaccgagtaaccgtacttccgtccggtacgtaccgtccgtagtcggtacgacggtacggcgtacgttacgtattacttaccgtctacgttacgcttacgtattaccgtcgtaacgtacttaccgtcgttaccttagttcgtacccgtggttaaacccggacgtaaccgggtaacctcgggttaacccctaacggtccttaacggcccgaacccgtaacccggacccgtaaaccccc

SEQ ID NO: 8565 - DNA, 671 bp, Homo sapiens
  misc_feature: GYAE6OF02FW65P.37.36.D03.1.454.CMB.1.raw
  modified_base (216)..(216): a, c, t, g, unknown or other
  misc_feature (216)..(216): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgactcacatcctcngcacgtaggaaccagcagtgatatagaactataaccttgtctacttcggtaccaacagccaccgagacaaacgacccccaaatcatgtaactttggtagacggaactagtaacggccggtaccctcggtaaggggttttactaacgtccgtacttccgttcgtggtacctacaaacggtcgttaacgacgaaaccgtaccgggtccctacccgtgaaccgtacttcgtaccgtcggggacccttacgacgggtcctagggaggaaccggagggtacttaaggtaacttaacgttctcgggtcttcggacctacgtaagtagtcgtacgtaacggttacgttactacgttctttagttacgttaccgttaaccgggaaacgttacgggtaaaccctacggttaaccctcccggttaaccgttaacgtacacccggtaacccggactaaacccccgg

SEQ ID NO: 8566 - DNA, 723 bp, Homo sapiens
  misc_feature: GYAE6OF02JX0QM.37.36.D03.1.454.CMB.1.raw
  modified_base (154)..(154): a, c, t, g, unknown or other
  misc_feature (154)..(154): n is a, c, g, or t
  modified_base (280)..(280): a, c, t, g, unknown or other
  misc_feature (280)..(280): n is a, c, g, or t
tcagtagtgtagatcacgaccggtgctcgatttagctgcgtcacgatctctcgttgggggggtcacgaagaggcagcgctcgtcgggacgtctccaccatcggcctgggctctgctgctcctcactctcctcactcaggacacgacgggttccngggcccagtctgccctgactcagcctgcctccgtctgggtctcctagggccagtcgaactcaaccctgtctacctagcgaacctggaaccctaggcaagttgacgtttgtagttataagtatggtntctggtacctaacactcactaaccactcgaccaaggccaaaaagttcccccccgtaactactaacgttacgtagacgtacacgtaaacggaccgttacaacggtacgtttcaccgtcgttcgtacgtcgtctaccgtaacgttaccgtacggtacctaaccggaccgtacccgtaccgtaccgtaacccccgttaccgtacggtccggtcctaaccggtaccttacggaacgtacgaacgttctaaccgtacttaacgttacttacggtaacttacgaccttaacgtaacttaacgaaccgtacgttacgacggttaccgaacgttaccggttacggtacgaaacggtttccggggaaccggttaccgggtaaccggaacccggtttaccgtacccggttaccggtaccggtaccgaaccggtcccgtaccggtacccgtccg

SEQ ID NO: 8567 - DNA, 585 bp, Homo sapiens
  misc_feature: GYAE6OF02GY6B0.37.36.D03.1.454.CMB.1.raw
  modified_base (429)..(429): a, c, t, g, unknown or other
  misc_feature (429)..(429): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatcctcctcgcactggaaccagcagtgatattagaaacttataaccttgtctcttaggtaccaacagccaccaggacaaacgccccaaactcatgtattgtgagacagtaacgcgccctgtacgggtttactatctcttcgtctcggctacagtcgtcgaccacgaccgcctcctagactactcgtcgtggtcctcgagtcgtaggacggtacggacgngtagtaattacttacgtcggctagtactctacttagtcgtacgtacggtacgtcttacgttactttagttcgttacgttacggtaaccggttacgggaaccgtacggtaccttaccggtaccgttaacgtcgaaccgtacccgaccgtaacccccg

SEQ ID NO: 8568 - DNA, 756 bp, Homo sapiens
  misc_feature: GYAE6OF02G7U6S.37.36.D03.1.454.CMB.1.raw
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtctcgcctgactcagcctgcctccgtgtcgtgggtctccgtggacagtcgatccacctatctcctgccacgtacggaaaccagcgagtgaattagttagtaaaactttactaaccttgttacttcgttacggtaaccaactacgaccaacccgaacggaaccaaaccgacccccaaactacagttcgtaagtttacggtagaaggaacgtaacgtaacggccggtacccgtaggtacggggttttacctaacgtccgtactttccgtcgttacggacctaccgtaagtaccgtacggaaccgaaaccggtcccggtaccccttcccgtaacgtacccgtaactccgttaccgtacgggtaccctaacccgaaacccgtagggaaaccggtacggacgtaccgttacctaacttaagtttacgtcgtacctaacgttactaacgtacgtaaactaaccgaacgtacgtcgtacgttcgttacggggttcggttacgggttaccgggtaccgggacgggtaacccgtacgtaaccggtaccggtttgtaacccgggtcgtaaaccgcccggtaacggtcccgttccccggttacccccgg

SEQ ID NO: 8569 - DNA, 551 bp, Homo sapiens
  misc_feature: GYAE6OF02FH9IV.37.36.D03.1.454.CMB.1.raw
  modified_base (310)..(310): a, c, t, g, unknown or other
  misc_feature (310)..(310): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattgaaacttataaccttgtcttcttggtaccaacagccacccaggacaaacgcccccaaactcatgatttgngaggacagtaacgccggcctgaggggtttctaagtcgcttctcgtgctcaagtctggcaacgcggccctcctagacaatctcgtcgggcctccgaggctggaggacgaggcttagatttacttactgtctgtctgtatagtcgacgtaggtacgtctacttctttagtcgttcgttacggaacgttcgggaacctacggtactacccggttacctaaggtccacgtacccaacggtacccc

SEQ ID NO: 8570 - DNA, 651 bp, Homo sapiens
  misc_feature: GYAE6OF02JD55F.37.36.D03.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctcgtgtctggtctcctggacagtcgatcaccntctcctgcactggaaccagcagtcgatattgaaacttntaaccttgtcttcttggtacccaagacgcacccgacggtacaaaccgccccaaacgtcacgtctattcgtgacggactagtaacggccgtcccgtacgtacggggtttactaacgtcgtcctttcgtctggccgttacaacgttcgtacggaccgtaacccgtaccgggtcctttcccgtacgaccctacttccgtccgttggggacccttccgacgtactcgggaacggtacgacggtcctaggtacttagttacgtcgcgttagtactacgtaatacggacgttccaaccgactacttacgtcgttacgttacggacggtacgggtaaccgtaaacgttccggttaccgttaaccgtaacggtccgttaacccgacccgtaacggaccccctaaccgtacccg

SEQ ID NO: 8571 - DNA, 867 bp, Homo sapiens
  misc_feature: GYAE6OF02IJJ2J.37.36.D03.1.454.CMB.1.raw
  modified_base (209)..(209): a, c, t, g, unknown or other
  misc_feature (209)..(209): n is a, c, g, or t
  modified_base (241)..(241): a, c, t, g, unknown or other
  misc_feature (241)..(241): n is a, c, g, or t
  modified_base (322)..(322): a, c, t, g, unknown or other
  misc_feature (322)..(322): n is a, c, g, or t
tcagtagtgtagatcacgaccggtgctcgatttagctgcgtcacgatctctcgttgggggggtcacaagaggcagcgctctcgggacgtctccacatggcctgggctctgctgctcctcactctcctcactcaggacacgtagggtcctgggcccagtcctgccctgacctcacgcctcgcctccgtgtcgtcgggtcctccgtggacngtcgatcaccatcctctgacacgtaggaaccngcagtgattatagaaacttactaacttgtctcgttcgtaacaacagccaccgacggacaaaccgtaccccaacgtcacgtntatttgagagacaagtacgccggtacctcgttacgggttactaacgtccgtcttccgtacgtcggtaccttaccgtaagttcgtacgacctaaccgaccggtccctaccgtcgaactacttaccgtcgtcgggtcctaccggtacgggtaccgtacgggaaccggtacggtacgggttaccgtaaacggttttaaccgttttaacgtttaaacccgtaccggttccgggttttaccggacccttttaaccgtaaaccgtttaaccgggtttaccgtaaaccggggtttacggggttttaaaccccgtaaccgtttaaaccccgtttttacgtttaccggttttaccgggttttttaacccgggttaaaccccggggtttaaaaccccggggttacccggggggttaaaacccccccggtttaaaaaccggggtttaccccccgttacccccggggttttaaaacccccggtttaaccgggttaacccccggtaaacccggggttaacccccccccggtaaaacggggttaaaccccccccccccg

SEQ ID NO: 8572 - DNA, 683 bp, Homo sapiens
  misc_feature: GYAE6OF02H37PV.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcgaggacacagggtcctgggcccagtctgccctgactcagcctgccctccgtgtctgggtctccgtggacagtcgatcaccatctcctgcactggaaccagcagtagattattagtaaactttacttaaccttgttcttacttacggtaaccaacacgtaccacccgaggacccaaaaccgacccccctaaaactcctaattgtaacgtttggtacggtacggaacgaaggttaacggcccggtccttacggtagggtttactaacgtcgtcttctcgtcgtctaccgtagtcgtcgacaccgacggtcccttccgagactactcgtacgtcggccttaccgaggtcgtacggtacgggaacgcggttaccgtaggttaactttacgttaactcggtaccttcgttacagtttacgtcgacgttaccggttagtacctaccgttacgtttacttcgtttaccggttacggtaaccgtacggtaaccgtaccgttaccgacccgttacgtaacgttccgaacccggtaccgtacccgacccctaaacccccg

SEQ ID NO: 8573 - DNA, 693 bp, Homo sapiens
  misc_feature: GYAE6OF02JXOJW.37.36.D03.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (517)..(517): a, c, t, g, unknown or other
  misc_feature (517)..(517): n is a, c, g, or t
tcagtagtgtagatcacgaccggtgctcgatttagctgcgtcacgatcgtctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacngtcgatcaccntctccngcactggaaccagcagtgatattgtaaaacttataaccttgtcttcttcggtaaccaacagccacccgaggaccaaacgtcccccaaaactcaatcggtaatttggtacgaggacaggtaacgcggcccttgaacgggggtttctaaagtccgtcgtttcctcggttcgtacgtaccaaggttccgttaggacccaaacgtcgggaccccttcctcggaactaactccgtcgtgggtcctcgaacgtcgttacggacggttaacggcgtactacggtaactttacttataccgggttancggttcttacaacggttttcgaacggttacgggaccttaaacgggtaaccgttccctttaggtacggtttctttaccggggtaacggtttaccggaacggggtttaacccgtaaaggttacccgaccgtttaacgacgtttacccgtacgttaccccgggtaaactaaccccccgg

SEQ ID NO: 8574 - DNA, 678 bp, Homo sapiens
  misc_feature: GYAE6OF02JW2T0.37.36.D03.1.454.CMB.1.raw
  modified_base (257)..(257): a, c, t, g, unknown or other
  misc_feature (257)..(257): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgacgggtcctgggcccagtctcgccctgactcagcctgcctcgtgtctcgggtctccgtggacagtcgatcactctctcctagcacgtggaaccagtcagtgattatagaaacttntaacttgtcttctaggtaccaacagccaaccacggacaaaccgaccccaaactcagtgtacttgtagaggacaaggtacgccggtcctaggtacgggttactacgtcgtcttcgtcgtcggccttacgagtcgtaggaccaacgaccggtcctaccgtagaaacctagtcctcgacgggccttccgcgggtcgaggacgggaacgcggtactaggttaacttacgttcgtacgtcttcgacttacgaagttacgcggtacgtaagttacgtaccgttcgtttaacttcgggttaccggtttccgggttaaacggtacccgggtttaacgggaaccccgtttaaggggtaccccgttaaacccggttaaccggtaaccggttacccgaaccggttaacccccggaaaccggtaaccccccgg

SEQ ID NO: 8575 - DNA, 761 bp, Homo sapiens
  misc_feature: GYAE6OF02FHLSK.37.36.D03.1.454.CMB.1.raw
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (561)..(561): a, c, t, g, unknown or other
  misc_feature (561)..(561): n is a, c, g, or t
tcagtagtgtagatcacgaccggtgctcgatttagctgcgtcacgatctctcgttgggggggtcacaagaggcagcgctctcgggacgtctcaccatggcctgggctctgctgctcctcactctcctcactcaggacacagggtcctagggcccagtctcgccctgactcagcctgcctccgtgtctgggtcctccgtggacagtcgatccaccntcctcctgcactggaaccngcagtgactattgaacttataaccttgacttcgttggtaaccaacacgccacccaggacaaacgccccaaatctatgtattttgagacgacgtagtaacggtccggacccttcggtacggggtttactaaagttccgcgttcctcgtcggtaccttaccgtaaagttccgtacggtaccaacccggtaccgggtcccttacccctttaaggaaccgtaaacgttccgtttccggtacggggttaccctacccggacggggtacccgttagggaaacccgggtacggaacgggttcccgttaaaggtacctttaagttttaacccggngtacccgttagggtacccttctaaaacctttaggttacgtacggtaaacgggtttacttaccctaaccgtttagtttacgcggtttaccggttaacgggggtaaccttacggggtaaacccccggttaacggttacccgtaaccccgggttacctttaaccgggtcccgtaaccggaccccggttaaacggaaccccccc

SEQ ID NO: 8576 - DNA, 525 bp, Homo sapiens
  misc_feature: GYAE6OF02G3VYI.37.36.D03.1.454.CMB.1.raw
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (448)..(448): a, c, t, g, unknown or other
  misc_feature (448)..(448): n is a, c, g, or t
  modified_base (491)..(491): a, c, t, g, unknown or other
  misc_feature (491)..(491): n is a, c, g, or t
  modified_base (516)..(516): a, c, t, g, unknown or other
  misc_feature (516)..(516): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatgacccagtctccactcccccctgtctgcatctgtaggagacagagtccaccatctacttcgccgaggcgagtcaggacagttggcaactatttaattggtatcagacagtaaaccaagggaacgccccaagctcgtgtcagctgcatccaattgaaacgagtagtccatcaaggttcagtggaagtggtatcggtaggataagttattttacgttacctacttctagtcacgtcgtntacngttacagaagtaactgtcgactaactatactttattctacaactacntacgcgtacctagggaactaagtagacttagaacgaacgtacncgggtagcgtacgaccaccgtactnttgtactcg

SEQ ID NO: 8577 - DNA, 617 bp, Homo sapiens
  misc_feature: GYAE6OF02GAHVU.37.36.D03.1.454.CMB.1.raw
  modified_base (239)..(239): a, c, t, g, unknown or other
  misc_feature (239)..(239): n is a, c, g, or t
  modified_base (277)..(277): a, c, t, g, unknown or other
  misc_feature (277)..(277): n is a, c, g, or t
  modified_base (427)..(427): a, c, t, g, unknown or other
  misc_feature (427)..(427): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatccaccatcctcctgcacgtggaaccagcagtnatattagaaacttataacttgtcttcttcggtaccaanagccacccaggaccaaaccgacccccaactacatagtattgtgagacaagtacgcgccctcgtagggttactaagtcgcttcctcgtcgctacctacgtctcggacaaccgaccgtccctcctacgaactaacttcgtaccgtcgggtcnccgtacggtactcggagggaaccgtaggcttaggtatttacttacgtgtcgtcgtcctctaacgtagttacgacgtaggttacgtacttacgttctttagttccgtaccggttacggaccgttacggggaaccttaaccggtccgttaccgtaccgttacggtaccgaccgacccgaaccggtaaccccc

SEQ ID NO: 8578 - DNA, 710 bp, Homo sapiens
  misc_feature: GYAE6OF02GF0XW.37.36.D03.1.454.CMB.1.raw
  modified_base (435)..(435): a, c, t, g, unknown or other
  misc_feature (435)..(435): n is a, c, g, or t
tcagtagtgtagatcacgaccggtgctcgatttagctgcgtcacgagtctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtcctcctggaccagtcgatcaccatcctcctgcactcggaaccagcagtgattatagtaaacttataaccttgtctcgttcggtaccaacacggacctacccaggaccaaacggtcccccaaaactcctaatgtatttgtacggagtaccgaagtaacggccggtccctcgtaggggtttacctaagtccgtctttcgtcgtcggctaccgaagtcgtacggacctaacgaccgtccctccgtanactaactcctcgtcgggcctacccgtggctagggacggacggtaggcttaggtaactttacgtacccgtgtaccgttcgtcctacgtaagtacgttcggaagtaacgggtttacgtacctaaccgtttacgtttacgttccggtttcccgttaacggggtaacccgggttacggggtaaaccccggtaacgggtttacccccgtaacccggtttaacccccgttaaggttcccccgtaaaaccccgggttacccccgaaccggttaacccccccg

SEQ ID NO: 8579 - DNA, 738 bp, Homo sapiens
  misc_feature: GYAE6OF02HO4XL.37.36.D03.1.454.CMB.1.raw
  modified_base (254)..(254): a, c, t, g, unknown or other
  misc_feature (254)..(254): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgtacgggtcctgggcccagtctcgccctgactcacgcctcgccctcgtgtcgtcgggtcctcgtaggactacgtcgactccaaccactcctcctgacctaccgtacggaaccngacgtagtagtaactttagttaacgtaaacttttaacgttaactttcgttaccttacggttacgaaccgtaacgacgaccaaccggacggaaccaaaccccgaccccctaaatcgaagttgttaacgttggagaacgtacgaaggtaccgccggtaccgtaggtacgggtttactacgttccgtcttacgtcgtcggtctacgtactacgacgaccaccgtaccgtcccttacgactaactcgttacgtcggtcggtccctaggtaccggtcgaacgggacggtacggcgttacgttacgtttaagttaccgtatccgttcgtacgtaccgttactaggtacgtaccggtaagttcgggtacttacctaccgtttgttaccgttcgggttaaccggtacggaccggttaaccggtaacgtaacccgtttaccgttaccggaccttacccggttacaaccccggttacccgaaccccgtaacccg

SEQ ID NO: 8580 - DNA, 579 bp, Homo sapiens
  misc_feature: GYAE6OF02GBTSR.37.36.D03.1.454.CMB.1.raw
  modified_base (309)..(309): a, c, t, g, unknown or other
  misc_feature (309)..(309): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatattagaaacttataaccttgtctcttggtaccaacagccacccaggacaaacgacccccaactcatgattgngagacagtaagcggcctcgtagggtttctaagtcgcttctctggctcaagtcgtggcaacacggccctcctagaacctatcctcgtgggctccgaggctaggaggcgagctagtattattactgtcgtgcctacatagtcgcgtaaggtacttactaccttactttagtcgttaccgtttacgggaacgttaccggggaacccttaacgggttacccaacccggtttaccgtaaacgtcccgtaaccggtaccccgaaccgtaccccccg

SEQ ID NO: 8581 - DNA, 728 bp, Homo sapiens
  misc_feature: GYAE6OF02F0Q3W.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctcgggcccagtctcgccctgactcagcctcgcctccgtgtctgggtctcctggacagtcgatccaccatcctcctgcactggaaccagcgagtgattattagaaacttactaaccttgtcttcgttacgtaaccaacacgccacccgacggaaccaaacccgaccccccaaaatcctaattcgtaagttttcggtaggaacggaacgtaacggttaacggccccggtacccgttacggttaacgggggttttactaaacgttccgtactttccttcgtcggtaccttaaccgaagttccgtacggaacccgtaaccggaccccggtcccttacccgtacgtaacctaacgtttccgtaccggtggggtaccctccgacggggtccgtagggaacgggacggtaggtcttacgttaactttacttcgtacggcttcggtaccttacgtattgtcgtacgtacggttactcctactttacgttacgttggtaccgtttaacgggaccggttacgggaacccgttaacggttcccgtacccgttaccgtaccgtacgacccggtacccgaaccgtaaccccccg

SEQ ID NO: 8582 - DNA, 563 bp, Homo sapiens
  misc_feature: GYAE6OF02FZVRA.37.36.D03.1.454.CMB.1.raw
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacagtcgatccaccatctcctgcactggaaccagcagtgatatgaaacttataacttgtctcttgaccacancaccagacaacgccccaaatcatgtacttgngaganacgtagccgcctacgtaggttactatcgtcttctcgtgcctcaagtcagccacgccgtcctcctagactctctcgtggcctcgaggctggacggacgtacgctagtacttagtctgctacgtctactagtactgtcgtaaggttactacttaccgttactttacgttcgttacggttaaccggacgttaccgggaaaccgttacggtacccgtaccgttaccggttaccaccggacccgtacccgaccggtaaccccccg

SEQ ID NO: 8583 - DNA, 756 bp, Homo sapiens
  misc_feature: GYAE6OF02H6ZZX.37.36.D03.1.454.CMB.1.raw
  modified_base (240)..(240): a, c, t, g, unknown or other
  misc_feature (240)..(240): n is a, c, g, or t
  modified_base (569)..(569): a, c, t, g, unknown or other
  misc_feature (569)..(569): n is a, c, g, or t
tcagtagtgtagatcacgaccggtgctcgatttagctgcgtcacgatctctcgttgggggggtcacaagaggcagcgctcgtcgggacgtctccaccagtggccgtgggctctgctgctcctcactctcctcactcagacacgagggtcctcgggcccagtcctcgccctgacctcacgtccgtgccctccgtgtcgttcggtcctccgtaggacaggtccactcacctcgtcctccgtnaccagtacggacacgtgtaggtataattcgtaacgttaaacttacttaaccgtgtttacctcgtaccggtaaccaacgaccgaccgaacccaacggaacctaaacccgtaccccctaaactacgtaagttacgttaagtttcggaaggaaccggaacgtaacggttaccggcccgttacccgttacgggtttaacggttacgttacgtccgtacctttccgtcggttacgtcccgtaacgtacgttaccgtacgaaccgtaaccgtaaccgtccctaccgtacaacgttactccgtacgtcggccttcgacgtcaggtacgacgcggtntacgttaacttcgtacagttcgtcgtacgtacgtataggtcgtacgtaacggtcgtccgttacgttaccgtagttccggttaaccggtaaccggtacgtaacccgggtaacccgtacccggtaaccgtttacccggtaaccggttaccgtcccgtaaacccggaccccggtaccgtaaaccccccgg

SEQ ID NO: 8584 - DNA, 734 bp, Homo sapiens
  misc_feature: GYAE6OF02H1QYR.37.36.D03.1.454.CMB.1.raw
  modified_base (202)..(202): a, c, t, g, unknown or other
  misc_feature (202)..(202): n is a, c, g, or t
tcagtagtgtagatcacgaccggtgctcgatttagctgcgtcacgatctctcttgggggagtcagtcccaaccaggacacagcatggacatggagggtccctgctcagctcctggggctcctgctgctctggctctcaggtgccagatgtgacatccagatcgacccagtcctcccacccccctgtctgcatcgtgtagganacgagtacgtccaccatccacgttgccgaggcgtagtcgaaggtacctgtttacggactaaactttaagtttaaacgtggtaatcgagaccaacggaaaccgaacggggtaaaccacccccgaaagtcctaccgttacgggtacctaaccgtctcggactaacttaccgtaaagtttacggaaaaccgtggtaacctaccctagttaaccggtaacgttacgtaagggtagggtaacgtacggtacgtacggtaagggaccttaaggtttaactttttaccttcctaaccgtttacacgtactacggtcctacggactacgtcgtaagtaagtctagttacgactaacgtactacgtttaacgtccgtaaaccgaacctaccgtaggttaacccgggtaacccggtccgggttaaaccgggaaacccgttaagggtacgtacgttaaacgtacccggaaaaaccggttcgtacggggtacgtacctacggtaccctaaccgtactttcccggttatcccgtttacctaaccg

SEQ ID NO: 8585 - DNA, 651 bp, Homo sapiens
  misc_feature: GYAE6OF02IUJD9.37.36.D03.1.454.CMB.1.raw
  modified_base (174)..(174): a, c, t, g, unknown or other
  misc_feature (174)..(174): n is a, c, g, or t
  modified_base (209)..(209): a, c, t, g, unknown or other
  misc_feature (209)..(209): n is a, c, g, or t
  modified_base (275)..(275): a, c, t, g, unknown or other
  misc_feature (275)..(275): n is a, c, g, or t
  modified_base (320)..(320): a, c, t, g, unknown or other
  misc_feature (320)..(320): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcaccctctcactcagggcacagggtcctgggcccagtctgccctgactcagcctncctcgtgtctgggtctcctggacagtcgatccacntctcctgcacgtcggaacccgcagtgtacggttggtagttaataaatatgtctcgttacgacaacntacacaacactcaccgagacaaacgtcccaaatctattaattacngacgtacaaccgtaacgcctataacggtactttcaactcgtctttacgtctcggcctaccgtaagtcgtacggcctaacgtccgcccttcctacgtaaccacgttcgtccgtggtccctaaccgtaccgttcggaacggtacgacggtccttacgtaactttacttaacgtcgacgtacgttacctactaacgttactaacggacgtacgaccgtcgtacgttacgggttgggttacggtaccggggtaacgggtacccggtaccgtacccggtacgttaccggtaccgttacgggtacccacccggacgttaccggtcccgtaccccggg

SEQ ID NO: 8586 - DNA, 613 bp, Homo sapiens
  misc_feature: GYAE6OF02HWDFM.37.36.D03.1.454.CMB.1.raw
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (323)..(323): a, c, t, g, unknown or other
  misc_feature (323)..(323): n is a, c, g, or t
  modified_base (458)..(458): a, c, t, g, unknown or other
  misc_feature (458)..(458): n is a, c, g, or t
tcagtagtgtagatcacgaccggtgctcgatttagctgcgtcacgatctctcgttgggggggtcacgaagaggcagcgctctcgggacgtctccaccatggcctgggctctgctgctcctcacctctcctcactccaggacacgacgggtcctgggccccagtctgccctgactcagccctgccctcgtgtctcggggttcctccgtaggacgagtcgatccaaccattcctccgtgactacagggaaccagctaggtnatatataacttatacttntctacgtacgacaacacaccacgacgaaccaaacaccccaatcatntatgtagagacagacgcgtccgtagtacggttactagtcgtcttcgtcgtcgactacgtagcgtacgacaaccgccgtcctccgtagtaactactccgtacgtcggacctccgaggcgtaggaaggacgtaggtntagttaattacgtctacgtcgtacgtactacgtacgtagtcgtacgtaaggtactacttacgttgtttacgttattaccggtaacggaacgttacgggaaccgtaaccgtaccgtaaccgtacgtaaccgtacgaaccgaccggtaacccaaccc

SEQ ID NO: 8587 - DNA, 711 bp, Homo sapiens
  misc_feature: GYAE6OF02IM3E2.37.36.D03.1.454.CMB.1.raw
  modified_base (120)..(120): a, c, t, g, unknown or other
  misc_feature (120)..(120): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctnactctcctcactcaggacacagggtcctgggcccagtctgccctgactcagcctgcctccgtgtctgggtctcctggacagtcgatcaccatcctcctgcactaggaaccagctagtgatattagaaacttataaccttgtctcgttacggtaccaacacgccaacccgaggaccaaaccgacccccaaaactcagtagtacgtttgagagacgaagtaacggccgccttacgtagggtttctaagtcgtcttcgtcgtcggcttaccgaagttccgtaggaccaaaccgacgggtccccgttaccgtacgaaaccttaacgtccgttccgtcggggtacccttcccgggaacggtccgtagggaacgggacggtaaggtccttaggttaaactttacgttacgtgtacgttcgtactacgtaattacgtacgtacgttaaacgggtactaccgttacttacgttacgttacgtttacccggttaacgggttaaccgttacggggaaacccgttaacgggtaaccccttacccggttaacccgtttaaacgtaccccggaaccgtacccccggtaaccggtaaaccccccc

SEQ ID NO: 8588 - DNA, 712 bp, Homo sapiens
  misc_feature: GYAE6OF02FZ6HE.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacgagggtcctgggcccagtctgccctgactcagcctgcctccgtgtcgtggtcctctggacagtcgatcaccatcctcctgcacgtgaaccagcagtgatattacgaaacttactacttgtcttacgttcggtaaccaactacgaccacccgtacggaacccaaaacccgacccccctaaaactaccgtagttacgtagttttagtacggaacggtaacgaaggtaacggccggtaccccgtacgggttaacggggttttactaaacgtccgttacgttcgtacgtcggtacctaccggtaacgttccgtacggaacctaaccgtaccggtcccttaccgtacgtaactaacgttcgtaccggtcgggtacctcggacggtctaggacggacggacgtcgtagtaccgttaattcgtcgtactcaccgttacgtaattacgtgtaacgtaacggttagtaccttacgttactttacgttacgttaccgttacgggtaacgttaccgggtaaccttagggtaccctacccggttaacgtacggtaccgaacccggtaccgaacccgtaaccccg

SEQ ID NO: 8589 - DNA, 778 bp, Homo sapiens
  misc_feature: GYAE6OF02HCH0N.37.36.D03.1.454.CMB.1.raw
  modified_base (148)..(148): a, c, t, g, unknown or other
  misc_feature (148)..(148): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgcagatgngacatccagatcgacccagtcctccacctccccctgtctgcatcgtggtaggagacgagacgtaccacctatcctacgttcgaccgaggacgacgtaccgaggtaactagttacggaactaaacttttaaagtttaaagttaggttactacaaggaaccgaaacggtaaaacccggaacggggaaacccgtacccccgaaggtcccgtaccggtacggtaccgtacgtcgtacgaccttaactaccgttaaagttaacggaaacgtacggtacctaccgtagtaccgtaaggttacaaggtacgggtaagtgtacgtacggtacggtaacgtttagtttaacctttttaccgttaccctaaccgttcgacgtaccgtacgtacgtcggtactacgtacgtaagaacgttccttaagtcgaactaaacctttcgttaactttacgttaaccgtacctaaaccgtaccggtacgttaacccggggcccggttaaccccggtaaaggggtaacccttaaagggttaccgggtaacttaaccgggtaaacctaaacgggttaaccgttcgggacccgttacggtaaccgacccgttaaccggttaccttacgtttccgttaacccgtttacccg

SEQ ID NO: 8590 - DNA, 813 bp, Homo sapiens
  misc_feature: GYAE6OF02HN6I8.37.36.D03.1.454.CMB.1.raw
tcagtagtgtagatcacgaccggtgctcgatttagctgcgtcacgatctctcttgggggggggtcacaagaggcagcgctctcgggacgtctccaccatggcctgggctctgctgctcctcactctcctcactcaggacacgagggtcctgggcccagtctcgccctgactcacgcctcgcctcgtgtcgtcgggtctccgtggacaggtcgactcaacctactcctcctgcaacgtacggaaccacgcgtagtacgtattagttaacgtaaactttaacttaaccgttgttctacgttacggaacctaaacgacgtaccgaacccgtaacggaacccaaaaccgaaccccctaaaactaccgtaaacgttacggttaagtttacggtacgggaacggtaaactaacggaaaccggtccggtaccctacgggttaaacggggtttacctaaacggttcgtaccgtttaccgtccggtacggtaccttaaccggtaagttccgttacgggaaacctaacccggaacccgggttccccttacccgacgtaaacccgttacgtttaccgtcggttacgggtacccgtacgtaacgggtcgtaacggggacggaacggtacggtaacgtaggtttaaccttaacgttacgtacgtacgttacgtaccttacgaacgttagtaccgttaacgtacgggttaactaacggttcctttagttacggttacggtttacggttaacggtaccggtaacggtaaccgtaccgtaccggtaacccgtaacgtacgtacgaacccgtaccggtaacccggtaccc

SEQ ID NO: 8591 - DNA, 737 bp, Homo sapiens
  misc_feature: GYAE6OF02GM4ON.37.36.D03.1.454.CMB.1.raw
  modified_base (286)..(286): a, c, t, g, unknown or other
  misc_feature (286)..(286): n is a, c, g, or t
tcagtagtgtagatcacgaccggtgctcgatttagctgcgtcacgatctctcgttggggggggtcacaagaggcagcgctctcgggacgtctccaccatggccctgggctctgctgctcctcactctcctcactcaggacacagggtcctgggcccagtctcgccctgactcagcctgcctcgtgtcgtggtctcgtggacagtcgatcaccatctcctgccacgtcggaaccagcagtcgatagttagtaaacttattaacctttgtctcttacggtaccctaanacgaccaacccgacggtaccaaaccggccccctaaaacgtccaacgtagtactttggtacggaagtaacgaaggtaacgcccgggtaccctacggtacggggttttacctaaacgtccgtacgttccgtcgttcggtaccgttaccgaacgttcgtcggaacctaaacggacccgtccccttacccgagtaaccctaagtccgttacgtccgggtacctacgacggtacgtcggaacggacggacggtcgtacggttaacttagttaccgtgtactagtaccttactattacggacgacgttaggtttaccgtaaccttacgttaccgttacgttcggttttaccgtaaccggggtaaccggttacgggtaaccgttaaccgggtacccttaacccggttaccggtaaaccggtccccgtaacggtaccccggtaacccggtaaccccccg

SEQ ID NO: 8592 - DNA, 763 bp, Homo sapiens
  misc_feature: GYAE6OF02HB74F.37.36.D03.1.454.CMB.1.raw
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgacgggtccgtcgggcccagtctcgccctgactcagcctncctcgtgtcgtggtctctggacagtcgatcacctntcctctgcactacggaccagcagtnattataagtaactacttaacttgtacttcgttacggtaacccaacgtacgacccaacccgaacgggtaaccaaacccggaccccctaaaaccttccgtaacgttaggttacggttttaggtacggaacgggtaaccaagggtaacccgggtccccggtacccgttaccgggttaacggggtttaccttaaccgtccgttacttccgtcggttacgtccctacggtacgttccgtaccggaccaaccggtcccgtcccttaccgacgtaacctacgtccgttacggtccggtcctaccggtacgtccggtaaggaccggacggtacggtacttagttactttaccgtctacgtcgttgtaccgtacgtacgaggttcaacgggttacgttacgtaccgttaccttacttacggttaccgtttacggtaccggggtaaccggtacggtaacccggtaccggtaaccgttaccccggttaaggtacccgtacccggaacccgttacccggaacccgtaacccccg

SEQ ID NO: 8593 - DNA, 838 bp, Homo sapiens
  misc_feature: GYAE6OF02GR8YQ.37.36.D03.1.454.CMB.1.raw
tcagtagtgtagatcacgaccggtgctcgatttagctgcgtcacgatcgtctcttgggggagtcagtcccaaccaggacacagcatggacatgagggtccctgctcagctcctggggctcctgctgctctggctctcaggtgcctagtatgtgacagtccagatcgacccagtctaccgactcccccgtgtctcgctactcgtggtacggagacgagtacgtccacactctaccttcgaccgaggacgacgtacgacggtactagttacggactaaactttaactttaaagttggtaacctacgtacggtactaacggaaacccggtaacgggaaacccgaccccccgaaggtaacccgtccggtaacggttaccgtaaccggtccgtacgtaccgttaaccgttaaccgttaaacgttttaacggaaaaccgtacggtaaccgttacccgtaacttaccggttaaacgggtttacccgtaaacggtagggttaaacgggttggttaaaccgttacggtaaccggggtaacgtttaacggtttaccgttttttaacctttaccctttaaccccgttagacggttacccgtaacggtccctttagaccgttacgtaccgttaacggaacggtacgttaaacttccgggaaactaccgtactttacgtttaaccgttacgaacccgtaacgtaacctacgggtactaaacccgggtacccgtaaacgggtacccgttaagggtaccgtaaactttacggtaaccgaaaaccgggtaaccgtgggttacccgacgtttaccgaacgttaccgggtctttacgttaccggtatttaacccgg

SEQ ID NO: 8594 - DNA, 789 bp, Homo sapiens
  misc_feature: GYAE6OF02JH8MC.37.36.D03.1.454.CMB.1.raw
  modified_base (126)..(126): a, c, t, g, unknown or other
  misc_feature (126)..(126): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcacctntcctcactcacggacacacgggtcctgggcccagtcttcgccctagacctcagcctcgcctcgtcgtctgggtcctccgtggacagtcgatccaacctattccgtccgtcgctaccgtggaacccagccagtcgaattacgttacgtaaacgttacttaaccgtttggtacctttcgttacggttaacccaaacgtacggaccaacccggacggaaccctaaaccgtacccccaaaacttccgaagttcgttaacgtttaggtacggaaacgacgtaaacgggttaccggaccggttaccccgtacggtaacgggttttacttaacgtcccggtactttccggttaccgtcgttaccgtaccgttaacgtccggttaacggcccgtaaacccgtccgggtaccccgtttacccgaggtaaaccctaacgttccgttaccggtacgttacccggttccgaaggttaccgtacgggaagaacccgggtttaaggaccgttaccgttaagtttaaacttacggtccgtaacgttcggtacccttaagtacgtttggccgtacgtaaaggttcttaaccgttcttaccgttagttggtaacccggttcggtaaccggtcggaaccgttacgtccgaacgttcgaactaccgcgtaccgacctacccg

SEQ ID NO: 8595 - DNA, 730 bp, Homo sapiens
  misc_feature: GYAE6OF02G7OUY.37.36.D03.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
tcagtagtgtagatcacgaccggtgctcgatttagctgcgtcacgatctctcttggggggggtcacaagaggcagcgctcgtcgggacgtctccaccatggcctgggctctgctgctcctcactctcctcgactcaggacacgacgggtccgtgggcccagtctcgccctgactcacgcctgcctcgtgtcgtggtcctccgngacagtcgatcacatctctgactacgtacgaaccngacagtcgattagttaacgaaacttactaaccttgtcttacgttaacgtaacgaaacnccaccgaagaccgaaaccgacccccaaatactacgtagtacgtttaggacgtaggaactaggtaacgccggtacccgttacgtacggtttacctaacgttcgtccgtttacgtcgtaggaccttacgtaaagtcgtaacgtacgaaccgtagttcccgtacccgttccctaaggtaaaccctacgttaccggtacgttcgggtaccccgtaccgagggtacccgtaaagggtaccggaaccggtacggtacgttaagtttaaccgttaaactttacgtcgaccgttagtaccgttacctaagttaacgtccgaagttacggtaactacgttacttacgttacgttacgttaccgtaacggtaaccgtagggaaccgtaaccgtaccggttacccgttaacgtaaccgtaccgaaccgtaccggtaactaccccg

SEQ ID NO: 8596 - DNA, 811 bp, Homo sapiens
  misc_feature: GYAE6OF02IYMAN.37.36.D03.1.454.CMB.1.raw
  modified_base (227)..(227): a, c, t, g, unknown or other
  misc_feature (227)..(227): n is a, c, g, or t
tcagtagtgtagatcacgaccggtgctcgatttagctgcgtcacgatctctcgttggggggggtcacaagaggcagcgctctcgggacgtctccaccatggcctgggctctgctgctctcactctcctcactcaggacacgagggtcctcgggcccagtcctgccctgactcacgtcctcgcctccggtgtcgtggtcctccgtaggacaggtcgactccactatcncctgccacgtacggaacacgacagtatatacttagtaaacttaactaaccttcgtactcttacggtaaccaacacgaccgaccctaaggaaccaaaacccgtaccccctaaacgtaacctagttacgtagttttaggacgtaagaacgaacgggttaacggcccgggtacccttaagggtaccgggggttttaactaacgttaccgttaccgtttacccggttcgtacggtacccgttaccgtaaacggtccttacgggaccggaaaacccgtcccgggttacccctaccccgtagtaacctaactccgttccggtacgggtccgttacgaccgggtacgtagggaacgggtaccggtaggtaccgttaggtaacgttttaccgtaacgttcggccttaacggttcttaacctaacgtttagtccggtaacttaccggggtaattaccgtaactttaccgtttacggtaccgggtttaccttaaccgggtaacgggttacccgggtaaaccgtaccggtacccggtaacccgtttaccgtaaaccgttccaaacccgggtaccccggtaaccgtaaccccccgg

SEQ ID NO: 8597 - DNA, 644 bp, Homo sapiens
  misc_feature: GYAE6OF02GQWL4.37.36.D03.1.454.CMB.1.raw
  modified_base (230)..(230): a, c, t, g, unknown or other
  misc_feature (230)..(230): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatctcctgcactcggaaccngcagtgatattagaaacttactaacttgtctcttggtaccaacagccacccaggacaaacgcccccaaactcatgtatttgagaggacaggtaacgccggtccctaggtaggggtttctaagtccgtcttcctcgtcggtcctaccgtaagttcgtcggaccaaacgtcccggcccttaccctgaacctattccgtcggtcggtcctccggacgggtcctagggacggacggacggtacgtagttactttacgttacgtgtcgttcgccttacgtattacgtggaccgttaggttaccgttaactccttagtttacgttacgtcggttaacggtaaccggttacgggtaacccgtacggttacccgtaccgtttacgtacggtaccgaacggtaccccgaaccggtaacccccg

SEQ ID NO: 8598 - DNA, 818 bp, Homo sapiens
  misc_feature: GYAE6OF02HM7CR.37.36.D03.1.454.CMB.1.raw
  modified_base (224)..(224): a, c, t, g, unknown or other
  misc_feature (224)..(224): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcagacacacgggtcctcgggcccagtctcgccctgactcacgcctcgcctccgtgtcgttgggtcctccgtggactacgtcgactcaacctntcctcctcgctacgtacggaaccagcagtacgattattacgtaaaactttacttaaccgttgttccttcgtttaccggtaaaccctaaacgacgtacccaacccgaacggaacccgaaaaccgaccccctaaaatccgaacgttagtacttttacgggacggtaacggtaacgtaaaggtaaccgggtccccggtacccggtttaacggtaacggggtttttacctaaaccgttccggtttaccttaccgttccggtttaccggacccgttttaaccgtaaacgttcggtaccgggtaaaccctaccggtaccccgggtaccccttacccgttaacggtaacccttaacgttcccgttccgggtacggtaccgtccggtaacggacggtacgggtacgggaacgtacgggtcgttaacgttactttacgtactcgggtactgtaccctctaagttcgtacggacgttacggtacttaccgtcgttacgttacgtttacggttacccggttaaggcccggttaaggggaacccttacgggtacccgttaacccggtacctaacggtacccgacccggtacccgaccgtaaccccg

SEQ ID NO: 8599 - DNA, 804 bp, Homo sapiens
  misc_feature: GYAE6OF02H5621.37.36.D03.1.454.CMB.1.raw
  modified_base (205)..(205): a, c, t, g, unknown or other
  misc_feature (205)..(205): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgacgggtcctagggcccagtctcgccctgactcagcctgcctcgtgtcgtggtcctcgtggacnggtcatccacctatcctctcgcacgtacggaaccagcagtagtaattattacgtaaactttattaaaccttgttaccttcgttacggaacccaacgacgtcccaacccgtaaggaaccgaaaacccgtacccccaaaacttcgaattacgtagtttcggtaacggtaaggaaacgtaacggtaacggtcccggacccgttacggttacggggttttactaacgtccgttcttcgtcgtcgtactacgtagtctacggactaaccgaccgtcctaccgtagaacctaacgtcgtacgtcggtacctaccgaacgggtctacgggaacggaccggtacgtacgttaacggttaatttacgttacgtacgtaccgttacggtaccttacgtaacgttacggtacggtaaccgttaaacggtttaccgtacccgtttaacggtttaacctttacggttttaacccggttacccggtttaaaccgggttaacccgggttacggggtaaaacccgttaacggtttacccccggttaaacggttaaccccggtttaaacgtaccccgggtaaaccggttacccccggtaaaccgtaacccccccgg

SEQ ID NO: 8600 - DNA, 677 bp, Homo sapiens
  misc_feature: GYAE6OF02GJYFZ.37.36.D03.1.454.CMB.1.raw
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
tcagtagtgtagatcacgaccggtgctcgatttagctgcgtcacgagtcgtctcttgggggggtcacaagaggcagcgctctcgggacgtctccacatggcctgggctctgctgctcctcacttctcctcactcaggacacagggtcctgggcccagtctgccctgactcagcctgcctcgtgtctggtctcctggacagtcgatcaccatctctgcacgtgaaccngcagtgatattgaaacttataaccttntctcttcggtaccaacngccaccgagcaacgccccaaactcatgactttgtgaggtacagtaacgccggtacctcgtaggggtttcctaaacgtccggtacttcgtacgtcgggtaccctaccgtaaagttcgttacgggtaaacctaacccgggttccctaccccgttacggtaccctaacgttccgttcgtcggggtaccctaccggtacggtccgtcggtaaccggtacggtacgggtacctacgtacttacgttatttcgacctagtcctacgtatacttaacgacggttaccacgtactacgtaccgtaggtttagggttccgttacggggtacccgggaaccgggtacccgtaccgtacggttaccccggttactttacgggtacctaacggtcccgtaaaggcccgttacccccgg

SEQ ID NO: 8601 - DNA, 749 bp, Homo sapiens
  misc_feature: GYAE6OF02JJ4IC.37.36.D03.1.454.CMB.1.raw
  modified_base (235)..(235): a, c, t, g, unknown or other
  misc_feature (235)..(235): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctcgccctgactcagcctcgcctcgtgtcgtgggtcctcgtggacagtcgatcacctatcctctcgcacgtcggaccngcacgtagacttactagtaaacttactaccgtttgtacttcgttacggtaaccaacgtacgccctaacccgtacggaaccctaaaccgtaccccctaaaactcctaagtacgttaacgtttcggtaacgaacgggtaaccgtaaggtaaaccggtccgggtacccttacggtacggggtttacctaacgtccgttcgtttactcgggtcgtaccgtacgtacgtcgtacgaccacggtacgtccctaccgtacgaacttacgtcgtccggtacgggtcctacgtacgggtccgtagggaacggtacgtacgggtacttagttaacgtttacgttaccggtattccgtacgtaccgttactaggttactcgggttcaacgggtttactaccgttaaccgtttccgtttcgttacggttaccggttaaccggtaccggttacggaaacccggttacggtaccctacccggttaactaccggttaccggaaccccgttaccgtaacccggtaacccg

SEQ ID NO: 8602 - DNA, 702 bp, Homo sapiens
  misc_feature: GYAE6OF02IBMQ7.37.36.D03.1.454.CMB.1.raw
  modified_base (227)..(227): a, c, t, g, unknown or other
  misc_feature (227)..(227): n is a, c, g, or t
  modified_base (459)..(459): a, c, t, g, unknown or other
  misc_feature (459)..(459): n is a, c, g, or t
tcagtagtgtagatcacgaccggtgctcgatttagctgcgtcacgagtctctcgttgggggggtcacaagaggcagcgctctcgggacgtctccaccatggcctgggctctgctgctcctcactctcctcgactcgagacacgagggtcctcggccagtctgtccctgactcagccgtgcctcgtgtcgttcgggtctccgtggacacgtcgactcacctatcctcncgcacgtcgaacacgtcagtgattatacgtaaacttataaccttgtcctgttacgtaaccacacgaccaaccgacgaccaaaccgacccccaaatcgacgtgttacgttggacgaacggtacgaacggttacggccgtacccgtagttaacgggtttacctaagttcgtcttaaccgtcgacgtaccgtacgtacgtcgtacgaccgtaaccgcccggttaccctaccgtanacttacgtccgttacggtcggtaccctacgggtactaccggtaggacgggtaacgcggttaccttagtaacgtttacgtacgtcgacttacgccttaagtaacgttgacgttacgggtaacgttacttacccgttaagtttcgttaacgttccggtttaccggaacgtaaccgggtaccgtaaacgtccgtaccgttacccgtagtaacccgtacggacccggtacccggtaactaacccccg

SEQ ID NO: 8603 - DNA, 600 bp, Homo sapiens
  misc_feature: GYAE6OF02GVGVE.37.36.D03.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgacgttggtggttataatntgtctntggtaccacagcaccaggacaaacgcccccaaatcatgattgngagacagtagcgcctcgagggttctaatcgacttcgtctcgctacaagtctggacaaccgccgacctccgagactaactcgtcgtgggccttcaggtcctaggacggacggcggacctagtactttacttacgtcgtcctacgtcctactagttactcggtacgtaacgggttacttaccgactttacttacgttacggttaccggtttaacggtaaccggtacgggtaaccctaacggttacccgtaacccgttccggtaacgtaccgtaaccggtacccggtaaccgaaccccccg

SEQ ID NO: 8604 - DNA, 780 bp, Homo sapiens
  misc_feature: GYAE6OF02FJKUG.37.36.D03.1.454.CMB.1.raw
tcagtagtgtagatcacgaccggtgctcgatttagctgcgtcacgatctctcgttgggggggggtcacaagaggcagcgctctcgggacgtctccaccatggcctgggctctgctgctcctcactctcctcactcaggacacagggtcctgggcccagtctcgccctgactcagcctgcctcgtgtcgtggtctcgtgacagtcgatccactactctcctgactacgtacggaaccagtaccaggtgtattacgttaagtaaaacctttacttaaccgttgtcctttacgtttacggtaaccaacgacgacccaacccgaacggtaaccgaaacccgaccccctaaacgtctaacgttacgttacgtttagacgggtaacggtaacgaacggtaaccggtcccggtacccttacgggttacggggtttactaacggtccgtcctttccgtcgtcggtaccttaccgtaagttccgtacggaccaacccggtccggtccctaccgtacaactacgttccgtcggtcggtcccttaccggacgggttacgacgggtacggtaacggtcggtaccggtttaacgttaattacgttaccgtcgtacgttcggactttagtaacgttagtaccgggtaacgttcgggtaacgttcttaccgttgttttacgttccggttaccggttaacggtaacccgggttacggtaaaccgttacccggttaccgttaacccgttaacgttaaccggacccgtaacccgacccgggtaaccctaaccccccgg

SEQ ID NO: 8605 - DNA, 862 bp, Homo sapiens
  misc_feature: GYAE6OF02G7IFX.37.36.D03.1.454.CMB.1.raw
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacgagggtcctcgggcccagtctcgccctagacctcgacgccctcgcccgtccgttgtccgttcgggtcctccgtggacacggtcgactaccaacctattcctccgngacctaccgtacggaaccngacgagtgaacttattaacgtaaaactttacttaaacctttgttccgttaccgttacggtaaccaaacgacgacccaacccgagggtaacccaaaacccggaaccccctaaaaccgtactaacgttacgtttaacgttttcggtaaggtaaaccgggtaaccgtaaagggttaaccggacccggggttaccccgttaacgggtttaacggggggtttaaccctaaaccgtccggttacccttttaccgttcgttacgggtaccttaaccgtaacgttcggttaaccgggaaccaaacccggtaccccgggtacccctttacccgtaaccggtaaacctaaacgttcccttaccgggtaccgggtacccgttaccggacgggttaccggacggtacgggtaaccggtacgtagttaacggttaacttaacgttacgtcgtccgttgtaccttacgtagtaacgtacacgggttaagtacgtaacctacgttacgttacgttacgttacggttaaccggaagtaaccgggtaacccgtaacgggttaccctaaccggttaccgtacggtaaccgaccggtacccgtaaccggtaacccc

SEQ ID NO: 8606 - DNA, 907 bp, Homo sapiens
  misc_feature: GYAE6OF02HCXCB.37.36.D03.1.454.CMB.1.raw
tcagtagtgtagatcacgaccggtgctcgatttagctgcgtcacgatctctcgttggggggggtcacaagaggcagcgctctcgggacgtctccacatggcctgggctctgctgctcctcactctcctcactcaggacacgacgggtcctcggccagtctcgcctgactcagcctgcctcgtgtcgtcggtctccgtggacacgtcgactaccacctactcctcctgaccgacgtacggaaccagaccgtagtacgaattaattaacgtaaaacctttaacttaaccgtttgttccttacggtttacggtaacccaacgaccgaccctaaccgaacggtaaacccgtaaaccgttaaacccccaaaacttacttaaaatttaaacgtttttaacgacgggtaaaccgttaccgaaaacccgttaaaacccggtccccgttaaggtaacggggttaaccgtttttcgaacggttaccgtaccgtttccgtttaccgttcggttaccggtaaccctaccggttaaacggttcgtaaccgggtaacccgtaaacccggtccccgggtacccttcccgaacgtaaccctacgttaccgttaccgggtaccgggttacccttaacccggaacggtaccgggaaacgggtaccggaaccggttaccgttaacccttaaacgtttaacgtttacgtaaccggtacgtaaccgttacctaaccgttaactaacgtaaaccgaacggtaccgtacgggttaccgttaaccggttacgggttaccgggttacgggtaccggggacggggtaacccgggtacccggttaacccggttacccgggtttacccgttacggttaccggttaaccggacccggttaacccggtacccggtcccggttaccccgttaccccgg

SEQ ID NO: 8607 - DNA, 768 bp, Homo sapiens
  misc_feature: GYAE6OF02FSY66.37.36.D03.1.454.CMB.1.raw
  modified_base (229)..(229): a, c, t, g, unknown or other
  misc_feature (229)..(229): n is a, c, g, or t
  modified_base (633)..(633): a, c, t, g, unknown or other
  misc_feature (633)..(633): n is a, c, g, or t
tcagtagtgtagatcacgaccggtgctcgatttagctgcgtcacgatctctcttggggggggtcacaagagcagcgctctcgggacgtctccaccatggcctgggctctgctgctcctcactctcctcactcaggacacgagggtcctgggcccagtctcgccctgactcagcctgccctcgtgtctggtctcctggacagtcgatcaccatctctcgcacgtgaaccngctagtagattatacgtaactttactaaccgttgtctttcgttagtaaccaacgtacgacctaacccgacgaaccgaaaaccccgtaccccccgaaacgttcaacgttaggttaacgttttagaccgggtaaacggtaacgtaacggtaaccggtccccgggtaccccgtttagggtttaaccggggttttactaaaccggttccgttacccgtttccgttaccgggtggttaccccttaccggtacgttccgaccggtaacccggaacccgtacccgggttccccttacctaaccggtaacttaacccgttccgttaccgggtccgttacccgccggtaaggttccggagggaaccgacgggtaagttctacggttaatttccgtacgtcgttcttgaccttntacttaggtccgagttacgttacgtaccttgttacctttcggacgttacggttaccggtacgttaaccgggaaccctttacggtccggtaacccttaggttaacccgtcgaacccgtaccgacccggtaaccccc

SEQ ID NO: 8608 - DNA, 761 bp, Homo sapiens
  misc_feature: GYAE6OF02FWLG1.37.36.D03.1.454.CMB.1.raw
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacgagggtcctgggcccagtctcgccctgactcagtcctgcctcgtgtctgggtctctgacagtcgatccacctatcctctgcacgtggaaccagcagtgatagttagaaacttactaacttgtcttacgttacggtaaccaacgtacgacctaacccgaggtaaccaaaccgacccccaaaactcacttagtactttaggtaggagtacgaaggtaacgcgtccctacggttacgggtttactaagtcgttcttacgtcgtacggctaccgtaagttcgacgggaaccaaaccgaccggttccctaccctaaggtaaacctaacggttcccttaccgggtacgggtaccctacccggtaaacggggtcgtaaacggggtaaacgggtacgggttaacggggtcctttaacgggttaaaccttttaacggtttaaccgtcggttaaccgttacggacctttaacgtaacgtttacgtaggtaaccgttaacggtttacgtaaccgtttaacttaccgtttagttccccgttacggtttaaaccggacgtaacggggacccttaacgggttcctaaccggttaccgttaaacgtcccgtaaccggtacccggaactacccccgg

SEQ ID NO: 8609 - DNA, 751 bp, Homo sapiens
  misc_feature: GYAE6OF02HBZB4.37.36.D03.1.454.CMB.1.raw
  modified_base (133)..(133): a, c, t, g, unknown or other
  misc_feature (133)..(133): n is a, c, g, or t
  modified_base (657)..(657): a, c, t, g, unknown or other
  misc_feature (657)..(657): n is a, c, g, or t
tcagtagtgtagatcacgaccggtgctcgatttagctgcgtcacgatctctcgttgggggggtcacaagaggcagcgctctcgggacgtctccaccatggcctgggctctgctgctcctcactctcctcactnaggacacgacgggtcctgggcccagtctcgccctgactcagcctgcctcgtgtcgtggtcctccgtgacgtagtcgactccacctacttcctccgtgcctaaccgtacggaaacctgactagtgtaattaagttaactaaactttacgttaaccttgttccttaccgttaaccggtaaccctaaacaccggtaccccaacccgtaaccgggaaccctaaaaccccgtaccccccgtaaatcctaacgttacgtttagtttaggacgaaggtaacctaaggtaccggacccggttacccggttagggtttaccggtttaaccttaacgtcccgtttcgttccgttaccggcgtacctaccgtaacgttcgtaccggaacctaccggcccggtcctccgtaacgaacctacgttccgcgtccgggtacctacggcgacgtgggaacggaccggagtcgttagtactttcgtcgtacggtcttaacggccttatactacgtcgttacgttaagtcttaccttacgtntttccgtaaggttcccggtaacgggtacctaggtaacccgttcggaccgttaaccggtacgtaccggtacccacccggtacccgaccctacccg

SEQ ID NO: 8610 - DNA, 779 bp, Homo sapiens
  misc_feature: GYAE6OF02JP6NL.37.36.D03.1.454.CMB.1.raw
  modified_base (224)..(224): a, c, t, g, unknown or other
  misc_feature (224)..(224): n is a, c, g, or t
  modified_base (588)..(588): a, c, t, g, unknown or other
  misc_feature (588)..(588): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacgaggtcctgggcccagtctgccctagacctcagcctgcctccgtagtcgtgggtcctcctagggacacgtcgtaatccaacctnttcctcccctagacccgtacgtaccgggaaaccctagggaccaggttagtaattaagttacggttaaaacttaaccttaaaccgtttccgttcttaccgtttacggttaaacccaaacgacggacccctaaaccccgtaacgggaacccaaaacccgaacccccctaaaccacctaacggttagtaccgttttaggtacgaacggaacctaaggttaaaccgcccgggtacccctagggttaaaccgggtttacgaaaccgttccgtcgtttacccgtcgttccgggtacctccggtaaacgtcgttaaacgggcaaccggtacccggactttacccgacgtactaacgtcgtacggtcgtacncgtacgcgtacggacgtacggacgtacgtacgtatttacgtacgtcggtctacgtcctacgacttaacggcgtacgttaaggttaacttccgtacttacgtacttaacggtcgtaaccggttacgtacggtaaccgtaccggtaccgacccggttataaccggaccgtaacctaccggtaccgaaaccccg

SEQ ID NO: 8611 - DNA, 735 bp, Homo sapiens
  misc_feature: GYAE6OF02GM6W6.37.36.D03.1.454.CMB.1.raw
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtgccagatgtgacatccagatcgaccctagtcctccaccttccccctgtcctcgctatcgtggtaggaagacagacgtcaccactctacgttcgaccgaggcgagtcgagactattcggactaaactttaattaagttggtaatcaagaccaaggaaacccgtaggaaacccgaccccaagtcctacggcgttaccacggtctcgtacctacgtacctaaagttacggaaaccgacggtactacctagttaccgtaaggtttacgaggtacggtaaggtcgacgttacggagggtaaccttaacggtttaactttttaaccgtttacccgtaaaccgtttacgaaccggtaccgtaacggtaccctacggtaccgtacggttaacgacggttaaacggtacttacttacgtaaacgtaaaccctttagttaccgtttaattacgtaacctaaacctacccttaaggtacccggtaaccccgggtaccgtaaacggggtaacccgtaagggtacgtaacgttaaccgtaaacggaaactaccggttcgggtacgaccgtacgtaacgtacccttacggttacttacgtaccgttacc

SEQ ID NO: 8612 - DNA, 662 bp, Homo sapiens
  misc_feature: GYAE6OF02FT4C9.37.36.D03.1.454.CMB.1.raw
  modified_base (281)..(281): a, c, t, g, unknown or other
  misc_feature (281)..(281): n is a, c, g, or t
  modified_base (319)..(319): a, c, t, g, unknown or other
  misc_feature (319)..(319): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacaggtcctgggcccagtctgccctgactcagcctgcctccgtgtcgtgggtctccgtggactagtcgatccacctatcctcctgactacgtcgaaccacgcagtcgattattagaacttataaccttgtctcttgtaccanagtccacgagaccaaccgaccccaatcatgtagtttgngagactagacgcgtccgtgtagggttactatcgtcttcgtacgtcgtactaccgtaacgtcgtacggaccctaaacggtcccgtacccttaccgtacgtaacccgtaactccgttaccggtccgtcccctacggacgtacgaggtaccgggacggtacgtcgttacttagttaacgtttccgtgttcccgtggtactactacgttagtacggacgggttaatccggtaacctacggtttacttacgtttcgttaccgggttacggtaaccggttaccgggtaacgtccgttacccgtacgtttacctaccggtccgtaccggaccccgtaccgtaacccccgg

SEQ ID NO: 8613 - DNA, 837 bp, Homo sapiens
  misc_feature: GYAE6OF02F7NWW.37.36.D03.1.454.CMB.1.raw
  modified_base (287)..(287): a, c, t, g, unknown or other
  misc_feature (287)..(287): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacgagggtcctggcccagtctcgccctgactcagcctgcctcgtgtctgggtctcctggacagtcgatccaccatctcctgccacgtcgaaccagcagtgattagttagaaacttacttaaccttgtcttcgtacggtaaccaacgacnccacccgacgaccaaacccgaccccctaaaactcaagtacgtagtttacggaggtaacgaacgtaaggtaaccggtcccggtaccccgttacgggttaccggggtttaactaacgttccgttcctttccgttacgttccggtccgttaaccgtaacggttccgtacgggaaaccccgtaaccggtaccccgggtacccccttacccggttaacctaaccgtaacccgtttaccgttacccggtaccggggttacccgtaccgggtaccgggtacgggtaacgggtaacccggggaaccgggttaacgggttaccggttaacgttaaccggtttttaacgttaccgttaacggttccgtttagacccgtttacgtaacgtttagtaccggttagttaaccggttacggttacctttacgtttacgtttcgtttaccgttccggttaaacgggttaaccggttaaccggggtaaccgtaacccgggtttcctaaaccccggtttaccgttaaggaccccgtaaccggaccccggtaaccccgtaaccccccg

SEQ ID NO: 8614 - DNA, 599 bp, Homo sapiens
  misc_feature: GYAE6OF02JTGTX.37.36.D03.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (319)..(319): a, c, t, g, unknown or other
  misc_feature (319)..(319): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggacngtcgatcaccatcctctgcactcggaaccagcaggtnattatagtaaacttataaccttgtactcgttcggtaccaacacgacacccgaggaccaaaccgccccaaactcatgtattagngagacgagtacgcggtcctagtacggttactaacgtcgtcttctcgtcgctactaagtcgtgaccaaccgtaccgccctaccgtgacctactctcggtcgacctcgacgtctacggacgcgacggactaggttaacttacgttcgtacgtccgtagtactacctagtcgtagtacgtacggttaacgtctaacgttcttagttcgtacggttacggtaactaccgggtaacgtaaccgttccgaacccgttctacgacgtacccgaccctaccggacccc

SEQ ID NO: 8615 - DNA, 761 bp, Homo sapiens
  misc_feature: GYAE6OF02HKKLI.37.36.D03.1.454.CMB.1.raw
  modified_base (148)..(148): a, c, t, g, unknown or other
  misc_feature (148)..(148): n is a, c, g, or t
tcagtagtgtagatcacgaccggtgctcgatttagctgcgtcacgagtctctcttgggggagtctagtcccaaccaggacacagcataggacaagtgagggtccctgctcagctcctgggctcctagctgactctggctctcaggtcnccagatggtgactatcctagactcgaccctacgtcctacccaccttccccccgtagtcttcgacctacgtccgtaggtaaggagaccagtacgtccacctataccgtaacgttcgccgtacggacgtaagtccaaggtacttagttcggactaaactttaagtttaaacggttggttactacgtagaaccgtaaacggaaaaccggacggggtaacccaccccaagtcctaccgttcggtacctacgactacgactacgttaccgtaagttacggaaacgcggtacgtccctaattaccggtaacgttcggaagttaggaacggttcgaacgttccggtaggggtaaccttagtttaccgtttaaccttaccctaacgttccgtaaacggtcccgtaacggtcccgtaaacgtggtaaaccgttcgtaggaaaccgtttattaccggtaataaccgtaacttaacgttaacgttcgtttaaccgaccgtaactacccggtatcgggtaacccgacgttacggaaaccgttagacgttaagaccgttaaacgtaagtcgttaccgggtacgaccttgtaaacccgtcttaacgttcccgttacggtcttacccg

SEQ ID NO: 8616 - DNA, 805 bp, Homo sapiens
  misc_feature: GYAE6OF02FKEOM.37.36.D03.1.454.CMB.1.raw
  modified_base (141)..(141): a, c, t, g, unknown or other
  misc_feature (141)..(141): n is a, c, g, or t
tcagtagtgtagatcacgaccggtgctcgatttagctgcgtcacgatctctcttgggggagtcagtcccaaccaggacacagcatggacatgagggtccctgctcagctcctggggctcctgctgctctggctctcaggtnccagatgtgacatccagatcgacccagtctccactcccccctgtctcgcatcgtgtacggagaccagacgtccaccatcacttgcccgaggcgagtacgaggactagttcggactaacttaatttaaatttagggtactcgtagacaaacggtaaacccgaaggggaaaaccgtcccccgaaagtcccgtacccgtggttacctaaccgctcggtaccacttacccgtaaagttttacgggaaaaccgtagggtaacccttacccgtagttacccgtaaaacgggtttacccaaggggttacgtaaacgggtagggtaacgtttaccggtagggggtaacctagggtttaaccgttttttaccgtttacctaacccgttttcgaacgtaccgtaacgtcccggtagtacggttaacgttaccgtaacgtaaacggttaactaggtttaccgaaaccgtaaccgtaactttactttaactttaacggtaccctaaaccgtaccggtaaccgtttacgggaaaccccggtaccccggttaacgggaacccgttaaaggttaccgggtaaacttaaccggtaaacccgtaaaacggttaaaccgttgggttacccggtacgtacggtaccgaacccttaattcccggtttacttacccgttaacccg

SEQ ID NO: 8617 - DNA, 645 bp, Homo sapiens
  misc_feature: GYAE6OF02JLL96.37.36.D03.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (450)..(450): a, c, t, g, unknown or other
  misc_feature (450)..(450): n is a, c, g, or t
  modified_base (534)..(534): a, c, t, g, unknown or other
  misc_feature (534)..(534): n is a, c, g, or t
tcagtagtgtagatcacgaccggtgctcgatttagctgcgtcacgatctctcgttggggggggtcacaagaggcagcgctctcgggacgtctccaccatggcctgggctctgctgctcctcactctcctcactcaggacacagggtcctcgggcccagtctcgccctgactcacgtcctcgcctccgtgtcgtcggtctccgtggacngtcgatccacntctctgcactcggaaccngcagngtatattaanaaacttataaccgttntcttcgttacggtaccaactcgaccaaccgacggtaccaaaccgcccctaaaacgtctaagtactagtttgacggaggtaacgacggtaagcccggtaccgtacggtacggggtttactaacgtccttccttcgtcgtcggacctacgtacgtctacggaccaacgtccggccctaccgtanacctatccgtcgtacggtccgtaccgacggtctagggaccggacggacggtctaacgttagttaacttcagtctcgaccgttanagttcgaccggtagtaccggtactcgttacttgttacgtcgttcggtacgtaggtccggtaacgtacgtacctaccggtacctagtaccggacccacggacccgtaacccg

SEQ ID NO: 8618 - DNA, 732 bp, Homo sapiens
  misc_feature: GYAE6OF02JG8R3.37.36.D03.1.454.CMB.1.raw
  modified_base (133)..(133): a, c, t, g, unknown or other
  misc_feature (133)..(133): n is a, c, g, or t
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
tcagtagtgtagatcacgaccggtgctcgatttagctgcgtcacgatctctcgttggggggggtcacaagaggcagcgctctcgggacgtctccaccatggcctgggctctgctgctctcactctcctcactnaggacacagggtcctgggcccagtctcgcccgtagacgtcagcctgcctcgtgtcgtcggtcctaccgtggacncggtcaacgtcaaccncttcctcgtacgacctacgtacgaaccgaggtcagtcgtactattaacgtaaacttacttaaccgttcgtcgttccgttacgaacctaacaccgccgaccgacggacaaccgaccccaatcacgtntagttcgnggtacgactagtacgccgtcctagggtacggttctactcgtacttccgacgttcgactacgacgtacgtacggaacctaaccggtccgtacccgttccaacgtacctaacgtttaccgtccggttaccgggacctccgggaacggtcgtaacgggcggtaacggaccgttacgttaacgttacgtttacgttaccggcgtaacgttccggtacttattaccgttaagtacccggtagttaaccgggtttaaacttcccgttagggtttacccttaggtttccgttacccggttaacggggaaccttacggggaaccttaccggtaccgtacccggtttaccacgttaccggtacccggaccgtaacccgtacccg

SEQ ID NO: 8619 - DNA, 615 bp, Homo sapiens
  misc_feature: GYAE6OF02JEBHL.37.36.D03.1.454.CMB.1.raw
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (358)..(358): a, c, t, g, unknown or other
  misc_feature (358)..(358): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcgatcaccatcctcctgcacgtggaaccagcagtnatattgaaacttataccttgtctcttgtacanacgcaccaggcaaacgccccaactcatagtattgtagaggacagtagcggcctgtagggtttctaatcgtcttctcgtcgactcaatcgngacaaccaccgcctcctacgactaactcgtcgtcgggcttccgacggtcgtacgacgaccggacggtctacttacgttacttattccggacacgtacccttagtaactacgtaacctaggacctacggtaacttaccgttacggttcgtttacggggtcgggttacccggggtacggggaaacgggtccccgtaccggttcggtaacccggtttccggttaccggtaacctaccgggtaccccggtacggtaccccg

SEQ ID NO: 8620 - DNA, 726 bp, Homo sapiens
  misc_feature: GYAE6OF02GFV12.37.36.D03.1.454.CMB.1.raw
  modified_base (174)..(174): a, c, t, g, unknown or other
  misc_feature (174)..(174): n is a, c, g, or t
  modified_base (180)..(180): a, c, t, g, unknown or other
  misc_feature (180)..(180): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
  modified_base (574)..(574): a, c, t, g, unknown or other
  misc_feature (574)..(574): n is a, c, g, or t
tcagtagtgtagatcacgaccggtgctcgatttagctgcgtcacgatctctcgttggggggggtcacaagaggcagcgctcgtcgggacgtctccaccatggcctgggctctgctgctcctcactctcctcactcacggacacgacgggtccgtcgggcccagtctctcccgtnacctcncgtcctcgtccgtcgtcgttcgtcggttcctccgacggacacggttacgactacaacctctcctcctgaccacgtacgaccagctagtacgtattacgttaacgttaacttaacttaccttcgttccgttaacgtaccgaacctaccggaacctaccgaaccggaccgaaccaaaccccgtaacccaccgtatacgtaagttacgtagtacgaacgagtaacgccggtaccgttccgtagtttaaccgtnttacgtgtttaccgtntcgtacgacctgactcgttacacctacggtacctaccctgtacacgtacgtacgtacggccggtacgcggtcgtacgtacgcggtaacggtgtacgttaacttacgttaacgtcgtacctcgttactntacgacgtttacgcggtacggtactttacggtaccttacgtttacttcggttacggttaacggttcccggtaaaggtcccgggttaacggaccccgttacggttacccctaaccggttaaccgtaccgaacccgtacccgtaccctaacccg

SEQ ID NO: 8621 - DNA, 658 bp, Homo sapiens
  misc_feature: GYAE6OF02F4CHF.37.36.D03.1.454.CMB.1.raw
  modified_base (129)..(129): a, c, t, g, unknown or other
  misc_feature (129)..(129): n is a, c, g, or t
  modified_base (245)..(245): a, c, t, g, unknown or other
  misc_feature (245)..(245): n is a, c, g, or t
  modified_base (334)..(334): a, c, t, g, unknown or other
  misc_feature (334)..(334): n is a, c, g, or t
  modified_base (511)..(511): a, c, t, g, unknown or other
  misc_feature (511)..(511): n is a, c, g, or t
  modified_base (547)..(547): a, c, t, g, unknown or other
  misc_feature (547)..(547): n is a, c, g, or t
tcagtagtgtagatcacgaccggtgctcgatttagctgcgtcacggatcgtctcttggggggggtcacaagaggcagcgctctcgggacgtctccaccatgggcctgggctctgctgctcctcacttcncctcactcaggacacgagggtcctgggcccagtcctcgccctgactcagccctgcctcgtgtcgtgggtcctcgtaggacagtcatccaccatcctcctgacacgtcggaacccgnagtgacggttggtcggttaataactagtgttctcgttagaaccaacactccaccgagacctaaaccgtaccccaaatcatgtagtttancgagtaccaacgtaaccggccgtagacgggtctactagtccgtcttgtcctaggtctaccgtagttcgacggacaccgcccggtcctcctacgaccgtacgtcctacggtcggcccttaccgacggtacgtacgggaaccgacggtccgtactccttaaacggtttattagttaccncggtactaccgtactataaacgacctaagccgtaanttacctgttagggttcgggttacgggtaccgggaaccgggacgggttacccgtaccgtagggttacctacgggttacgtaccggaccccgtcgtacgggtccccttcccgg

SEQ ID NO: 8622 - DNA, 749 bp, Homo sapiens
  misc_feature: GYAE6OF02FN6C2.37.36.D03.1.454.CMB.1.raw
  modified_base (613)..(613): a, c, t, g, unknown or other
  misc_feature (613)..(613): n is a, c, g, or t
tcagtagtgtagatcacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctcgccctgactcagcctgcctcgtgtctgggtctcctggacagtcgatccaccgtatcctccgtgaccacgtacggaaacctagacgtaggttagaattaattacgtaaaactttaactaaccgttttcgtcgtttccgtttacgggtaacccaaacgtacggaccccaaccccgacgggaacccaaaaacccggtacccccccgaaaactaccctaattagggtaaacgttttggtacggaaacgggaacgtaacggttaaacgggccccggtcccgttacggtacgggggtttacttaaagtccgtactttctacgtcgtactaccgtagttacgtacggactaacccgaccggtccctcccgtagacctacgttccgacggtcgggtcctaccggacgtcgtaggacgggtacgtaggtcctaggttaattactacttcgacgttcgacttntaactagttacgtccgtaagttacctacgttaccttgtttacgtgttaccgtacgggtaaccggttacgggaaccgttaccggtaccgtaacccggttacaccggttctaacccgacccggtaaccgtaacccccg

SEQ ID NO: 8623 - DNA, 598 bp, Homo sapiens
  misc_feature: GYAE6OF02FQI2U.37.36.D03.1.454.CMB.1.raw
  modified_base (128)..(128): a, c, t, g, unknown or other
  misc_feature (128)..(128): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
tcagtagtgtagatcacgaccggtgctcgatttagctgcgtcacgatctctcttgggggggtcacaagaggcagcgctctcgggacgtctccaccatggcctgggctctgctgctcctcactctcctnactcaggacacagggtcctgggcccagtctgccctgactcagcctgcctccgtgtctgggtctctggacagtcgatcaccatcctctgcactggaaccagcagtgacgttggtagttataaatatgtcttcgttggaaccaacagtccaaccgaacatccaacccgaggaccaaacggtaccccaaactnaattaagttanacgagtaccaacgtaacggccctagaaggtactttacaagtctcttctcgtcggactaccaaggttctaggacctaacgaccgcctcctacgaccctactctacgtcggtacctaccgaactggaacggacgtacgcgtacctaacttaattgtacgacgacgtctacagttactaacgagcagcgtactacggtttagggtcgttacgggccggtaacggtacccgtacgtacgtccggttacgttacggacgtacgacccgtaacgg

SEQ ID NO: 8624 - DNA, 516 bp, Homo sapiens
  misc_feature: GYAE6OF01CWE68.44.41.D08.1.454.CMB.1.raw
  modified_base (438)..(438): a, c, t, g, unknown or other
  misc_feature (438)..(438): n is a, c, g, or t
  modified_base (496)..(496): a, c, t, g, unknown or other
  misc_feature (496)..(496): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccgggggaacgagccaccctctcttgcagggccggccagactgttgacgacgacttagcctggtaccaacagaagcctggccaggctcccagactcctcatctatgatacttctagtagggcctctggcatcccagcccgcttcagtgcagtgggtctgggacagacttcactctcaccatcaccagcctagacgcctgaagattttgctagtttatacttgtctacacgtaagagtgcctcaatntcacttcggcctagggaccaagtggatatcaacgaactgtgctgcaccatctgtcttnattcctcccgctatctgtac

SEQ ID NO: 8625 - DNA, 530 bp, Homo sapiens
  misc_feature: GYAE6OF01AUMOE.44.41.D08.1.454.CMB.1.raw
  modified_base (504)..(504): a, c, t, g, unknown or other
  misc_feature (504)..(504): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaagagccaccctctcctgcagggccagtcagagtgttaggactacttagcctggtatcaacagacacctggccaggctcccaggctcctcatctatgatgcatccaatacgggccgcgggcatccccagccaggttcagtggcagtggtctgagacagacttcactctcaccatccagcggacctagacgccggaagattttgctagtttattactgtcaacgtaccgtagacgactcggcctaggtactagttttggaccgtagggaccaagctaggagcgtacaaacgacgtgtggctgacncatctgtcttacacttctcccgctac

SEQ ID NO: 8626 - DNA, 523 bp, Homo sapiens
  misc_feature: GYAE6OF01C8QSU.44.41.D08.1.454.CMB.1.raw
  modified_base (201)..(201): a, c, t, g, unknown or other
  misc_feature (201)..(201): n is a, c, g, or t
  modified_base (511)..(511): a, c, t, g, unknown or other
  misc_feature (511)..(511): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaattgtgttgacacaatctccagccaccctgtctttgctccaggggaaangccaccctctcctgcagggccagtcagagtgttaggaactacttagcctggtatcaacagacactggccaggctccaggctcctcatctatgatgcatccaatagggccgcgggcatcccagccaggtcagtggcagtggtctgagacagacttcactctcaccatcagcggcctagacgccggaagtatttgctagtttattactgtacaacgaccgtagcgactgccttagttacgtagttttcggacgagggtaccgaagtcgtaggacgactacgaaacgacgtgtggctgcaccatctgtcttcntcctcccgctac

SEQ ID NO: 8627 - DNA, 154 bp, Homo sapiens
  misc_feature: GYAE6OF01B27SH.44.41.D08.1.454.CMB.1.raw
  modified_base (154)..(154): a, c, t, g, unknown or other
  misc_feature (154)..(154): n is a, c, g, or t
tcagacagtatatacacgaccggtgctcgatttagtcacgcgagaaagggaaagggacacgacttgagattaagcgaactgtggctgcaccatctgtcttcatcttcccgccatctgatatatactgtctgagcgggctggcaaggcgcatagn

SEQ ID NO: 8628 - DNA, 551 bp, Homo sapiens
  misc_feature: GYAE6OF01EAA8V.44.41.D08.1.454.CMB.1.raw
  modified_base (203)..(203): a, c, t, g, unknown or other
  misc_feature (203)..(203): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccactggagaaatagtgatgacgcagtctccagccaccctgtctgtgtctccaggggaaangccaccctctcctgcagggccagtcagagtgttaccagcaacttagcctggtaccaccagaaacctgggcaggctcccgaggctcctcatctatggaacatcccaccgagggccactggtactccccaccctaggttcagtggcaggtcggcgganagagttcactctcaccancagcgctgcngtctgagtntttgcttagtttattacgtgtcagtactagtataatactcggtcctcgtctacggttcgggcgggggtaccgagggtgaagtactacgaaacgacgtggtacggcgtcggcaccgtattccgttgttccttctacttcccttcccctctacgttc

SEQ ID NO: 8629 - DNA, 561 bp, Homo sapiens
  misc_feature: GYAE6OF01D6DTT.44.41.D08.1.454.CMB.1.raw
  modified_base (554)..(554): a, c, t, g, unknown or other
  misc_feature (554)..(554): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagacaccctgtctttgtctccaggggagagagccaccctctcctggtagggccaggtcggagtgttgctaagtacctagcctggtaccaacagaaacctggccaggcctcccaggctcctcatctatgatgcataccaacgagggtcacgtggacccacccagacaggttcaggtgcgaggtgggtctgggacagtacttcactctcaccgtcagctaatgtacagcctagaatagtttgactagttttatactgtacagctacgtccgttcctcgacggtccctctctacggttcggggcgggggtaaccaggggttgagctcgagacgtacgtgtcggctcgccactattcgtgttccttctacttcccttcccgactnttcgtag

SEQ ID NO: 8630 - DNA, 696 bp, Homo sapiens
  misc_feature: GYAE6OF01DUAWL.44.41.D08.1.454.CMB.1.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (305)..(305): a, c, t, g, unknown or other
  misc_feature (305)..(305): n is a, c, g, or t
  modified_base (660)..(660): a, c, t, g, unknown or other
  misc_feature (660)..(660): n is a, c, g, or t
tcagacagtatatacacgaccggtgctcgatttagtcacgcgagaaaggggaaagggggaggaactgctcagttaggacccagagggaaccatggaagccccagctcagcttctcttcctcctgctactctcggctcccagactaccactggaagaaatagtgatgacgcggtctcacgccacctgtctgtcgtcacgaagggaacacnccacctctcgngcgacggcagtcagtagtgtagcagactaactcgcctacgacagacaagaactcgtacggaccacggcctccgacgtcctacctntacttcgtgtcggtacacctacgtacccgacggtaccggacctacggttacgacctaccgacggtccgtaaggttcgaggtcgacggttagggtcggtacgacggaactacggtacttaccgcctacgtaccaactcgcgaacttcgaacgttccagtcgttaacgttacgtaggttaacttttacgttagtaccgttttaagttacctaggtacgactaaagggttaactaaggtttaactacggtccgtacccggttcccgtaccccggttacgaaccggggaagttaaccgggacttacggtaagtaaaggtaaaccggttaaacgttaaccggcggttacggccttaaccngtaaaccctgtaaccgtttcgttaccaccgtttccc

SEQ ID NO: 8631 - DNA, 655 bp, Homo sapiens
  misc_feature: GYAE6OF01D6KIL.44.41.D08.1.454.CMB.1.raw
  modified_base (204)..(204): a, c, t, g, unknown or other
  misc_feature (204)..(204): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagactaccaccggggaaattgtgttgacacaatctccagccacctgtctttgtctccgaggggaaanagccacctctcctgcagggccagtcagagtgttaggaacttacttagcctggtatcaacagacacctggccaggcctcccaggcctcctcattctatcgattgcatccaagtcgggccgcggcactccagcctaggttcaggtcggcaggtggtctgagcagacttcactctcaccgtatcgacgccggtacctaaggacgaccggtaaagtacgttttaggacttaagttttaacttacgttacgtacctaaacgtaccggtaagccgtaacgtcggtaccgtagggttacttaaggttttccgggacccggtaacggggtaacctaacgggtcggtaggtacgtaccgtaaccgtaaaaacggtaccgttaggtacggtacctacggtacccaaccgtacttaccgttacggttaccttacctacctttcccgttccccgccttaaccg

SEQ ID NO: 8632 - DNA, 638 bp, Homo sapiens
  misc_feature: GYAE6OF01A0CN1.44.41.D08.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggcctcccagataccaccggggaaattgtgttgacacaatctccagccaccctgtctttgtctccgaggggaanagcccaccctctcctgcagggtccagtcagagtgttaggactactagcctggtatcaacngacnccgtggccaggcctcccaggcctcctcatctatgatcgcacttaccgaagtacggggccgacgggcactccccagccaggttcaggttcgctaggtggtctaggagcagtcttcgactcacacatcgacgccggcctaagacgtacggtaacgttagttttcgacttagtttacttacgttacgttactaaccgtaaccgttaagtaacgtcggtacctacctaacgttacttaccttaccgtttcggtaccccgttagggaaaccctaacgggttacggtaactacgtaaccgtaaacgtactaggtcggtacgtacgacctacctacttacgttcgttaccttacgtactttcccgttaccctcgtac

SEQ ID NO: 8633 - DNA, 770 bp, Homo sapiens
  misc_feature: GYAE6OF01B05BB.44.41.D08.1.454.CMB.1.raw
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
tcagacagtatatacacgaccggtgctcgatttagtcacgcgagaaagggaaagggggaggaactgctcagttaggacccagagggaaccatggaacgccccagctcagcttctcttcctcctgctactctggctccagactaccgacgggtaattgtgtgacactatctaccacgcctacctgttctttgtcctaccggaaggggaacacgcccacctctccnggacacgggtccagtcaggtagtgttacgaccaccaccacngtcttctacgctacgacgacgagagacgcgtcggccgacggtcctacccgaggcctacctacatatacgatacgactactacgaagaccgaacggccgacgtcggaccacgtaccgagtaacgtcggttacgaggtcgacggtaggtcgggtacggtacggtacgtaacgtcgtttacacgtcgtacaggtacacgtacgagggtccggtaacggtcgggtacgaccggtaacgggtacggtacgtttacgtaacggtacgttttaactttacggtttactacgggtttaaccgtagttcggtaacgggtttacgtttacggggttaccgttacccgtaacgtttcggttaaccgggttacccggtttaacccggggaaccgggaaacggggtaaacccgggttaaagggttaaaccggtaaaacccggttaaacgtaaaccgggttaaggttacggttaaccggtaccggttacgaccctaacggttgttacccggtttaccgg

SEQ ID NO: 8634 - DNA, 509 bp, Homo sapiens
  misc_feature: GYAE6OF02IXHUF.44.41.D08.1.454.CMB.1.raw
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaagagccaccctctcctgcagggccagtcagagtgttaggaactacttagcctggtatcaacagacacctggccaggctcccaggctcctcatctatgatgcatccaatagggccgcgggcatcccagccaggttcagtgcagtggtctgagacagacttcactctcaccatcagcgctagagcgaagatttgctagtttattactgtacaacacgtagcgactggcctaggtactagtttggccgagggacagcgtggagactacaacgactgtggctgcacatcgtgtcttctatccttcccgctac

SEQ ID NO: 8635 - DNA, 516 bp, Homo sapiens
  misc_feature: GYAE6OF02FKBKQ.44.41.D08.1.454.CMB.1.raw
  modified_base (512)..(512): a, c, t, g, unknown or other
  misc_feature (512)..(512): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaagagccaccctctcctgcagggccagtcagagtgttaggaactacttagcctggtatcaacagacacctggccaggctcccaggctcctcatctatgatgcatccaatagggccgcgggcatcccagccaggttcagtggcagtggtctgagacagacttcactctcaccatcagcgctagagccgagatttgctagtttattactgtcaacaccgtagcgactggcctaggtactagtttggcctaggggaccaagctggacgctacaaacgacgtgtggctgacaccatctgtcttctactccttcccnctac

SEQ ID NO: 8636 - DNA, 679 bp, Homo sapiens
  misc_feature: GYAE6OF02ILKP4.44.41.D08.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (332)..(332): a, c, t, g, unknown or other
  misc_feature (332)..(332): n is a, c, g, or t
  modified_base (424)..(424): a, c, t, g, unknown or other
  misc_feature (424)..(424): n is a, c, g, or t
tcagacagtatatacacgaccggtgctcgatttagtcacgcgagaaagggaaagggggaggaacgtgctcagttaggacccagagggaaccatggaagccccagctcagcttctcttcctcctgctactctggctcccagactaccaccgggaattgtgttgacacaatctccagccacctgtctttgtctccagggaanagccaccctctcctgcacgggccagtcagngtgttacgactattagcctggtatcaangacactgccaggcctccaggtctccncagtcctaatcgattcgctactacaaacgttcggcccgcggacctacnccccgacggaccctacgggttccaacggtcgggacctaacggttcgggtcttacggacgtaacgacgtaaccttcgacgttccgtccgaccngtacccgaggtcccggactaggacgaccgggtaaagtagttttcggactttaagtttacgttacgtacgtttaccgaaaccgttaaccggttcgacgtacgttacggaccttaacgggtaacttacggttttcggaccgtaacggggtaccaacggtcgtacgggacgtaccttaacgaaacgtaccttgggtaccgagttcgaccgtaacgtcttacgtcgttacttaccgtacttcgttaccccgtactaacg

SEQ ID NO: 8637 - DNA, 554 bp, Homo sapiens
  misc_feature: GYAE6OF02F6MH2.44.41.D08.1.454.CMB.1.raw
  modified_base (203)..(203): a, c, t, g, unknown or other
  misc_feature (203)..(203): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctctcctgcagggccagtcagagtgttaggactacttagcctggtatcaacagacacctggccaggctcccaggctcctcatctatgatgcatccaatacgggccgcgggcactcccagccaggttcaggtgcagtggtctgagacagacttcactctcaccatcagcgctagacgcgagtatttgctagtttattactgtacaacgacgtagcgacgtggacctaggtactaggttttacggaccgtaggggaccaaggtcgtaggagtcctaccgaacgtactaggtcggtcgtcgaccaacctagttcctcgttccttacctacgttcccttcccgtctac

SEQ ID NO: 8638 - DNA, 642 bp, Homo sapiens
  misc_feature: GYAE6OF02GGCV6.44.41.D08.1.454.CMB.1.raw
  modified_base (236)..(236): a, c, t, g, unknown or other
  misc_feature (236)..(236): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccacctgtctttgtctccaggggaaagccaccctctcctgcagggccagtcagagtgttancagcaacgttgcccttggtaccagcagtaaactcgtaggccaggtcctaccccgaggccttcccncagtaccttatgggtancctaactcccgaccgacgggcctaacgtcggtactcccgaggccctaggttccaggttcggactagggttcgggtcgtacggggactagggtacttcgactctcactatcgacgtnacgcctagctagtctaggaattgtttcgntaagttttatacttgtacagccgtagtaatagacgtacgttccggtccctttaccgtcggaaccgaaacgggtccaacggtacgtacgggtagtaacgttaaacgggtagtcgggttaccggaattcggaaccgtacctacgttccttagtaccgtttacctacgtttccccgtaaccc

SEQ ID NO: 8639 - DNA, 662 bp, Homo sapiens
  misc_feature: GYAE6OF02JQ6UR.44.41.D08.1.454.CMB.1.raw
  modified_base (204)..(204): a, c, t, g, unknown or other
  misc_feature (204)..(204): n is a, c, g, or t
  modified_base (613)..(613): a, c, t, g, unknown or other
  misc_feature (613)..(613): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtagttgacacaatctccagccaccctgtcttgtctccgaggggaaangccaccctctcctgcaggccagtcagagtgttagactatacgcctggtatcaacgagacaccgtgaccgaggcctaccaagtcctcctacattcctatgaattcgactactaccgaagtacgggcctacgttcggtacctacccacgccgtaggttcgaggtcggacgtaggtccggtggtacgggacgtagtacgtttccaacgttccgtacacctacgtcgaagcctacgccgttgacgtagtaccgtacgtaacgttagtttggtacttaggttttacgttacgtcgttacgtacgtacgttaacgttataaacggtcgtaccgttacgggttacccttacccggtacggtaccgaacggtaccgtacgacggtacgtaagtaactaacggtatcggtacggtacncgtacctactcgttacttcgtacgtaccttacgttacctcccgtaaccg

SEQ ID NO: 8640 - DNA, 766 bp, Homo sapiens
  misc_feature: GYAE6OF02JURON.44.41.D08.1.454.CMB.1.raw
  modified_base (206)..(206): a, c, t, g, unknown or other
  misc_feature (206)..(206): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (398)..(398): a, c, t, g, unknown or other
  misc_feature (398)..(398): n is a, c, g, or t
tcagacagtatatacacgaccggtgctcgatttagtcacgcgagaaagggaaagggggaggaactgctcagttaggacccagagggaaccatggaagccccagctcgagcttctcttcctcctgctactctggctcccagactaccgaccggggaattgtgttagacacaatctccagccacctgtctttgtcctcgagggtaacncgccacctgtcctgcgacggccaggtcagagtgttcgacaccgaccacgagtccgttactacgcccttacggtaccaggacctaaggaaccgtcgtacggccctaacgggcccttacccgaggtcctaccctnactacgtacgnttcgcactcccgagccaacgggccgtcgtaggcacgtccgaacgtacnggtttccaggtcgacgtgggtcgggtacgtcgggaacgtacgtaccttaccgacgttcgtacgacgtacctacgtccgacggtaccggtaccggtacgggtaaccgtcggtacggtacggtacgttcggttacgttacggttaagttttaccttacggttagtaccggtaacggttaccggtaagtttacggtttacgggtttacgggtacccgttacgtttaccggtacggttaccggtttaccgggtaacccgggtacgggttaacccggtaaggggttaacggttaaaccgtaaccggttaaacggttaaccggttaacggttacgtaccgtaccggtacctaccggttacggttacccttacgg

SEQ ID NO: 8641 - DNA, 640 bp, Homo sapiens
  misc_feature: GYAE6OF02JBQ28.44.41.D08.1.454.CMB.1.raw
  modified_base (200)..(200): a, c, t, g, unknown or other
  misc_feature (200)..(200): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctccagataccaccgggaaattgtgttgacacaatctccagccacctgtctttgtctccaggggaaanacgccacctctcctgcagggccagtcagatgttagactactagcctggtatcaacagacacctggccaggctcccaggctcctcattctatgatcgcatccaagtacgggccggcgggacactccccgagcccaggttccaggtggctagtgggtctggancagtcttnacttcacaccatcacggtcgactaggacggccggtaagtattttgacgttagttttaacttacgttcgttacctacgttaaccgttaaggtaacgtcgtacccttaccgtaattacttacgtaccgtttccggtacccgtaacgggtaaccctaaacggttcgtaacttacgtaaccgaaaccgttacgttaggtacggtaaccgtacgtacgtaacccgtagttaccgttacggttaccttaccgtactttccccgttaccgaccctaac

SEQ ID NO: 8642 - DNA, 716 bp, Homo sapiens
  misc_feature: GYAE6OF02GFB61.44.41.D08.1.454.CMB.1.raw
  modified_base (203)..(203): a, c, t, g, unknown or other
  misc_feature (203)..(203): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaangccaccctctcctgcagggccagtcagagtgttgacaccaccacagtcttcttacgcctggtaccaggcagagcctggccaggctcccgaggcctcctcattacacgatgaccatccagcaacggcccgctggactactcccgagaccgtaggtttaccaggttcggactagggttgggtacctaggggaactaggtaccttacgaccgttctacgagtcacgtcgaacggcggtagtcggacgtccgtggtacggtacttcgtacgtacgtttacgtttaagtaccgttacgtaccgtaggtaccgtaaggtttacggtttcgggtttacggtacccgttaacccgttcggttaccggttaacccgggtttaccgggaacccgggttaaacggggtaacccggttaaacgggggttaacggtaaaaccgttaacccggtaaaaccggttaacgttaacgggttaccgtaaccgttaccggtaacccgttaaccgtacgttccgtttacccgg

SEQ ID NO: 8643 - DNA, 893 bp, Homo sapiens
  misc_feature: GYAE6OF02G0TZN.44.41.D08.1.454.CMB.1.raw
  modified_base (205)..(205): a, c, t, g, unknown or other
  misc_feature (205)..(205): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccgaggggaaagngccaccctctcctgcagggccagtcagagtgttaccagcaacttagcctggtaccacacgaaccgtggcaggctcccgaggcctcctcatctataggaacactaccacgacgggccacgtcggtactcccgagccgagtacgttcgagtcggacgtagggttcgggtcgtacggggaactaacgggtacgtttaccgtaacgtttcctacccgtaaccaacttaccgaagtacccgaaccggttcccccgtagggtacccgtaacccggtacccggtttacggttaacgtttacggttttaacggttttttaacggttaaacctttaaaacccggttttaaactttttaaaccccggttaaccgtaaaccccgttaaaaccgttaaaacggtttaaagtttaaaaacgggtttaacggttttaaccgttttaacccgttaacgttaaaacgggttttaacgggttttttaaccggggaacccgggttaaaaccggggggtaaacccggttaaacggggtaaccgggttaacggggtaaaccggttaaacggttaaacccggtaaaaccggttaaccgggttaacgggttaacgggtaccggttaccgggtaacccttaacccgttaccgtttaccgtttaccggttccgtttaccgtaacccgttttacccgttacccccgtaacccg

SEQ ID NO: 8644 - DNA, 667 bp, Homo sapiens
  misc_feature: GYAE6OF02FWHUW.44.41.D08.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (311)..(311): a, c, t, g, unknown or other
  misc_feature (311)..(311): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggcctcccagactaccgaccggggaaattgtgttgacacaatctccagcccaccctgtctttgtctccgaggggaaanacgccaccctctccngcagggccagtcagagtgtaggaactacgttagcctggtactcaacagaccaccgtggccacggcctccgaggcctcctcatctatgntcgcacgtaccgaagtaccggggccgcgggaccactcccagcctaggttcgaggtcggctaggtggtaccgtgacgacgagtccttacacttcaccactacgtaccgacggtcccgacgtaggacgggtaccggaagtttcgttttacgactttacgttttacttaccgttacggtaacctaaccgtaaccggtagtacccggtacgtcggttacccgtaagggttacgttacggttacggaccggttacgggacctaacggtcgtagaccgtacgacgtaaacgtcgtagacggtctacgcctaccgacgttctacgttccttaccgtaccgtttcccgttaccccgtactaacg

SEQ ID NO: 8645 - DNA, 602 bp, Homo sapiens
  misc_feature: GYAE6OF02F9C94.44.41.D08.1.454.CMB.1.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctctcctgcagggccagtcagtagtgtaggaactacttagcctggtancaacagaccacctggccaggcctcccgaggcctcctcatctangatgacatcaagtacgggccgcgggactcgtcccgagtccgtacggttcaggtggcgtaggtgggtcgtagacganacgacttcactcacactancacgcgacgtagacgacggtattagtttcgacgttaatttacgtatgtacagactagtataacgtcgtagtccgttcctaccggtacgacgtaacgggaccacgtaccgagtaacgtaacgtaacacgttaggtccggtatacggaccaacctagtccgtttacgttcccgtttaagtcctttccccgtaccccgtatacttaccg

SEQ ID NO: 8646 - DNA, 822 bp, Homo sapiens
  misc_feature: GYAE6OF02GAWNX.44.41.D08.1.454.CMB.1.raw
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
tcagacagtatatacacgaccggtgctcgatttagtcacgcgagaaagggaaagggggaggaactgctcagttaggacccagagggaaccatggaagccccagctcagcttctcttcctcctgctactctggctcccagactaccgacgggaattgtgttgacacatctcagccacctgtctgtntctccgaaggggaaacncgccaccctctcctgacgacggccagtcaggtagttgtacncgtagacctaacgttcgccgttacggtaacccaaccgaacgtaaaccggtggggacctacgggtccctaccgacggtccttcccgtacacgttacgtaacgtacgggaaacctaaccgttaccccgaaccggtaccgggcctaaccggttaccggtacctacccccgtaaccggttacggttccgaaggttcggaccgtacgggggttccggggtacccggaacgtaacgggttacttaacccgtcctaaccgtacccaacggtactaccggtacggcccggttacctacggaccggacgtccggtacggtacgttacggtttccgtaacgtttactttaacgtaaccgtacggtaacctaaacttaacgtttacgtttttaccttttaaccgtccggtttaacggttcggtttaccggacgggttaaccgggtaacgtacggttcccggttaaggaggttaaacctaaggtaaaccggtacgttggggtacccgttcgacgtaccctaacgttacgttcccgttacgttacctacgttacccgttcccgtaaccgtctacggttcttactaatttacg

SEQ ID NO: 8647 - DNA, 811 bp, Homo sapiens
  misc_feature: GYAE6OF02JYHVW.44.41.D08.1.454.CMB.1.raw
  modified_base (177)..(177): a, c, t, g, unknown or other
  misc_feature (177)..(177): n is a, c, g, or t
  modified_base (567)..(567): a, c, t, g, unknown or other
  misc_feature (567)..(567): n is a, c, g, or t
  modified_base (755)..(755): a, c, t, g, unknown or other
  misc_feature (755)..(755): n is a, c, g, or t
tcagacagtatatacacgaccggtgctcgatttagtcacgcgagaaagggaaagggggaggaactgctcagttaggacccagagggaaccatggaacgccccagctcagcttctcttcctcctgctactctggctccagctacgaccgggaattgtgttgactacaatcctcgtacnccaccctgttcctttgtcctccgtaaggggaacgacgcccaccttctccgtgcgacgggaccaggtaccgagtacggttgttaacggtaaaccttacgtttaacgcccggttaggttaactaccgaaacgtacggtaacccgtaccgtcgggtaccgaagggtcccctaacccggtaacggcccttacctaccgtaattaccgtaacgtcgactacggtaccctaacgttacccgaaaagggtttacccggggccccgggttacgggaaccttacccggtacccgtaaccgggtacccggttagggtttactaacgggggttcggaaccgttcggggtcggtacgtacgggaacttaacggaacttaccgtacgaccttatccaaaccgngtaccgaacgtcggtaacgtaccggtacgacggtaagttactttaggtacttacgtttacttacgtcgtaacgcgtacgttacgttaccgtcccgttacgtaccggccgtttacggttcgtaccggttacggggtcccggtacggtaggacgtacggacgttaacgacggtacgtacgtggttaccgngttaccagtacccgtgttacgtacttcgttaccggttctaccggtcgttacctcgg

SEQ ID NO: 8648 - DNA, 187 bp, Homo sapiens
  misc_feature: GYAE6OF01BC77U.11.38.D05.1.454.CMB.1.raw
  modified_base (174)..(187): a, c, t, g, unknown or other
  misc_feature (174)..(187): n is a, c, g, or t
tcagcgagagataccacgaccggtgctcgatttagtatctgatagttgggtttgggggaagaggaagactgacggtcccccaggagttcaggtgctgggccacagcggccctgggctgcctggtcaaggactacttccgtatctctcgctgagcgggctggcaaggcgcatagnnnnnnnnnnnnnn

SEQ ID NO: 8649 - DNA, 173 bp, Homo sapiens
  misc_feature: GYAE6OF01A8BFA.11.38.D05.1.454.CMB.1.raw
  modified_base (173)..(173): a, c, t, g, unknown or other
  misc_feature (173)..(173): n is a, c, g, or t
tcagcgagagataccacgaccggtgctcgatttagtatctgatagttgggtttgggggaagaggaagactgacggtcccccaggagttcaggtgctgggcacagcggccctgggctgcctggtcaaggactacttccgtatctctcgctgagcgggctggcaaggcgcatagn

SEQ ID NO: 8650 - DNA, 179 bp, Homo sapiens
  misc_feature: GYAE6OF01DSUSP.11.38.D05.1.454.CMB.1.raw
  modified_base (174)..(179): a, c, t, g, unknown or other
  misc_feature (174)..(179): n is a, c, g, or t
tcagcgagagataccacgaccggtgctcgatttagtatctgatagttgggtttgggggaaagaggaagactgacggtcccccaggagttcaggtgctgggcacagcggccctgggcttcctggtcaaggactacttccgtatctctcgctgagcgggctggcaaggcgcatagnnnnnn

SEQ ID NO: 8651 - DNA, 569 bp, Homo sapiens
  misc_feature: GYAE6OF01A44HG.11.38.D05.1.454.CMB.1.raw
  modified_base (248)..(248): a, c, t, g, unknown or other
  misc_feature (248)..(248): n is a, c, g, or t
  modified_base (336)..(336): a, c, t, g, unknown or other
  misc_feature (336)..(336): n is a, c, g, or t
tcagcgagagataccacgaccggtgctcgatttagtatctgatagttgggtctggggggaggcttggtacagcctgggggggtccctgagactctcctgtgcagcgtctggattcaccttttagcagctatgccatgacctgggtccgccaggctccgaggggaaggggctgggagtgggtctcagctattagtgatagtggtggtagcacatactacgcagactccgtgaagggccgttcaccatcncagagacaattccatgaacacgctgtatctgacaaatgaacagcctgagagccgaggacacggccgtatattactgtgcgcagatagnttggtagtggtgtagctgctacgtggggccagggaccctggtccaccgtctcctcacgtcctaccaccgaacgggccctacgtccggttcccttccccgtcggccctacccctccctaccaacgcgccaccgtcggcggggccacgacggccggcccgtcgggcctcggccgtggtacgaacggtacctaccgttccgtactccttcgtccgtcgtggcggccgggcgtcggg

SEQ ID NO: 8652 - DNA, 913 bp, Homo sapiens
  misc_feature: GYAE6OF02H3QYG.11.38.D05.1.454.CMB.1.raw
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
tcagcgagagataccacgaccggtgctcgattagtatctgatagttgggtcgtggggagggcgttggtacgagccgtggggggtcccgtggagactctcctgtgcagcgtctggattcacctttagcagctatgccatgacctgggtcccgaccaggcctccgaggggaagggggctggaggtgggtctcgaggctaagttagngataggnggtggtacgacagatacgtacgcagaactccggtgaaaggggccggttacaaccgtatcctccaagacgaactaacttcccgaatgaaaccgactcgtactaactctaggaacctaaaagtgaaaaccacgaccctaggaacgacggtaccgaacgggaccaaccggggttaccgtaaattaacgttaacgttcgggtaggcccgtaggtaaaacggtacgtaaaacggtagttttgggtaaagggggttggggttaaaggggtccgtaaccgggttgtaaaccggttttaaccggggtcggggggggaaacccccttaaacgggggggggtaaacccccttggggggttaaccccggtaaaccggtcccgttacccggtacccgtaaccgggcccccgttaccgaaacccggtaaacccgggggtacccctaacgggtacccgggttacccgttacccccgttccgggacccgttaccccctacccgtaccaaacggtaccgaccctacccggttaccggacccgggggtaccacccggtaacggcccggggtacccccgcggggttcccgtcccgggtacccgttacggggtaaccgtaaccgggtaaacccgttcccggtttaaccccggttaacctttaccgttaccccgttaccggtacccggttccgggaacggtcccgggtaccggtaccggggg

SEQ ID NO: 8653 - DNA, 717 bp, Homo sapiens
  misc_feature: GYAE6OF01EKOT8.14.50.E06.1.454.CMB.1.raw
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (637)..(637): a, c, t, g, unknown or other
  misc_feature (637)..(637): n is a, c, g, or t
  modified_base (674)..(674): a, c, t, g, unknown or other
  misc_feature (674)..(674): n is a, c, g, or t
tcagcgtctagtaccacgaccggtgctcgatttagatctactgacaacacacaaggggacccaacaaccacatccctcctcagaagcccccagagcacaacgcctcaccatggactggacctggaggatccttctttttggtggcagcagccacaggtgcccactcccaggtccaccttgtgctagtctgggctgaggtgaagaagccgtgggcctcgagtgtaaggtttccngacgaaggtcttacnggactaacnccttcacctacttagttgttnttcagtttcgggtcgcccgaccgaccggccccccggaaactaaacggtcttacggaggttgggaacgttggggtagttagggacgtccgaaacggtccgtaggggactaaaacggttacggtaaaaccctaaaaggtaaaaactttactttaccgaacgaacgttaggttaggttttacggaacggggtacctaaggtaacggttacccaaacccgttaacgttaaaccccggaacgggtaactaaacccgtacggtacccggacggtaacgacgtaaccgtacgggttactaaccaggtacggacgtacgaggtacgacgtacgccgttagactaagtcgaagtacgaacggtccgtnttacgtgttactcgtgtaggccgagtagaacgtaggnggaggttagtgtcgttagtggaccgagtcgtagtcgttaaggg

SEQ ID NO: 8654 - DNA, 530 bp, Homo sapiens
  misc_feature: GYAE6OF02FTBQ8.14.50.E06.1.454.CMB.1.raw
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (436)..(436): a, c, t, g, unknown or other
  misc_feature (436)..(436): n is a, c, g, or t
tcagcgtctagtaccacgaccggtgctcgatttagatctactgacaacacacaaggggacccaacaaccacatccctcctcagaagcccccagagcacaacgcctcaccatggactggacctggaggatcctctttttggtggcagcagccacaggtgcccactcccaggtccaccttgtgcagtctggggctgaggtgaagaagcctggggcctcagtgaaggtttcctgcaaggcttctggatacaccttcaccacctatgttgttcattgggtgcgccaggcccccggacaaaggcttgagtggagtgggatggatcgaacgctggcaataggtaacacaaaatatacacagatgttcaggcagancaccattacaggacacntccgacgagcacacgtctacatggagctagagcagcctgagatcgagaanacgacgcttagtgttatacgtgtgacgtagagagtaaggaggacggtagttggacgttagtttcggtacggtactccgggtcgtacgttaaggg

SEQ ID NO: 8655 - DNA, 783 bp, Homo sapiens
  misc_feature: GYAE6OF02H75K0.14.50.E06.1.454.CMB.1.raw
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
tcagcgtctagtaccacgaccggtgctcgatttagatctactgacaacacacaagggacccaacaaccacatccctcctcagaagcccccagagcacaacgcctcaccatggactggacctggaggatcctctttttggtggcagcagccacaggtgcccactcccaggtccaccttgtgcagtctggggctgaggtgagaagcctgggcctnagtgaggtttccngccgaaggcttcnggactacaccttnacccactatgttgttcagtttgggtgcgcccgtacgggcccccggaacaaagggtccttagaggtcggagtggggagtgggattcgaacgtcgtgggtataaacggtcggttaaaaccaacgtaaaaaacttacgtttacgaaaccgtaaggtaacgttttcgggtttaacgaacgggggtttactaacggacggtttcccaaaaccggtacgttttaacccgggaacggggtaacctaaacccgtaccgttacccggtaacggtaccggaaccccgtaacgaaccgggttaccttaacgaaacggtcgggaagtcggttcgaacggtacaacggtcccgtaagacggtactacggttacggaaaccggtacgtaaccgggtcttccggtttagttactaaccggttggtacgggttacggacggtaaggtacgtaaagggtacggggtacggtaagggtttacgggacggttaacggttttcgggacgggttaccccggtttaccggggtaccgtacggttttaacgggg

SEQ ID NO: 8656 - DNA, 782 bp, Homo sapiens
  misc_feature: GYAE6OF02JBE83.14.50.E06.1.454.CMB.1.raw
  modified_base (248)..(248): a, c, t, g, unknown or other
  misc_feature (248)..(248): n is a, c, g, or t
tcagcgtctagtaccacgaccggtgctcgatttagatctactgacaacacacaaggggacccaacaaccacatccctcctcagaagccccagagcacaacgcctcaccatggactggacctggaggatcctacgttttggtggcagcagccacaggtgcccacctcccaggtccaccctgtgcagtcgtggggctgaggtgaagaagccgtggggcctcagtgaacggtttcctgcgaaggtcttcgnggactactaccttacacctacctatcgtttacgttcagttagggtgccgtaccgacgggccccccggtaacaaacgggtcgttcgaggtacggagttggggagtggaacgtccgaacggacgtaggaccaagttacggtaacctaacgtaaaagttacgttaaccgaacgtaaggtaacttacgggttttacggaacgggacgttaaacggacggttaacccgaccgttaaaccgttacccggaaacggggtaacctaacccgttaaagccccggggtacctaacgggaccaaaccgttacgtaaccgtaaacccgtagttacgggaacgtaccgtaggtaacgtacccggtagaccgtaggtaacgtacgtaccgaagtaaccggaccgtaacgcgggttacgttaggttacttagttcggtacggaacgagttaaggaacggttaaacgggcgggtaacggttaacgttcgggtaacgttaaggtttagggttaccggaccgggttaccggtaccgggttagtttaaccggg

SEQ ID NO: 8657 - DNA, 179 bp, Homo sapiens
  misc_feature: GYAE6OF02FGRHF.45.50.E06.1.454.CMB.1.raw
  modified_base (178)..(179): a, c, t, g, unknown or other
  misc_feature (178)..(179): n is a, c, g, or t
tcagacgcgatcgacacgaccggtgctcgatttagatctactgacaacacacaagggcccatcggtcttcccctggcgccctgctccaggagcacctccgagagcacagcggccctgggctgcctggtcaaggactacttcctcgatcgcgtctgagcgggctggcaaggcgcatagnn

SEQ ID NO: 8658 - DNA, 180 bp, Homo sapiens
  misc_feature: GYAE6OF02HVMJD.45.50.E06.1.454.CMB.1.raw
  modified_base (178)..(180): a, c, t, g, unknown or other
  misc_feature (178)..(180): n is a, c, g, or t
tcagacgcgatcgacacgaccggtgctcgatttagatctactgacaacacacaagggcccatcggtcttccccctggcgccctgctccaggagcacctccgagagcacagcggccctgggctgcctggtcaaggactacttcctcgatcgcgctgagcgggctggcaaggcgcatagnnn

SEQ ID NO: 8659 - DNA, 588 bp, Homo sapiens
  misc_feature: GYAE6OF01B46R0.53.11.A11.1.454.CMB.1.raw
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
tcagcgcgtatacacacgaccggtgctcgatttagctacgactgcagggggtgggtccaggaggcagaactctgggtgtctcaccatggcctggatccctctacttctccccctctcactctctgcacaggctctgaggcctcctatgaggtgacacagccaccctcggtgtcagtcgtccccaggacagacggccaggatcacctgctcnggagaggcattggacaaaacatanggatagttggaccgcagaagcaggccaggccctgtgttggtaatatataaagacgaggagacggccccgaggactcccgtgagcgatactcgtggctcagctcgacggacaacagtcacattcgacatcagtggagtcgagacagaagacggaggacctagtaactagttactgtactaatcgtggacggacagacgtagttcggttctcgtagtggtaggtttacgttcgggacgggaacgggtaaccgaacgtccgtacggacccggttaccgtacgggtaccgtaccggacccgaacgggtccgtcccggtacccccgtaccgggttcccaccgttcccgttacccccgg

SEQ ID NO: 8660 - DNA, 487 bp, Homo sapiens
  misc_feature: GYAE6OF01EG9XR.53.11.A11.1.454.CMB.1.raw
  modified_base (408)..(408): a, c, t, g, unknown or other
  misc_feature (408)..(408): n is a, c, g, or t
  modified_base (456)..(456): a, c, t, g, unknown or other
  misc_feature (456)..(456): n is a, c, g, or t
  modified_base (479)..(479): a, c, t, g, unknown or other
  misc_feature (479)..(479): n is a, c, g, or t
tcagcgcgtatacacacgaccggtgctcgatttagctacgactgcaggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggccctgtgttggtaatatataaagacagggagaggcccccagggatccctgagcgatactctggctccagctcagggacaacgagtcacattgacatcagtgagtccagcagaagcgagctgactatactgtcaatctgcgacngcagtgtctcatgtgtattcgggcgaggccaagctgaccgtctaggcncgcccaagctgaccccctggtcnctcgtccg

SEQ ID NO: 8661 - DNA, 616 bp, Homo sapiens
  misc_feature: GYAE6OF01BIHXI.53.11.A11.1.454.CMB.1.raw
tcagcgcgtatacacacgaccggtgctcgatttagctacgactgcaggggtgggtccaggagggctagaactctgggtgtctcaccatggcctggataccctactacttctccccctcctcactctctgcacaggctctgaggcctccgtatgacggtgacacagccaccctcggtgtcagtgtccccaggacagacggccaggatcacctcgctctggagaggcattggcaaaacgatactggatagttggtaccgcagaagccgaggccaggccctgtgttacggtaacgtagtataaagacgagggagacggccccgagggactccgtgagcgatactcgtgctcagctcaggacaacgacgtcacattcgaccactcgagtcggacgtaccgaggacacgaacgacgacggctacgactacttacgtgtacactcgtgacgacgagtcgtagttcgttctacgtagttgttaggttacgttacgggacgggtaacgggtacctaaggtccgttacggtacccggttccgttaacgggtacccgtacgtaccccgtaagggtccttaccgggtaccccccgttacgggtaccctcccgttccggttaccccgg

SEQ ID NO: 8662 - DNA, 520 bp, Homo sapiens
  misc_feature: GYAE6OF01B93M1.53.11.A11.1.454.CMB.1.raw
  modified_base (254)..(254): a, c, t, g, unknown or other
  misc_feature (254)..(254): n is a, c, g, or t
  modified_base (339)..(339): a, c, t, g, unknown or other
  misc_feature (339)..(339): n is a, c, g, or t
  modified_base (403)..(403): a, c, t, g, unknown or other
  misc_feature (403)..(403): n is a, c, g, or t
tcagcgcgtatacacacgaccggtgctcgatttagctacgactgcagggggtgggtccaggaggcagaactctgggtgtctcaccatggcctggatccctctacttctccccctctcactctctgcacaggctctgaggcctcctatgaggtgacacagccaccctggtgtcagtcgtccccaggacagacggccaggatcacctgctctggagaggcattggacaaaacatatggatattggaccgcagagcngcagccctgtgttggtaatatataaagacagggagaggcccccaggactccgtgagcgatactctggcctcagctgagggacaanagtcacattcgaccatcagtggagtccagcagagacgagctgactatatgacaatcgtgcgacngcgagttcggttactagagtgttaggtacgtttcgggacggagggtaccaagcgtagacccgtcgtaggtcacggcccgaacggtctccggaccccctgggcctacgtcgtccccgg

SEQ ID NO: 8663 - DNA, 597 bp, Homo sapiens
  misc_feature: GYAE6OF01ATGMC.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctctcactctctgcacaggctctgaggcctcctatgaggtgacacagccaccctggtgtcagtgtccccaggacagacggccaggatcacctgctctggagaggcattggacaaaaacatatggatagttggtaccgcagaagccaggccaggcccctgtcgttggtaatatataaagacgagggagacggcccccgagggactcccgtggagcgatactcgtggctccagctcgaggacaacagtcacattgaccatcagtgacgtccgaggcaagaagacgagcgtagaacgtattacgtgtactaatcgtgcggacagcgagttcgttactcgagttggttacggtagttcggggacggacgggtaaccaaggtccgtacggaccccggttacgtaacgggttccgaccggaccccgaaagggttcccgtacccgggtccccccgttaccgggtaccctaccgttcccggtttacccccggg

SEQ ID NO: 8664 - DNA, 595 bp, Homo sapiens
  misc_feature: GYAE6OF01BTXDI.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacatatggatatggtaccgcagaagccaggccacggccctgtgttaggtaatatataaagacgaggggagacggcccccgagggactcccgtgagcgatactcgtggctccgagctcgagggacaacagtcactatcgaccagtacaggtggagtccgaggcaaggagacgagctagactatacgtgtacatcgtgacggacagctaggtcgttctcgagttggttgggttaacgttcgggacgggtaacgggaccgtaacggtccgtaccggtacccggtccggttaggtacccgcggaccccgtaaggccccgttacccggtccccccgttaccgggtaccctaccgtttcccgttacccccgg

SEQ ID NO: 8665 - DNA, 633 bp, Homo sapiens
  misc_feature: GYAE6OF01C4M5E.53.11.A11.1.454.CMB.1.raw
  modified_base (213)..(213): a, c, t, g, unknown or other
  misc_feature (213)..(213): n is a, c, g, or t
  modified_base (257)..(257): a, c, t, g, unknown or other
  misc_feature (257)..(257): n is a, c, g, or t
  modified_base (425)..(425): a, c, t, g, unknown or other
  misc_feature (425)..(425): n is a, c, g, or t
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagcccaccctcggtgtcagtgtccccaggacagacggccaggatcacctgctcgnggagaggcagttggacaaaacaatagtggatagttggtaccggngagaagccgaggccacggccctgtgttaggtaatatataaagacgagggagacggccccgagggactcccgtgacgcgatactcgtggctccagctacgaagggacaacgagtacactattcgaccatcgaggtacggacgtaccgaaggacgaaggaacggaacggnggtacgtagtaacttaattaccgttgtaactaacgttcgtagaccggacgagtactaggttcgttactcgtagttgggtaggttacgttaccggggcggggtaacggggtaacccaggtaccgtacggtacccgttacggtacggtccgacggtacccggacggtccgtacccggtcccccgtacggtacctccgttccgttccccgg

SEQ ID NO: 8666 - DNA, 567 bp, Homo sapiens
  misc_feature: GYAE6OF01ACR8Y.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacaatatggatattggtaccggcagaagccaggccaggcccctgtcgttggtaatatataaagacgagggagacggcccccagggactcccgtgagcgatactctggctcagctcgagggacaacgagtacactattgacctatcagtggacgtccgaggcagaagacgaggctagactattacgtgtactaatcgtagacgacagctagtgttctcgtagttcggttagtacgttcggacggacgggaccgtaagcgtacgtacccggtcgtacggttcgacgacccgaacggccctccggtaccccccgttcggtcctaccgttccgttcccccgg

SEQ ID NO: 8667 - DNA, 807 bp, Homo sapiens
  misc_feature: GYAE6OF01BC3F2.53.11.A11.1.454.CMB.1.raw
tcagcgcgtatacacacgaccggtgctcgatttagctacgactgcagggggtgggtccaggaggcagaactctgggtgtctcaccatggcctggatccctctaccttctccccctcctcactctctgcacaggctctgaggcctcctatgaggtgacacacgcccaccctcggtgtcagtcgtccccaggacagacggccaggatccacctgctcgtggagaggcagttggaacaaaacaatagtaggtaattagttacgggtaccggacaaggaacgccgaacgggccaacggcccctggtgtttagggtaattagtaataaaagtacgaggggaacggacggacccccgagggactacccgtagacgacgtatactctcgggcctccgacgctacgaagggacaacgacgtacactagttacgacctacgtacgtacgtagggtacgtaccggaaggaccgaaaggtaaacgggaacggaacgggtacccgtaaggtaaccgtttaaacgtttaaccgttacggttaaccttaaacgtcgtttaccgggaccgggtaaccgtaaggtaccggtaacgggtttacggttaccggttacgtaacgggttagggtttaacgggtttaccgggtttaccggggacgggggtaaccgggtaaccggaacggtacccggtaccgggttaaccccggttacccgggttacgggtaacccggtaccgggaaccccggtaacgggtaccccggttacccgggtaccccccggttacccgggtacccttcccggttccccggtttaccccccggg

SEQ ID NO: 8668 - DNA, 678 bp, Homo sapiens
  misc_feature: GYAE6OF01C52V4.53.11.A11.1.454.CMB.1.raw
tcagcgcgtatacacacgaccggtgctcgatttagctacgactgcagggggtgggtccaggaggcagaactctgggtgtctcaccatggcctggatccctctacttcctccccctcctcactctctgcacaggctctgacggcctcctatgaggtgacacagcccaccctcggtgtcagtcgtccccaggacagacgccaggactcacctgctcgtggagaggcagttggaacaaaacaatagtaggaatagttacggaccggcaagaagccgaaggccacggccctggtgttaggtaatataagtaaagacgagggaacgacggaccccgagggactcccgtagacgacgactacgtcgtcggctccgaacgcgtacgaacgggacaaacgagtaccaactacttagaccctagtaccgaggtacggacgtaccgaggaccgaaggtaacggacgtaacggcgtagaacttaagttaactcgtaactaatccgtaggaccgaacaggtaccgaaggtttcgtaccttagtaagtttgggttaggttgttttacggggacgggtaacggtaaccgaaggtccgtaacgggtacccgttcgggtaccgttacgaccggacccgtaacggtcccgtacccggtacccccgttgggtacccaccgttcccgttacccccgg

SEQ ID NO: 8669 - DNA, 604 bp, Homo sapiens
  misc_feature: GYAE6OF01AYZWK.53.11.A11.1.454.CMB.1.raw
  modified_base (370)..(370): a, c, t, g, unknown or other
  misc_feature (370)..(370): n is a, c, g, or t
tcagcgcgtatacacacgaccggtgctcgatttagctacgactgcagggggtgggtccaggaggcagaactctgggtgtctcaccatggcctggatccctctacttctccccctctcactctctgcacaggctctgaggcctcctatgaggtgacacagccaccctcggtgtccagtgtccccaggacagacggccaggatcacctgctcgtggagaggcagttggacaaaacatagtggaacttagttggtaccggcaagaagccaggccaggccctgtcgttaggtaatatataaagacgtagggagacggccccagggactcccgtggacgcgatacgtctggcctccgagctcgacgggacaacgngtacacagttcgaccatcagtggacgtccgaggcaagacgacgagcgtagactattacgtgtacaagtcgtagacgtacacggacgtaggttcggttactacgtagttacggttggttacgttccggggacggtaacgggacctaacggtcgtacggtaccggtacgtagggtaccacggacccgtaacggtccgtacccggtaccccgttcggtacctccgtccgttaccccg

SEQ ID NO: 8670 - DNA, 587 bp, Homo sapiens
  misc_feature: GYAE6OF01BNX5P.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtcccccaggacagacggccaggatcacctgctctggagaggcattggacaaaacatatggatattggtaccggcagaagccaggccaggcccctgtgttggtaatatataaagacaggggagacggcccccgagggactcccgtggagcgatactctggctccagctcgagggacaacgagtcactagttacgaccatcaggtggagtccgaggcgaagaagacgaggcgtagacttattactgtacaatcgtgcgtacagcgagtgttctcgtagtggttggttagttccgggacgggtaacgggaccgtaacggtctacggtacccgtccggttaacgggtacgaccggaccccgaagggtccctccggtaccccccgttccggtcctaccgttcccgttcccccgg

SEQ ID NO: 8671 - DNA, 543 bp, Homo sapiens
  misc_feature: GYAE6OF01ESRCB.53.11.A11.1.454.CMB.1.raw
  modified_base (249)..(249): a, c, t, g, unknown or other
  misc_feature (249)..(249): n is a, c, g, or t
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacatatggatatggtaccgnagaagccaggccagccctgtgttggtaatataataaagacgagggagacggcccccgagggactccctgagcgatactctggctccagctcgagggacaacgagtacactattacgaccatcgagtggacgtccgaggcaagaacgacgaggctagactattactagtacaatcgtagcgacacgctagtgttactacagttgtggttagttcgggacggacggacgagtcgtacgtaccgtcgtaggcgacgacccgaacggcgtccgccccgtcggtcctcgtccgttcccg

SEQ ID NO: 8672 - DNA, 553 bp, Homo sapiens
  misc_feature: GYAE6OF01CHMLB.53.11.A11.1.454.CMB.1.raw
  modified_base (508)..(508): a, c, t, g, unknown or other
  misc_feature (508)..(508): n is a, c, g, or t
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagcccaccctcggtgtcagtgtcccccaggacagacggccaggatcacctgctctggagaggcattggacaaaacatatggatattggtaccgcagaagccaggccaggcccctgtgttggtaatatataaagacgagggagacggcccccgagggactcccgtgagcgatactctacggctccagctcgagggacaacgagtcacattagaccatcagtggacgtccgaggcaagaagacggaggctgaacttagttactgtactaagtctagcggacagcgtagttggtctcgtagtggtggtagttcgggacggtagggaccagtcctaggacccgtcgtaggtacncggcccaagggcccgtccgccccgtcggacctcgtcgttaccccg

SEQ ID NO: 8673 - DNA, 902 bp, Homo sapiens
  misc_feature: GYAE6OF01CVG9Q.53.11.A11.1.454.CMB.1.raw
  modified_base (129)..(129): a, c, t, g, unknown or other
  misc_feature (129)..(129): n is a, c, g, or t
tcagcgcgtatacacacgaccggtgctcgatttagctacgactgcagggggtgggtccaggaggcagaactctgggtgtctcaccatggcctggatccctctacttctcccctcctcactctctgcacnggctctgaggcctcctatgaggtgacacagcccacctcggtgtcagtcgtccccaggacaggaccggccaggactcacctgctcgtaggagaggcagttggacaaaactagtagtggatagttgggtaaccggcagaagccaggccacggtccctgtgttaggtaatataagtaaagacggagggacgacggaccccgaagggacctacccgtaggacgtacgtacgtaacgtccgtcgggtccctaccgacgtcgtacggaacggggtaacccaacgacggttaccaacgtactttacgacctaagtaccgtaaggtacggtacgtaccgaacgggtaccgaacggaaacggaaccgggaacgggtacgttacggtaaaccgtttaacgttaaccgtttacggtaaacccgttaaaccgttaccggttacgggtaccgggtaaacccgtacgggtaacccgttaacggggtttaccggtttaaccgttaaccggttaacgggtttaccggggtttaacgggtttaccgggtttaacccgggggtaccggggggtaaacccggggttaaaaccccgtaaacgggttaccccggtttaccggggtaaacccccgggtttaaacccgggttaacgggtttaaccccggtaaacccgggtaaacccccgggtaaaccgggttacccccggttacccccggggttaacccccccccggttacgggggtttaaccccccttaaccccgggttttacccccgttttaaccccccccggg

SEQ ID NO: 8674 - DNA, 604 bp, Homo sapiens
  misc_feature: GYAE6OF01DO19S.53.11.A11.1.454.CMB.1.raw
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
tcagcgcgtatacacacgaccggtgctcgatttagctacgactgcagggggtgggtccaggaggcagaactctgggtgtctcaccatggcctggatccctctacttctccccctctcactctctgcacaggctctgaggcctctatgaggtgacacagccaccctcggtgtcagtcgtccccaggacagacggccaggatcacctgctctgggagaggcattggacaaaactatatggatatttggacggcagaagccaggccaggccctgtgtggtaatatataaagacagggagacggccccagggactccctggagtcgatactntggctcngctacgagggacaacagtcactacttagaccatacagttggacgtccgagaccaggaagacgaggctgaacttagttactaggtctaaatcgtacggccggtaacgagccgtaaggttcggtttactcgtacgttgggttaagggttacgtttcggggacgggaacgggacccgtaaggcgttacggtacccgttaccgtacggggttcacccggacccgaggtcccgtaccggtcccccgtaggttcccgaacttccgtttacccccg

SEQ ID NO: 8675 - DNA, 723 bp, Homo sapiens
  misc_feature: GYAE6OF01EBG16.53.11.A11.1.454.CMB.1.raw
  modified_base (275)..(275): a, c, t, g, unknown or other
  misc_feature (275)..(275): n is a, c, g, or t
tcagcgcgtatacacacgaccggtgctcgatttagctacgactgcgagggggtgggtccaggaggcagaactctgggtgtctcaccatggcctggatccctctacttcctccccctcctcactctctgcacaggctctgacggcctcctatggaggtgacacagcccaccctcggtgtcagtcgccccgaggacagacggccaggactccgacctgctcgtggagaggcagttggaacaaaataagtagtaggtaattagttcgggtaaccgganagaacgccgacggccgacggcccgttgtcgttaggtaatagtaagtaaaggacgaagggacggaccgggtaccccgagggacctccgtagacgacgacgtactcgtcggcgtaccgagcgtacgaaggacaacgacgtacactatcgacgatacgaggtcggacgtcgaaggacgaacggaacgacggtaggtacgtagtacgtaagttacgtagtaactacgtacgacggacgacgacgtatacggttacgtactgtagtggttacggttcggttccggggacggtaacgggtaaccgtaggtaccggtaccgggttaacccggttaccggttacgggacccggttaaaccggacccccgggtaaaccgggtccccgtttaccccgggttaccccccggttacccgggttaaccctttacccgggtccccggtttttaccccccggg

SEQ ID NO: 8676 - DNA, 802 bp, Homo sapiens
  misc_feature: GYAE6OF01BCZTF.53.11.A11.1.454.CMB.1.raw
tcagcgcgtatacacacgaccggtgctcgatttagctacgactgcagggggtgggtccaggaggcagaactctgggtgtctcaccatggcctggatccctctacttcctccccctcctcactctctgcacaggctctgaggcctcctatgaggtgacacgacgccaccctcggtgtcagtcgtccccgaggacacgacggccaggactccacctgctcgtggagaggcagttacggacaaaaacatagtaggatagttcgggtaccggacaaggaacgcccgaggcccgacgggaccccttggttaggtttaggtaaattaagtaaagtaaaaggaccggaaggggtacggacccggggacccccgaaggggtaccctcccggtagtaccggacgaactttacccgtcggtcggtccctacccgtaggtaccctcggaaacgggtaacccaacgtacgtacccgaactacgtttacgaccctagtcgaacgggtacggtacgtacccgaggaccggaaaggaacggaccgggtaggacccgttaagaacctttaacgtacgtcgttaacgacgttaccgaggtacgaaccgtaggtaccgttaggttaccggttctaacgttaggttacgggttacgggtttaccgggttacgggggtaccggaaccgggttaacccgaacgggttcccgtaaccggttacccgggttacccgttaaggcccggtacccggtacccggtaaccggtccccgtaccccggtccccccgttagggtccccttacccgggttcccgttacccccg

SEQ ID NO: 8677 - DNA, 701 bp, Homo sapiens
  misc_feature: GYAE6OF01A33O3.53.11.A11.1.454.CMB.1.raw
  modified_base (125)..(125): a, c, t, g, unknown or other
  misc_feature (125)..(125): n is a, c, g, or t
  modified_base (156)..(156): a, c, t, g, unknown or other
  misc_feature (156)..(156): n is a, c, g, or t
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
tcagcgcgtatacacacgaccggtgctcgatttagctacgactgcagggtggtccaggaggcagaacttctgggtgtcgtcaccatggcctggatccctctacttctaccccctctcactctcgngcacagctctgagcctcctatgaggtgacanagccacctggtgtcagtgtccccagacagtacgcgagtatcgacctagctcgtgagngcatgacaaacaatacgtgatacttcggtacccgngagacgccacgccgacggccctggtcgttacggaatataataaacgacgagggtaccgaacggcccccgaaggctacccgtaggacgtacgacttacgcgtacggctccgagtcgacgacgggaacctaacgagtaccgaactacgtttacgaaccagtttaccaggtagggactacccgaagaccgtaagaagaaccggaggtaccgtaggaacttaagtacgttacgtacgaaactcgtacgaccggaagacgacgtaacggttcggtttactacgttaacgttacggttaacggttagtttaccgggacgggttaacggaacccggtaaacgtaccgtacgggtaacccgttaccccggttaagggttcccaaccggtacccgaaaaccgggttcccgtaccccggtccccccgttacggtaaccccgtaaccgttcccgttaacccccg

SEQ ID NO: 8678 - DNA, 669 bp, Homo sapiens
  misc_feature: GYAE6OF01CBXCL.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacacgcccaccctcggtgtcagtcgtccccaggacaggaccggccaggatccacctgctcgtaggagaggctagttcggaacaaaacatataggattagttcgggtaccggcaggaacgccgacggccacggcccctgtggttagtaatataataaagacgagggacggaccggaccccgaggacctcccgagacgcgatactcgtggcctcgacgctgaggacacgagtcgactactacgactagtcgtaggtggtacggtccgtagggacgaagaacgacggtaggacgtagtaacttattaacgtctactaatcgtcgacggtacacgtacgtaacggttcggttactcggtaagttgggttacggttacggttccggggtacgggaacgggtaacccgaggtacccggtacggtacccggtaccggttagggaccgaacccggtcccggaaacggtccccgtacccggtcccccgttacccggaccgttcccgtcccggtttacccccg

SEQ ID NO: 8679 - DNA, 716 bp, Homo sapiens
  misc_feature: GYAE6OF01CFNYS.53.11.A11.1.454.CMB.1.raw
  modified_base (132)..(132): a, c, t, g, unknown or other
  misc_feature (132)..(132): n is a, c, g, or t
  modified_base (139)..(139): a, c, t, g, unknown or other
  misc_feature (139)..(139): n is a, c, g, or t
  modified_base (155)..(155): a, c, t, g, unknown or other
  misc_feature (155)..(155): n is a, c, g, or t
  modified_base (173)..(173): a, c, t, g, unknown or other
  misc_feature (173)..(173): n is a, c, g, or t
  modified_base (260)..(260): a, c, t, g, unknown or other
  misc_feature (260)..(260): n is a, c, g, or t
tcagcgcgtatacacacgaccggtgctcgatttagctacgactgcagggggtgggtccaggaggcagaactctgggtgtctcaccatggcctggatccctctaccttcctccccctcctcactctctgcacnggtctcngacgcctctatgagtnacacacgccaccgtggtnctagtcgtcccgagacaggacgccaggactccgacctgctcgtggagagctagtacgaacaaatatagtggaatagttacggacganaagacgccgaacggccgtaccggtcccgttaggttcggttaacggttaaataagttaaagtaaaacggtacgggaacggggacggtacccgggaaccccggtagggtaccctaccgtaggacgtaacgtactacgtcgacgtacctcgaacgccgtaacggaacggtaaccaagtacgtacgtaaatacgttacgacctacgtaccgtaggtacgggaactaccggaacggtaacggaaacggtaacgggacggtaacgggtaactaggtaacttacgttactacgtaactacgtcgtacgacggtaacgacgttacggtcggttctacgtagttacggttcggttaaggtccggttacgggacggtaaccggtacgacgtaccgtaccggtaacgtcggtacgaaccggacgtacgccgtacccgtccgtaccgacgtccttcgtcccgtacccg

SEQ ID NO: 8680 - DNA, 878 bp, Homo sapiens
  misc_feature: GYAE6OF01APY0C.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacacgcccaccctcggtgtcagtcgtccccaggacagaccggccaggatcacctgcctcgtgggagacggctagttacggaaccaaaaactaattagtagggtaattaggtttacgggtacccgggacgaacggaaacggacccgacgggacccgaccgggtcccccgttaggtttagggtttacggttaaagttaagttaaagtaaaacggaaccggaacgggggaacggacccgggaccccccggtaaggggtaccttaccccggttaggaaccggtaccggtaaccgtttaccgttaccggtcgggtacccgttacccgaacggtacccgttaccgggaaaccggggtaaccgtaaaccgtaacggttaaccaacttaacgttaccggaaaccctacgtttacggaacggttacgggtaccggtaaccggacgggtaccgaaggtaacggaacggacggtaccggtacgtaacttaacgttaccgtagttaacctagttcgtaccggacggaacgtcgtacggtacggtttcggttacgtactaggtttggttacggggttacgttaccggggacgggaacggtaccggacggtacccgttaccggtaacccgggttcccggttaacgggacccggtaaccggtaaccccggaccgggttaccccgttccccggaccccccggttacggttacccgttcccgttccggtttacccccgg

SEQ ID NO: 8681 - DNA, 896 bp, Homo sapiens
  misc_feature: GYAE6OF01AQW4O.53.11.A11.1.454.CMB.1.raw
  modified_base (80)..(80): a, c, t, g, unknown or other
  misc_feature (80)..(80): n is a, c, g, or t
  modified_base (127)..(127): a, c, t, g, unknown or other
  misc_feature (127)..(127): n is a, c, g, or t
  modified_base (156)..(156): a, c, t, g, unknown or other
  misc_feature (156)..(156): n is a, c, g, or t
  modified_base (177)..(177): a, c, t, g, unknown or other
  misc_feature (177)..(177): n is a, c, g, or t
tcagcgcgtatacacacgaccggtgctcgatttagctacgactgcgagggggtgggtccaggaggcagaactctggggtntctcaccatggcctggactccctctacttcctcccctctcactctcngcacaggctgtgacgcctctatggaggtnacacacgcccacccgtggtcncgtacggtccgtacccggaggacgacggaccggccaaggtactacctaccgtcgcctcggtaggacggacggtcttacggttacggaaaactaaaaaccggtaattacggtaggtaaacgttacgggttaccggggtaacccggaagaaccggaaccggaccggaacccgggacccggtacccgggttcccggttagggtttaggttaaaggttaacttaaaggtaaacggtaaacgggaaccggggaacgggggtaaccggaaccccggggtaccccggacggggtaccgtaccggtaggacggacgtacctaccgtcggccgtcgtaccggacgtacgtacgggaacgaaccgtaacgtactacgtaactacgtacggtacctcggtaacggtcgggtaccgggtacgaccggaacgggacggaaacggaacgggtcggtaacggtaccgttaacttaaccgtttaacgtacgttaacctaacggtacgttaccgggtacggaccggtaacggttcgacggtttcggttaccggttacgtacgttacggggttgggttaacgggttcgggaccgggtaacggggaccggtaacggtaccgggttaccgtaccgggtacggttacccgggacgtacccgggtaaccgtcccgggtaacccgccccggttcccgggttaccccggtacgtacccgtttccggtccccgtttcccccggg

SEQ ID NO: 8682 - DNA, 845 bp, Homo sapiens
  misc_feature: GYAE6OF01BPFWS.53.11.A11.1.454.CMB.1.raw
  modified_base (101)..(101): a, c, t, g, unknown or other
  misc_feature (101)..(101): n is a, c, g, or t
  modified_base (168)..(168): a, c, t, g, unknown or other
  misc_feature (168)..(168): n is a, c, g, or t
tcagcgcgtatacacacgaccggtgctcgatttagctacgactgcagggggtgggtccaggaggcagaactctgggtgtctcaccatggcctggatccctntacttctcccctctcactctctgcacaggctctgaggcctctatgaggtgacacagccacctcggtntcagtcgtccccaggacagacggccaggactcaccgtgctcgtaggacgaggctagttcggaactaaaaacctatagtgggtaattagtttcgggtaccggcaaggaacgccgaggccgacggtccctaggttcgttaggtaaacttagtaactaaaggtacgaggggacgaccggcccccgtagggactcccgtgaacgtcgaacttacgtacgtcggacctcgacggtactacggtaacgggaacaaacgtacgtaccgacgtaagtttacgaccgtacgtacgtagggttacggtaacggttaccgtaacgggtacgtaaacgggaacgggtaaccggtacggtaccgttaacggtaaccgttaagtttaacccgtcggttaacctaaacggttcgtaccgggacgtaacgtacggtacggttacggtttaccgggtttactacgttaacggttagggtttaccggtttaacgggttcccgggggtaaccgggttaaccggggtaaacccgttacggggtaccccgttaaccggggtttaacccgggtaacccggtttaacggggtacccggttaacccgggtaaccccggtaaaccggggttcccgttacccccggggttaccccccggtttaacggttccccgttaaccggtttccccggtttaaccccccg

SEQ ID NO: 8683 - DNA, 844 bp, Homo sapiens
  misc_feature: GYAE6OF01DPOPC.53.11.A11.1.454.CMB.1.raw
tcagcgcgtatacacacgaccggtgctcgatttagctacgactgcgagggggtgggtccaggaggcagaactctgggtgtctcaccatggcctggatccctctaccttcctcccctcctcactctctgcacaggtctctggacgcctcctagtggaggtgacacacgcccaccgtcggtcgtcgagtccgtccccgaaggaccgaggacccggccgaaggactccgacctgccttcgagggaacggaggtactagttacggaaacaaaacaattagtaggaacttagtaccgggaccgaagacggaacgccggacggccgaccggtacccgtggttaggtacggtaataacgtaagaaacgacgggtaagggaacggtaaccggaccccgacgggtaaccctccggtaggaccgtacgtactaccgttccgtaccggactaccgcgtacggtaaccgaacggggtaaaccctaacgtaccggtacctaaacgttaccgttaaccgaccaacggttaccgtagggtacgtaaccggacgaacgggtaacgtaacgggaacgggttaacggaggtacccgttaacgtaccgttaacgttaaccgttacgttaaacgtaacgttaccggtaccggacggtaacccgtagggtacggtttcggtttacggtaccttaggttacgggttagggtttacgggttaccgttaacgggggacggtaacgggtacccgtacggttccggtaacgttacccgggttccggaacggtcggaacccgtaaccgggcccggttacccgtcccggtacccccgtacggttaccctacccggttcccggtttaccccgg

SEQ ID NO: 8684 - DNA, 499 bp, Homo sapiens
  misc_feature: GYAE6OF02G0872.53.11.A11.1.454.CMB.1.raw
  modified_base (399)..(399): a, c, t, g, unknown or other
  misc_feature (399)..(399): n is a, c, g, or t
tcagcgcgtatacacacgaccggtgctcgatttagctacgactgcagggggtgggtccaggaggcagaactctgggtgtctcaccatggcctggatccctctacttctcccctcctcactctctgcacaggctctgaggcctcctatgaggtgacacagccaccctcggtgtcagtgtccccaggacagacggccaggatcacctgctctggagaggcattggcaaaacatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattacngtcaatctgcggacagcagtggttctgatgtggtattcggcggagggaccaagctgaccgtctaggtcagcccaaggctcgccccctggtcactctccgg

SEQ ID NO: 8685 - DNA, 493 bp, Homo sapiens
  misc_feature: GYAE6OF02GAVH0.53.11.A11.1.454.CMB.1.raw
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagacggcccccagggatccctgagcgatactctggctccagctcagggacaacagtcacatgacatcagtgagtccagcagaagacgaggctgactatacngtacaatctgcgacagcagtgtctnatgtgtatcggaggaggacagctagaccgtctaggtcacgaccgagctcgccccgtggtcctacgtctccg

SEQ ID NO: 8686 - DNA, 653 bp, Homo sapiens
  misc_feature: GYAE6OF02FF6XQ.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgagtgacacagccacctcggtgtcagtcgtccccaggacagacggccaggatccacctgctctggagaggcattggacaaaacatatggatattggtaccggcagaagccaggccacggcccctgtgttaggtaatatataagacgagggagacggccccgaggactcccgtggacgacggataccgtcgtcggctccgaagcctacgacggggaaccaacgtagtccaactatacgacctatcgaggtcggacgtccgaaggcaaggaacgacgaggtctaggtaacttaacttaccgtagttaccaaattccgttaggaccggtaacgacggtacgtaacggtttcggtccttacgtaagttggtacgggttacgttccgggacgggtaacggacccgtaaggtccgtacggtacccgttaccggtacggtaccgtaacggaccccggtaaggtcccgtaccggtaccccccgttcggtaccctacccgttccgttaccccgg

SEQ ID NO: 8687 - DNA, 576 bp, Homo sapiens
  misc_feature: GYAE6OF02INQMW.53.11.A11.1.454.CMB.1.raw
  modified_base (417)..(417): a, c, t, g, unknown or other
  misc_feature (417)..(417): n is a, c, g, or t
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcactgctctggagaggcattggacaaaacaatatggatagttggtaccggcagaagccaggccaggcccctgtgttggtaatatataaagacagggagaggcccccagggatcccctgagacgatactcgtggctccagctcgagggacaacagtcacattgaaccatcagtggagtccggccagaggacgaggctgactattactgtcaggtccncgaagacagcagtggcaggtttatgttcgttagttccgggcggaacgggtaccgtacggccgtaggaacccggttccgttaacgggtccgaacggtccccaaagggtccctcggtaccccccgttcggtaccctacccgttccgtccgtttaccccccg

SEQ ID NO: 8688 - DNA, 568 bp, Homo sapiens
  misc_feature: GYAE6OF02IFTSC.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaaacatatggatattggtaccggcagaagccaggccaggcccctgtgttggtaatatataaagacagggagaggccccgagggactcccgtgacgcgatactctggctccgagctcgagggacaacgagtcactattgaccatcagtggacgtccgaggcaagaagacgaggctagactattactgtactaatctgcggtacagactaggtcgttactcgtagtgttggtacgttcgggacggacggtacgaagtccgtaggtacccgtacgtacgggtaccacggtacccgaacgggtcctaccggtcccccgttcggtaccctaccgtcgttccccgg

SEQ ID NO: 8689 - DNA, 601 bp, Homo sapiens
  misc_feature: GYAE6OF02H3057.53.11.A11.1.454.CMB.1.raw
  modified_base (438)..(438): a, c, t, g, unknown or other
  misc_feature (438)..(438): n is a, c, g, or t
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctggtgtcagtgtccccaggacagacggccaggatcacctgctctggagaggcattggacaaaaacgaatatggatattggtaccggcagaagccaggccaggcccctgtgttggtaatatataaagacgaagggagacggacccccgaagggactcccgtaggacgacgatacctcgtaggctaccagctacgagggacaacagtcactattcgaacctatcagtggatccgaggacagaagacgaggctgtactattactgtacaagttcncgacggactaggctaagggttcgttactacgtacgttggttagttacgtcggggtacggaacgggtaccgaaggtctacgggtaccgtccgtaacgggtacgaccggtaccccgaacgggcctaccggacccccgttcgggtacctcccggtccgttaccccg

SEQ ID NO: 8690 - DNA, 521 bp, Homo sapiens
  misc_feature: GYAE6OF02HYCXF.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacatatggatattggtaccggcagaagccaggccaggcccctgtgttggtaatatataaagacgagggagacgggcccccagggactcccgtgagcgaatactctggctccagctcgagggacaacagtcacattgaccatcagtggagtccaggcagaagacgaggctgactattactgtacaatctgcgacagcgagtgttctcgattggtgttagttcgggcggaggacaagctggaccgtcgtaggtcacgtccgaaggcgtcgcccccgtggtccacctcttcccgg

SEQ ID NO: 8691 - DNA, 543 bp, Homo sapiens
  misc_feature: GYAE6OF02GDUII.53.11.A11.1.454.CMB.1.raw
  modified_base (280)..(280): a, c, t, g, unknown or other
  misc_feature (280)..(280): n is a, c, g, or t
tcagcgcgtatacacacgaccggtgctcgatttagctacgactgcagggggtgggtccaggaggcagaactctgggtgtctcaccatggggcctgggactccctctacttctccccctccgtcactctctgcacaggctctgaggcctcctatgaggtgacacagccaccctcggtgtcagtgtcccccaggacagacggccaggatcacctgctctggagaggcattggacaaaacgatatggatattggtaccggcagaagccaggccaggcccctgngttggtaatatataaagacagggagacggccccagggatcccgtgacgcgaatacgtctggtctccagctcgagggacaacagtcacattagaccatacagtggacgcaggcagaagacgaggctgactatactgtcaatctgacgacagcagttgtctcgattgtagttagttcgacgggtaggaccgaagcgtagacccggtctaggttacaacggcccgaagggtcctcggccccccgttaggtctaccttcgttacccg

SEQ ID NO: 8692 - DNA, 660 bp, Homo sapiens
  misc_feature: GYAE6OF02H8EVF.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctctcactctctgcacaggctctgagcctcctatgaggtgacacagcccaccctcggtgtcagtcgtccccaggacagacggccaggatcacctgctcgtaggagagggcagttggaacaaaaacatagtggatagttggtaccgcagaagccgagccaggccctgtgttaggatataataaagacgagggacgacggcccccgagggactcccgtaggacgtcgaactacgtcgtacggtcctaccgagccgtcgaacgggacaaacgacgtacacaacgttcgaacctagtaccgaggtacggtacgtacccgaggaccgaaggaaacggacggaacggtcgtagtaacgttagttacgtagttaacgaacgttcgtggaccgtacgacggacgtaggttcggttactcgtaacgttgggtaggttacggtttcgggaacgggtacgggtaacctaggtacccgtacggtacccggtacggtacggttccgaaccggtaccgtacgaccgtccggaccccgttcgggcctaccgtcgttaccccgg

SEQ ID NO: 8693 - DNA, 689 bp, Homo sapiens
  misc_feature: GYAE6OF02FV8LH.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggacaaaacatatggatattggtaccggcagaagccaggccaggcccctgtgttaggtaatatataaagacagggagacggcccccgagggactcccgtgacgcgattactcgtggcctaccgagtctacgaacgggacaacgtaagtacaactacgttacgacctaatcgaaggttcgggaacgttcccgaagggacccaaggaaacggaacggaacgggaccgttacggtaaccgttaagtttaaccgtaggttaacctaaacgtttccgtacggaccgggtaacgacggtacgtacgggtttacggtttacctacgtagtttaggttagggttacgtttcgggaacgggtaacgggtaccgtaacggtccgtacggacccggttcggtaaccggtacgaaccggtacccgtaaggtccctaccgggtacccccgttcgggtcccttaccgtcccgttaccccgg

SEQ ID NO: 8694 - DNA, 633 bp, Homo sapiens
  misc_feature: GYAE6OF02HAD8K.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctctcactctctgcacaggctctgaggcctcctatgaggtgacacagcccaccctcggtgtcagtcgtcccccaggacagacggccaggatccacctgctcgtgggagaggcagttggacaaaaacatatggatagttggaccggcagaagccaggccacggcccctggtgttaggtaatataataaagacgagggagacggccccgagggactcccgtggacgcgtatactcgtggcctcagcctcgagggacaacgagtacactattacgacctactcgaaggtcggacgtaccgaacggacgaacgaaggacggagggctagacttattacgtgtactaagtcgtacggacgacacgacgtaggttacggttctacgtatcggttaggttacgttcgggacggaacgggtaaccgaaggtccgtacggtacccggttacgttacgggtaccacgggtaccccgtagggccttccccgggtaccccgttaccggtacccttaccgttcccgttaccccg

SEQ ID NO: 8695 - DNA, 653 bp, Homo sapiens
  misc_feature: GYAE6OF02JSO2A.53.11.A11.1.454.CMB.1.raw
  modified_base (237)..(237): a, c, t, g, unknown or other
  misc_feature (237)..(237): n is a, c, g, or t
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctactggagaggcattggacaaaacatacnggatatggtaccggcagagccaggccaggcccctgtcgttggtaatatataaagacgaggagacggaccccgagggatccccgtaggacgacgactacgtccgtaggaccttccgagcctacgaacgggtaaccaacgaacgtacgacgtacttacggaaccaagtcaaggttcgacgtacccgaaggaccaaggaacgacggacggtacgttagaacgttaagttaaccgtacgtacaacgttaccgtcgaccggactaggaccgtaggttcgttacctagtacgttgtacgttacgttccggaacggtacggaccgtaagtaccgtacgtacccggtccgttaaggccgtaacgttacccggaaggtccgtacccgtacccccgtcggttaccgacccgttcccgttaccccgg

SEQ ID NO: 8696 - DNA, 658 bp, Homo sapiens
  misc_feature: GYAE6OF02IE9R0.53.11.A11.1.454.CMB.1.raw
  modified_base (251)..(251): a, c, t, g, unknown or other
  misc_feature (251)..(251): n is a, c, g, or t
  modified_base (361)..(361): a, c, t, g, unknown or other
  misc_feature (361)..(361): n is a, c, g, or t
tcagcgcgtatacacacgaccggtgctcgatttagctacgactgcagggggtgggtccaggaggcagaactctgggtgtctcaccatggcctggatccctctacttctccccctctcactctctgcacaggctctgaggcctcctatgaggtgacacagccaccctggtgtcagtcgtccccaggacagacggccaggatcacctgcctcgtggagaggcattggacaaaaacatatggatattggtacgnagagcaggccaggccctgtgttggtaatatataaaagcaagggagaccggccccagggctacccgtggacgcgaactacttcgcggctccgagcctgacgggaacaacgngtacactattcgaacatcgaggtggacgtaccgaggcaaggaacggaacggacggtctagtaactagtttacgtagtaactaattcgaggacccggtacgagccgtaaggttcgttaccgtaactggtttacggtgggtttaacgttcggggacggggttaacggaaccgttaacggacccgttagggaccccggttacggttaccggtacccgaacccgggtaaccccgaagggtcccgttaccccggtacccccggttacgggtttacccgtaccccgttaccctttacccccgg

SEQ ID NO: 8697 - DNA, 906 bp, Homo sapiens
  misc_feature: GYAE6OF02G0IVM.53.11.A11.1.454.CMB.1.raw
tcagcgcgtatacacacgaccggtgctcgatttagctacgactgcagggggtgggtccaggaggcagaactctgggtgtctcaccatggcctggatccctctacttcctccccctcctcactctctgcacaggctctgaggcctcctatgaggtgacacagcccaccccgtcggtgtcaggtcgtacccccgaggacaggaccggccgaggactcacctgcctcgtgggagaggctagttggaacaaaaacaagttagtaggtaattacgttacgggtacccggaccgtaagaacggacccgacggacccgaaccggtcccccgttaggttaggtttagggttaaacttaagttaaagttaaaacggtaaaccggaagggggtaacggaacccggggtacccccccggaaacgggggtaccttccccggtagggacggtaaccggacgttaaccgtcggtacggtcccgtaccgacgtccgtacggaacgggaaccaacgtacgtactaacgttacgttacgaaccctaacgtacgaacgggtacgggtaacgtaccggtaacgggaaccgaacgggtaaaacgggaaccggtacggggaacgttaaccggtaacgttaaaccgtttacggttaacgttaacgtaaccgtacgggttaacggaaccgggtaaccgtaagaccgggttacggtttaccgggtttaccgttacggttacgtttcggggtttacggggttaccggtttaccgggggacgggtaaccggggaaccgtaacgggtaccggttaccgggtacccggttaaccgggttaccgggtaccgtaacccgggtaaccccgtaagggtccccgttacccggtaccccggtttacggtacccgttacccggtttcccgttaccccccgg

SEQ ID NO: 8698 - DNA, 735 bp, Homo sapiens
  misc_feature: GYAE6OF02HRWK3.53.11.A11.1.454.CMB.1.raw
  modified_base (246)..(246): a, c, t, g, unknown or other
  misc_feature (246)..(246): n is a, c, g, or t
  modified_base (559)..(559): a, c, t, g, unknown or other
  misc_feature (559)..(559): n is a, c, g, or t
tcagcgcgtatacacacgaccggtgctcgatttagctacgactgcagggggtgggtccaggaggcagaactctgggtgtctcaccatggcctggatccctctacttcctccccctctcactctctgcacaggctctgacggcctcctatggaggtgacacgacgccacccgtcggtgtcaggtcgtccccgaggacagaccggccaggactcgaccgtgctgtggagcggcagttggaacaaaaanatagtaggattagttcggaccggcaagaacggccaggccgacgcccgtgttcgttagtaataataagtaaaggacgaagggaacggaccggacccccgtaagggtacctacccgtaggaacggtacgtaagttaaccgtcgtacggtcccgttacccgaggtcccgtaccggaacgggaactaaaccgtacgtactaactaacgtaccgaactacgtaccgaggtacgggtaacgtaccgaggtacaaacgggaaacgtaggacgcgtaacggtacttaacgttactacgtagaacgttacgagtaccggtanacgtacgttaggttacgttccgttcgtaaggttcggtttaagtacgggttacggggacgtaaacgggaccgtaaccgtacgtaccggtacccggtaacggtaccggtaccaacccggtaccccgaggttccccgtacccgggccccttacggtcccgttcccgtacgttcccccgg

SEQ ID NO: 8699 - DNA, 733 bp, Homo sapiens
  misc_feature: GYAE6OF02FTAV4.53.11.A11.1.454.CMB.1.raw
tcagcgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtcgtccccaggacagacggccgaggatccacctgctctggagaggctattggacaaaacaatagtggattagtcggtaccgcagaagccaggccacgcccctgtgttaggtaatataataaagacgaggagacggccccgaggtactcccgtaggacgacgattaccgtcgtacggtctaccgagcctaccggaacgggacaacgacgtcccgacgagtttaccgacctacggttacgaacgggttacggtaacggtcccgaagggaccaaagggaaacgaaccgggaacggtacgttacgtaacgttaacgtttaccgtagttaccgtaacgttaccgttaggaccgggaacacgtaccgtaaggttccggtttaccgtacgtaggtttacggttacggggttaccgtttacgggggacgggaacggggtacccaaagggttccgacggttaaccccggtacggttaacggtaccggtaacccgtacccggaaaggttcccggtaccccgtcccccggttacgggtaccccgtacctttccccggtttacccccgg

SEQ ID NO: 8700 - DNA, 851 bp, Homo sapiens
  misc_feature: GYAE6OF02IL72O.53.11.A11.1.454.CMB.1.raw
tcagcgcgtatacacacgaccggtgctcgatttagctacgactgcagggggtgggtccaggaggcagaactctgggtgtctcaccatggcctggatccctctacttcctccccctcctcactctctgcacaggctctgaggcctcctatggagtgacacagccaccctggtgtcagtcgtccccagacagacggccaggactcacctgctcgtggagaggctagttaggaacaaaaactaagtatacggtaattagttacgggtaccggacgtaaggaacgcccgaacgggacccgaacgggtcccccgttggttcggtttagggtaaattaacgtaaagttaaaacggaacggtaaggggaacggtaccggaccccccggaaggggtacctacccccgtggacgtacgtaactaccgttccgtcggtacctaccgacgtaccgtacgaacgggtaaccaacgtacgtacactaagttacgaacccattaccgtaggtacgggtaacgtaccggtacggacgtaaacgggaaacgggaacccgaagggtaccgttaaacgggtaaccttaacggtttaaccgttacgttaaacgtaacgtttaccggtaacgggtaaccggtaaccgtaacggtacgttaccggggtttcggtttaccgttaccgttaggttacgggttacgggtttaccgggttcgggggtaaaccgggaacgggtaacccgtaacggtacccggttacggtaccccggttagggtaacccggtccggaaccggtcccgaaccggggttccccttcccgggttacccccgttacccgggttacctacccccggttccgttaccccccggg

SEQ ID NO: 8701 - DNA, 889 bp, Homo sapiens
  misc_feature: GYAE6OF02JQ14E.53.11.A11.1.454.CMB.1.raw
  modified_base (220)..(220): a, c, t, g, unknown or other
  misc_feature (220)..(220): n is a, c, g, or t
tcagcgcgtatacacacgaccggtgctcgatttagctacgactgcagggggtgggtccaggaggcagaactctgggtgtctcaccatggcctggatccctctaccttcctccccctctcactctctgcacaggctctgacggcctcctagtggaggtgaccaacacgccctaccctcggtgtcagtcgtcccaggacacggaccgccgaggactcaccgngctacgtaggagtggtacgtagttacggaaactaaaaacgaattagtaggtaagttacggttaccgggaaccggtacgaagaaccggaccgacggaccggaccggtcccgttaggttaaggttacgtaaataagtaaacgtaaaggaaccggacgggacggaacccggaccccgtaacgggtaccttccgagggtaacgtcgtaactccgtaccggtacggttccctaccgtacggtccgtaaccggtaacgggaaccctaacggttaacgtactaaacgttacgtacctaaacccgtgttaaccgtaaggtaccgggtaacgacccggtaacgggacgaaaacggtacgtaaaccggggccgttaaagttaccggttaaactttaaccgtacccggtaagttacgaaaccggttttggaaacccgggtctaacggtaccgtccgggttaagggttttaccgtaccctaaggttcgggttacgggtttaacgcccggggtttaacgggaaacgggtacccgtaacgggttacggtaccggacccgggttaaccgggtcccttaaacgggtccgtaaacccgggggttcccaacggggttaccccccgtttaccccgggaccccggtttttacgaccccgtttacccgtttacccccgggtttccccggg

SEQ ID NO: 8702 - DNA, 939 bp, Homo sapiens
  misc_feature: GYAE6OF02I4RYD.53.11.A11.1.454.CMB.1.raw
  modified_base (159)..(159): a, c, t, g, unknown or other
  misc_feature (159)..(159): n is a, c, g, or t
tcagcgcgtatacacacgaccggtgctcgatttagctacgactgcagggggtgggtccaggaggcagaactctgggtgtctcaccatggcctggatccctctacttctcccctcctcactctctgcacaggctctgacgcctcctatggaggtgacacncgcccacccgtcggtgtcagtcgtccccaggacacgacggccaggatcacctgctcgtggagagctagttcggaacaaaactaatagtaggtaattaggttacggtaccggacgtaagaacggaccgtacggaccgaccgggtccccgttaggttacgggttacggttaaatacgttaaaacgttaaaacggaaccggaagggggtaacggaaccggggtaccccccggtaaagggggtacctttacccccggttagggaaccggtaccggtaaacgtttacccgttaccggttacgggtacccctttaccggaaccggtcccggttaacggaaaccgggggaaaaccctaaaccggttaaccggtaacccgtaaaccgttacgttacccgtaaaccgtacgttaccggtaaggtaccgggtaccggttaaaccgggacgggtaaaccggaaacgggaaacgggtaacccggtaagggtacccgttaaggttaaaccgtttaacggtttaaccgtacggttaaaccgttaacgttccgggttaccgggaaccggtaaacgtaccggtacggtttaaccgggttcggtttaacccttagggtaacggttttcgggtttaacggggttaccgggttaaccggggaccgggtaaaacggtccgaacggttccgggtaccgtaccgggttaaccggtaccgggtacgtaaccggtaacccggacgggttacccgtcccccgggtacccgttacggtaccgttcccggttacccgtttcccccgg

SEQ ID NO: 8703 - DNA, 304 bp, Homo sapiens
  misc_feature: GYAE6OF01B517I.30.30.C08.1.454.CMB.1.raw
  modified_base (301)..(304): a, c, t, g, unknown or other
  misc_feature (301)..(304): n is a, c, g, or t
tcagcacgctacgtcacgaccggtgctcgatttagtctgacgtcaagggaagggctggagtgggtggccaacataaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 8704 - DNA, 305 bp, Homo sapiens
  misc_feature: GYAE6OF01CGFBF.30.30.C08.1.454.CMB.1.raw
  modified_base (302)..(305): a, c, t, g, unknown or other
  misc_feature (302)..(305): n is a, c, g, or t
tcagcacgctacgtcacgaccggtgctcgatttagtctgacgtcaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 8705 - DNA, 307 bp, Homo sapiens
  misc_feature: GYAE6OF01EFC4K.30.30.C08.1.454.CMB.1.raw
  modified_base (304)..(307): a, c, t, g, unknown or other
  misc_feature (304)..(307): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 8706 - DNA, 323 bp, Homo sapiens
  misc_feature: GYAE6OF01AMFV0.30.30.C08.1.454.CMB.1.raw
  modified_base (305)..(323): a, c, t, g, unknown or other
  misc_feature (305)..(323): n is a, c, g, or t
tcagcacgctacgtcacgaccggtgctcgatttagtctgacgtcaagggaagggctggaggtgggtggccaacataaaccaagatgggaagtgaacagtactatgtggactcctgtgaagggcccgattcaccatctccagagacaacgccaagaactcactgtctcctcagcctccaccaagggcccatcggtcttcccctggccgccctgctccaggagcacctccgagagcacagcggccctgggctgccctggtcaaggctacttccacgtagcgtgctgagcggctggcaaggcgcatgnnnnnnnnnnnnnnnnnnn

SEQ ID NO: 8707 - DNA, 314 bp, Homo sapiens
  misc_feature: GYAE6OF01D3TZH.30.30.C08.1.454.CMB.1.raw
  modified_base (306)..(314): a, c, t, g, unknown or other
  misc_feature (306)..(314): n is a, c, g, or t
tcagcacgctacgtcacgaccggtgctcgatttagtctgacgtcaaagggaaaggggctgggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnn

SEQ ID NO: 8708 - DNA, 327 bp, Homo sapiens
  misc_feature: GYAE6OF01CURGV.30.30.C08.1.454.CMB.1.raw
  modified_base (306)..(327): a, c, t, g, unknown or other
  misc_feature (306)..(327): n is a, c, g, or t
tcagcacgctacgtcacgaccggtgctcgatttagtctgacgtcaaagggaagggggctggagtgggtggccaacataaaccaagatggaagtgaacaggtactatgtggactctgtggaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatgnnnnnnnnnnnnnnnnnnnnnn

SEQ ID NO: 8709 - DNA, 309 bp, Homo sapiens
  misc_feature: GYAE6OF01C8CG2.30.30.C08.1.454.CMB.1.raw
  modified_base (304)..(309): a, c, t, g, unknown or other
  misc_feature (304)..(309): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnn

SEQ ID NO: 8710 - DNA, 305 bp, Homo sapiens
  misc_feature: GYAE6OF01DEHMF.30.30.C08.1.454.CMB.1.raw
  modified_base (303)..(305): a, c, t, g, unknown or other
  misc_feature (303)..(305): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctccgagagcacagcggccctgggctgcctggtcaaggactacttccacgtagcgtgctgagcggctggcaaggcgcatagnnn

SEQ ID NO: 8711 - DNA, 310 bp, Homo sapiens
  misc_feature: GYAE6OF01ATDFX.30.30.C08.1.454.CMB.1.raw
  modified_base (304)..(310): a, c, t, g, unknown or other
  misc_feature (304)..(310): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnn

SEQ ID NO: 8712 - DNA, 307 bp, Homo sapiens; identical to SEQ ID NO: 8705
  misc_feature: GYAE6OF01COJR3.30.30.C08.1.454.CMB.1.raw
  modified_base (304)..(307): a, c, t, g, unknown or other
  misc_feature (304)..(307): n is a, c, g, or t

SEQ ID NO: 8713 - DNA, 305 bp, Homo sapiens
  misc_feature: GYAE6OF01CKAKE.30.30.C08.1.454.CMB.1.raw
  modified_base (302)..(305): a, c, t, g, unknown or other
  misc_feature (302)..(305): n is a, c, g, or t
tcagcacgctacgtcacgaccggtgctcgatttagtctgacgtcaaagggaagggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 8714 - DNA, 307 bp, Homo sapiens; identical to SEQ ID NO: 8705
  misc_feature: GYAE6OF01BCVGB.30.30.C08.1.454.CMB.1.raw
  modified_base (304)..(307): a, c, t, g, unknown or other
  misc_feature (304)..(307): n is a, c, g, or t

SEQ ID NO: 8715 - DNA, 308 bp, Homo sapiens
  misc_feature: GYAE6OF01BX8M2.30.30.C08.1.454.CMB.1.raw
  modified_base (305)..(308): a, c, t, g, unknown or other
  misc_feature (305)..(308): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactacttccacgtagcgtgctgagcgggctggcaaggcgcatagnnnn

SEQ ID NO: 8716 - DNA, 306 bp, Homo sapiens
  misc_feature: GYAE6OF01AIVOB.30.30.C08.1.454.CMB.1.raw
  modified_base (304)..(306): a, c, t, g, unknown or other
  misc_feature (304)..(306): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 8717 - DNA, 306 bp, Homo sapiens
  misc_feature: GYAE6OF01CC911.30.30.C08.1.454.CMB.1.raw
  modified_base (303)..(306): a, c, t, g, unknown or other
  misc_feature (303)..(306): n is a, c, g, or t
tcagcacgctacgtcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 8718 - DNA, 307 bp, Homo sapiens; identical to SEQ ID NO: 8705
  misc_feature: GYAE6OF01BFYRW.30.30.C08.1.454.CMB.1.raw
  modified_base (304)..(307): a, c, t, g, unknown or other
  misc_feature (304)..(307): n is a, c, g, or t

SEQ ID NO: 8719 - DNA, 309 bp, Homo sapiens
  misc_feature: GYAE6OF01CRC2Z.30.30.C08.1.454.CMB.1.raw
  modified_base (305)..(309): a, c, t, g, unknown or other
  misc_feature (305)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcctagagcacagcggccctgggctgcctggtcaaggactacttccacgtagcgtgctgagcgggctggcaaggcgcatagnnnnn

SEQ ID NO: 8720 - DNA, 305 bp, Homo sapiens
  misc_feature: GYAE6OF01DEY34.30.30.C08.1.454.CMB.1.raw
  modified_base (303)..(305): a, c, t, g, unknown or other
  misc_feature (303)..(305): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnn

SEQ ID NO: 8721 - DNA, 308 bp, Homo sapiens
  misc_feature: GYAE6OF01DCGZW.30.30.C08.1.454.CMB.1.raw
  modified_base (305)..(308): a, c, t, g, unknown or other
  misc_feature (305)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 8722 - DNA, 306 bp, Homo sapiens; identical to SEQ ID NO: 8716
  misc_feature: GYAE6OF01CGKN9.30.30.C08.1.454.CMB.1.raw
  modified_base (304)..(306): a, c, t, g, unknown or other
  misc_feature (304)..(306): n is a, c, g, or t

SEQ ID NO: 8723 - DNA, 305 bp, Homo sapiens
  misc_feature: GYAE6OF01CQWDG.30.30.C08.1.454.CMB.1.raw
  modified_base (301)..(305): a, c, t, g, unknown or other
  misc_feature (301)..(305): n is a, c, g, or t
tcagcacgctacgtcacgaccggtgctcgatttagtctgacgtcaaagggaagggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnnnn

SEQ ID NO: 8724 - DNA, 309 bp, Homo sapiens
  misc_feature: GYAE6OF01B32QG.30.30.C08.1.454.CMB.1.raw
  modified_base (305)..(309): a, c, t, g, unknown or other
  misc_feature (305)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 8725 - DNA, 309 bp, Homo sapiens; identical to SEQ ID NO: 8724
  misc_feature: GYAE6OF01C4AEF.30.30.C08.1.454.CMB.1.raw
  modified_base (305)..(309): a, c, t, g, unknown or other
  misc_feature (305)..(309): n is a, c, g, or t

SEQ ID NO: 8726 - DNA, 325 bp, Homo sapiens
  misc_feature: GYAE6OF01DUJU8.30.30.C08.1.454.CMB.1.raw
  modified_base (306)..(325): a, c, t, g, unknown or other
  misc_feature (306)..(325): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctggagcgggctggcaaggcgcatagnnnnnnnnnnnnnnnnnnnn

SEQ ID NO: 8727 - DNA, 309 bp, Homo sapiens; identical to SEQ ID NO: 8709
  misc_feature: GYAE6OF01A5NYG.30.30.C08.1.454.CMB.1.raw
  modified_base (304)..(309): a, c, t, g, unknown or other
  misc_feature (304)..(309): n is a, c, g, or t

SEQ ID NO: 8728 - DNA, 309 bp, Homo sapiens; identical to SEQ ID NO: 8724
  misc_feature: GYAE6OF01DAGAE.30.30.C08.1.454.CMB.1.raw
  modified_base (305)..(309): a, c, t, g, unknown or other
  misc_feature (305)..(309): n is a, c, g, or t

SEQ ID NO: 8729 - DNA, 305 bp, Homo sapiens
  misc_feature: GYAE6OF01AJKLR.30.30.C08.1.454.CMB.1.raw
  modified_base (302)..(305): a, c, t, g, unknown or other
  misc_feature (302)..(305): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaggcgcatagnnnn

SEQ ID NO: 8730 - DNA, 397 bp, Homo sapiens
  misc_feature: GYAE6OF01CEDLS.30.30.C08.1.454.CMB.1.raw
  modified_base (388)..(397): a, c, t, g, unknown or other
  misc_feature (388)..(397): n is a, c, g, or t
tcagcacgctacgtcacgaccggtgctcgatttagtctgacgtcaaagggaaagggctggagtgggtggccaacataaaccaagatggaagtgaacagtactatgtggactctgtgaaggccgattcaccatctccagagacaacgccaagaactcactgtcctctcacgcctccaacgacggcctagtcggtcccttccccgtggcccgtccctcgcctaccgagggacgacctacccgtccggaaggacgaccaacgacggccccggtccccggtgggtccgtccgtcccggttcggtaacgaaacggtaaccttacccttcccgaacggtacggtcggtcgccgtaggacgggccgggtcgtcggacgaacgggccgacagtagnnnnnnnnnn

SEQ ID NO: 8731 - DNA, 309 bp, Homo sapiens; identical to SEQ ID NO: 8724
  misc_feature: GYAE6OF01CYHAY.30.30.C08.1.454.CMB.1.raw
  modified_base (305)..(309): a, c, t, g, unknown or other
  misc_feature (305)..(309): n is a, c, g, or t

SEQ ID NO: 8732 - DNA, 307 bp, Homo sapiens
  misc_feature: GYAE6OF01BFPQ7.30.30.C08.1.454.CMB.1.raw
  modified_base (305)..(307): a, c, t, g, unknown or other
  misc_feature (305)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 8733 - DNA, 306 bp, Homo sapiens
  misc_feature: GYAE6OF01CTF32.30.30.C08.1.454.CMB.1.raw
  modified_base (303)..(306): a, c, t, g, unknown or other
  misc_feature (303)..(306): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcacgtagcgtgctgagcgggctggcaaggcgcatagnnnn

SEQ ID NO: 8734 - DNA, 310 bp, Homo sapiens
  misc_feature: GYAE6OF01AFZFA.30.30.C08.1.454.CMB.1.raw
  modified_base (305)..(310): a, c, t, g, unknown or other
  misc_feature (305)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnn

SEQ ID NO: 8735 - DNA, 308 bp, Homo sapiens
  misc_feature: GYAE6OF01EV9KZ.30.30.C08.1.454.CMB.1.raw
  modified_base (304)..(308): a, c, t, g, unknown or other
  misc_feature (304)..(308): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 8736 - DNA, 327 bp, Homo sapiens
  misc_feature: GYAE6OF01D4T8P.30.30.C08.1.454.CMB.1.raw
  modified_base (204)..(204): a, c, t, g, unknown or other
  misc_feature (204)..(204): n is a, c, g, or t
  modified_base (275)..(275): a, c, t, g, unknown or other
  misc_feature (275)..(275): n is a, c, g, or t
  modified_base (307)..(327): a, c, t, g, unknown or other
  misc_feature (307)..(327): n is a, c, g, or t
tcagcacgctacgtcacgaccggtgctcgatttagtctgacgtcaaagggaaaggggctgggagtgggtggccaacataaaccaagatggaagtgaacagtactatgtggactctgtgaagggccgattcaccatctccagagacaacgccaagaactcactgtctcctcagcctcaccaaggcccatcggtcttcccctggcnccctgctccaggagcacctccgagagcacagcggccctgggctgcctggtcaaggacctacttccacgtancgtgcttgagcgggctggcaaggcgcgatagnnnnnnnnnnnnnnnnnnnnn

SEQ ID NO: 8737 - DNA, 305 bp, Homo sapiens
  misc_feature: GYAE6OF01E1WHG.30.30.C08.1.454.CMB.1.raw
  modified_base (303)..(305): a, c, t, g, unknown or other
  misc_feature (303)..(305): n is a, c, g, or t
tcagcacgctacgtcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 8738 - DNA, 307 bp, Homo sapiens
  misc_feature: GYAE6OF01BQSEX.30.30.C08.1.454.CMB.1.raw
  modified_base (303)..(307): a, c, t, g, unknown or other
  misc_feature (303)..(307): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatcccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 8739 - DNA, 317 bp, Homo sapiens
  misc_feature: GYAE6OF01D4FSQ.30.30.C08.1.454.CMB.1.raw
  modified_base (307)..(317): a, c, t, g, unknown or other
  misc_feature (307)..(317): n is a, c, g, or t
tcagcacgctacgtcacgaccggtgctcgatttagtctgacgtcaaagggaaaggggctgggagtgggtggccaacataaaccaagatggaaggtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnnn

SEQ ID NO: 8740 - DNA, 308 bp, Homo sapiens
  misc_feature: GYAE6OF01CR0RA.30.30.C08.1.454.CMB.1.raw
  modified_base (303)..(308): a, c, t, g, unknown or other
  misc_feature (303)..(308): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnnnnn

SEQ ID NO: 8741 - DNA, 311 bp, Homo sapiens
  misc_feature: GYAE6OF01A3NHD.30.30.C08.1.454.CMB.1.raw
  modified_base (305)..(311): a, c, t, g, unknown or other
  misc_feature (305)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnn

SEQ ID NO: 8742 - DNA, 304 bp, Homo sapiens
  misc_feature: GYAE6OF01C70K3.30.30.C08.1.454.CMB.1.raw
  modified_base (302)..(304): a, c, t, g, unknown or other
  misc_feature (302)..(304): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttcacgtagcgtgctgagcgggctggcaaggcgcatagnnn

SEQ ID NO: 8743 - DNA, 306 bp, Homo sapiens
  misc_feature: GYAE6OF01C0ZDA.30.30.C08.1.454.CMB.1.raw
  modified_base (303)..(306): a, c, t, g, unknown or other
  misc_feature (303)..(306): n is a, c, g, or t
tcagcacgctacgtcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctcgagagcacagcggccctgggctgcctggtcaaggactacttccacgtagcgtgctgagcgggctggcaaggcgcatagnnnn

SEQ ID NO: 8744 - DNA, 308 bp, Homo sapiens; identical to SEQ ID NO: 8740
  misc_feature: GYAE6OF01C37SL.30.30.C08.1.454.CMB.1.raw
  modified_base (303)..(308): a, c, t, g, unknown or other
  misc_feature (303)..(308): n is a, c, g, or t

SEQ ID NO: 8745 - DNA, 305 bp, Homo sapiens
  misc_feature: GYAE6OF01BMDHU.30.30.C08.1.454.CMB.1.raw
  modified_base (304)..(305): a, c, t, g, unknown or other
  misc_feature (304)..(305): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnn

SEQ ID NO: 8746 - DNA, 308 bp, Homo sapiens; identical to SEQ ID NO: 8721
  misc_feature: GYAE6OF01B5HIY.30.30.C08.1.454.CMB.1.raw
  modified_base (305)..(308): a, c, t, g, unknown or other
  misc_feature (305)..(308): n is a, c, g, or t

SEQ ID NO: 8747 - DNA, 307 bp, Homo sapiens; identical to SEQ ID NO: 8705
  misc_feature: GYAE6OF01BOZ9L.30.30.C08.1.454.CMB.1.raw
  modified_base (304)..(307): a, c, t, g, unknown or other
  misc_feature (304)..(307): n is a, c, g, or t

SEQ ID NO: 8748 - DNA, 318 bp, Homo sapiens
  misc_feature: GYAE6OF01ELAFS.30.30.C08.1.454.CMB.1.raw
  modified_base (313)..(318): a, c, t, g, unknown or other
  misc_feature (313)..(318): n is a, c, g, or t
tcagcacgctacgtcacgaccggtgctcgatttagtctgacgtcaaaggaagggctggagtgggtggccaacataaaccaagatggaagtgaaccagtactatgtggactctgtgaaggccgattcaccatctccagagacaacgcccaagaactccactgtctacctcagcctaccaaccaagggcccactcggtccttccccctggccgccctcgctcccaggacgcacctccgagacgcacagcgccctggctgcctggtcaaggactacttccacgttagcgtgctgagcggctggcaaggcgcatagnnnnnn

SEQ ID NO: 8749 - DNA, 309 bp, Homo sapiens
  misc_feature: GYAE6OF01CZU60.30.30.C08.1.454.CMB.1.raw
  modified_base (305)..(309): a, c, t, g, unknown or other
  misc_feature (305)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactactttcacgtagcgtgctgagcgggctggcaaggcgcatagnnnnn

SEQ ID NO: 8750 - DNA, 308 bp, Homo sapiens; identical to SEQ ID NO: 8735
  misc_feature: GYAE6OF01BS0RA.30.30.C08.1.454.CMB.1.raw
  modified_base (304)..(308): a, c, t, g, unknown or other
  misc_feature (304)..(308): n is a, c, g, or t

SEQ ID NO: 8751 - DNA, 308 bp, Homo sapiens; identical to SEQ ID NO: 8735
  misc_feature: GYAE6OF01DZHDP.30.30.C08.1.454.CMB.1.raw
  modified_base (304)..(308): a, c, t, g, unknown or other
  misc_feature (304)..(308): n is a, c, g, or t

SEQ ID NO: 8752 - DNA, 309 bp, Homo sapiens; identical to SEQ ID NO: 8724
  misc_feature: GYAE6OF01BGVCZ.30.30.C08.1.454.CMB.1.raw
  modified_base (305)..(309): a, c, t, g, unknown or other
  misc_feature (305)..(309): n is a, c, g, or t

SEQ ID NO: 8753 - DNA, 309 bp, Homo sapiens; identical to SEQ ID NO: 8724
  misc_feature: GYAE6OF01CKNRW.30.30.C08.1.454.CMB.1.raw
  modified_base (305)..(309): a, c, t, g, unknown or other
  misc_feature (305)..(309): n is a, c, g, or t

SEQ ID NO: 8754 - DNA, 321 bp, Homo sapiens
  misc_feature: GYAE6OF01DHUWD.30.30.C08.1.454.CMB.1.raw
  modified_base (303)..(321): a, c, t, g, unknown or other
  misc_feature (303)..(321): n is a, c, g, or t
tcagcacgctacgtcacgaccggtgctcgatttagtctgacgtcaaagggaaagggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnnnnnnnnnnn

SEQ ID NO: 8755 - DNA, 307 bp, Homo sapiens; identical to SEQ ID NO: 8705
  misc_feature: GYAE6OF01BVOTO.30.30.C08.1.454.CMB.1.raw
  modified_base (304)..(307): a, c, t, g, unknown or other
  misc_feature (304)..(307): n is a, c, g, or t

SEQ ID NO: 8756 - DNA, 310 bp, Homo sapiens
  misc_feature: GYAE6OF01CG1YO.30.30.C08.1.454.CMB.1.raw
  modified_base (304)..(310): a, c, t, g, unknown or other
  misc_feature (304)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnn

SEQ ID NO: 8757 - DNA, 390 bp, Homo sapiens
  misc_feature: GYAE6OF01AE88X.30.30.C08.1.454.CMB.1.raw
  modified_base (321)..(321): a, c, t, g, unknown or other
  misc_feature (321)..(321): n is a, c, g, or t
  modified_base (323)..(324): a, c, t, g, unknown or other
  misc_feature (323)..(324): n is a, c, g, or t
  modified_base (330)..(330): a, c, t, g, unknown or other
  misc_feature (330)..(330): n is a, c, g, or t
  modified_base (332)..(390): a, c, t, g, unknown or other
  misc_feature (332)..(390): n is a, c, g, or t
tcagcacgctacgtcacgaccggtgctcgatttagtctgacgtcaaagggaaagggggctggagtgggtggccaacataaaccaagagtggaagtgaaccagtactaatgtggactctgtggaaggggccgacgtttcaccatcgtccagagacaacgcccaagaactcactgtctcctcagcctccaccaagggcccatcggtcttcccctggcggccctgctccaggagcgacctccggagagcacagcgggccctgggctgccgtggtcaaggactacttccacgtagcgtgctgagcgggctggcaaggcgcatagngnntgtggngnnnnnnnnnnnnnnnnnnnnnnnnnnnnnnnnnnnnnnnnnnnnnnnnnnnnnnnnnnn

SEQ ID NO: 8758 - DNA, 307 bp, Homo sapiens; identical to SEQ ID NO: 8705
  misc_feature: GYAE6OF01A5CWE.30.30.C08.1.454.CMB.1.raw
  modified_base (304)..(307): a, c, t, g, unknown or other
  misc_feature (304)..(307): n is a, c, g, or t

SEQ ID NO: 8759 - DNA, 367 bp, Homo sapiens
  misc_feature: GYAE6OF01D4YTJ.30.30.C08.1.454.CMB.1.raw
  modified_base (312)..(317): a, c, t, g, unknown or other
  misc_feature (312)..(317): n is a, c, g, or t
  modified_base (319)..(319): a, c, t, g, unknown or other
  misc_feature (319)..(319): n is a, c, g, or t
  modified_base (321)..(367): a, c, t, g, unknown or other
  misc_feature (321)..(367): n is a, c, g, or t
tcagcacgctacgtcacgaccggtgctcgatttagtctgacgtcaaagggaaaggggcgtgggagtgggtggccaacataaacccaagatggaagtgaacacgtactatgtggactctgtgaaggccgattcaccatctccagagacgaacgccaagaactcacctgtctcctcagcctccaccaaggcccatcggtcttcccctggcgccctgctccaggagcacctccgagagcacagcggccctgggctgcctggtcaaaggactacttaccacgtagcgtgcctgagcggctcggcaaggcgcatagnnnnnncntnnnnnnnnnnnnnnnnnnnnnnnnnnnnnnnnnnnnnnnnnnnnnnn

SEQ ID NO: 8760 - DNA, 309 bp, Homo sapiens
  misc_feature: GYAE6OF01BVL5T.30.30.C08.1.454.CMB.1.raw
  modified_base (305)..(309): a, c, t, g, unknown or other
  misc_feature (305)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggactacttccacgtagcgtgctgagcgggctgggcaaggcgcatagnnnnn

SEQ ID NO: 8761 - DNA, 338 bp, Homo sapiens
  misc_feature: GYAE6OF01C614A.30.30.C08.1.454.CMB.1.raw
  modified_base (311)..(338): a, c, t, g, unknown or other
  misc_feature (311)..(338): n is a, c, g, or t
tcagcacgctacgtcacgaccggtgctcgatttagtctgacgtcaaagggaaagggggcgtgggagtgggtggccaacataaaccaagatggaagtgaacacgtactatgtggactctgtgaagggccgattcaccatctccagagaccaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggccaaggcgcatagnnnnnnnnnnnnnnnnnnnnnnnnnnnn

SEQ ID NO: 8762 - DNA, 308 bp, Homo sapiens; identical to SEQ ID NO: 8721
  misc_feature: GYAE6OF01ARKHV.30.30.C08.1.454.CMB.1.raw
  modified_base (305)..(308): a, c, t, g, unknown or other
  misc_feature (305)..(308): n is a, c, g, or t

SEQ ID NO: 8763 - DNA, 336 bp, Homo sapiens
  misc_feature: GYAE6OF01DRS95.30.30.C08.1.454.CMB.1.raw
  modified_base (325)..(336): a, c, t, g, unknown or other
  misc_feature (325)..(336): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccgccgtggctcgcgtgtacgaacggacttacctaccacgtacgcgtgcgtagacggccggtcgtggaccgaagggccgactaagtagnnnnnnnnnnnn

SEQ ID NO: 8764 - DNA, 310 bp, Homo sapiens
  misc_feature: GYAE6OF01A5QLR.30.30.C08.1.454.CMB.1.raw
  modified_base (306)..(310): a, c, t, g, unknown or other
  misc_feature (306)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnn

SEQ ID NO: 8765 - DNA, 432 bp, Homo sapiens
  misc_feature: GYAE6OF01D0TT2.30.30.C08.1.454.CMB.1.raw
  modified_base (217)..(217): a, c, t, g, unknown or other
  misc_feature (217)..(217): n is a, c, g, or t
  modified_base (302)..(305): a, c, t, g, unknown or other
  misc_feature (302)..(305): n is a, c, g, or t
  modified_base (307)..(310): a, c, t, g, unknown or other
  misc_feature (307)..(310): n is a, c, g, or t
  modified_base (312)..(312): a, c, t, g, unknown or other
  misc_feature (312)..(312): n is a, c, g, or t
  modified_base (317)..(318): a, c, t, g, unknown or other
  misc_feature (317)..(318): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (327)..(328): a, c, t, g, unknown or other
  misc_feature (327)..(328): n is a, c, g, or t
  modified_base (330)..(331): a, c, t, g, unknown or other
  misc_feature (330)..(331): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (346)..(347): a, c, t, g, unknown or other
  misc_feature (346)..(347): n is a, c, g, or t
  modified_base (349)..(350): a, c, t, g, unknown or other
  misc_feature (349)..(350): n is a, c, g, or t
  modified_base (352)..(353): a, c, t, g, unknown or other
  misc_feature (352)..(353): n is a, c, g, or t
  modified_base (355)..(357): a, c, t, g, unknown or other
  misc_feature (355)..(357): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (398)..(399): a, c, t, g, unknown or other
  misc_feature (398)..(399): n is a, c, g, or t
  modified_base (402)..(402): a, c, t, g, unknown or other
  misc_feature (402)..(402): n is a, c, g, or t
  modified_base (404)..(405): a, c, t, g, unknown or other
  misc_feature (404)..(405): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctcaccaagggcccatcggtcttcccctggcgccctgctccaggancacctccgagagcacagcggccctgggctgcctggtcaaggctacttccacgtagcgtgctgagcgggctggcaaggcgcatagnnnntnnnntnagctnntcngtnagnntnnagntacngcngcatnncnngnngnnngnctantcngatgncngctgnagnatntangtacngactgnnagngnngancgngcgnacgtnacgtncgntacg

SEQ ID NO: 8766 - DNA, 308 bp, Homo sapiens; identical to SEQ ID NO: 8721
  misc_feature: GYAE6OF01BT8NI.30.30.C08.1.454.CMB.1.raw
  modified_base (305)..(308): a, c, t, g, unknown or other
  misc_feature (305)..(308): n is a, c, g, or t

SEQ ID NO: 8767 - DNA, 307 bp, Homo sapiens; identical to SEQ ID NO: 8732
  misc_feature: GYAE6OF01ETWT4.30.30.C08.1.454.CMB.1.raw
  modified_base (305)..(307): a, c, t, g, unknown or other
  misc_feature (305)..(307): n is a, c, g, or t

SEQ ID NO: 8768 - DNA, 318 bp, Homo sapiens
  misc_feature: GYAE6OF01CFOAG.30.30.C08.1.454.CMB.1.raw
  modified_base (311)..(318): a, c, t, g, unknown or other
  misc_feature (311)..(318): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactccactgtctacctcagcctaccaaccaagggcccatcggtcttccccctggccgccctgctcccaggacgcacctccgagagcacagcgccctgggctgcctggtcaaggactacttccacgtagcgtgctgagcgggctggcaaggcgcatagnnnnnnnn

SEQ ID NO: 8769 - DNA, 305 bp, Homo sapiens
  misc_feature: GYAE6OF01EMJAK.30.30.C08.1.454.CMB.1.raw
  modified_base (304)..(305): a, c, t, g, unknown or other
  misc_feature (304)..(305): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnn

SEQ ID NO: 8770 - DNA, 306 bp, Homo sapiens; identical to SEQ ID NO: 8716
  misc_feature: GYAE6OF01B39XX.30.30.C08.1.454.CMB.1.raw
  modified_base (304)..(306): a, c, t, g, unknown or other
  misc_feature (304)..(306): n is a, c, g, or t

SEQ ID NO: 8771 - DNA, 308 bp, Homo sapiens; identical to SEQ ID NO: 8721
  misc_feature: GYAE6OF01B9I6Y.30.30.C08.1.454.CMB.1.raw
  modified_base (305)..(308): a, c, t, g, unknown or other
  misc_feature (305)..(308): n is a, c, g, or t

SEQ ID NO: 8772 - DNA, 308 bp, Homo sapiens; identical to SEQ ID NO: 8735
  misc_feature: GYAE6OF01ES0HP.30.30.C08.1.454.CMB.1.raw
  modified_base (304)..(308): a, c, t, g, unknown or other
  misc_feature (304)..(308): n is a, c, g, or t

SEQ ID NO: 8773 - DNA, 306 bp, Homo sapiens
  misc_feature: GYAE6OF01BLZ23.30.30.C08.1.454.CMB.1.raw
  modified_base (303)..(306): a, c, t, g, unknown or other
  misc_feature (303)..(306): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnn

SEQ ID NO: 8774 - DNA, 310 bp, Homo sapiens; identical to SEQ ID NO: 8734
  misc_feature: GYAE6OF01DQRI5.30.30.C08.1.454.CMB.1.raw
  modified_base (305)..(310): a, c, t, g, unknown or other
  misc_feature (305)..(310): n is a, c, g, or t

SEQ ID NO: 8775 - DNA, 308 bp, Homo sapiens; identical to SEQ ID NO: 8721
  misc_feature: GYAE6OF01BM93L.30.30.C08.1.454.CMB.1.raw
  modified_base (305)..(308): a, c, t, g, unknown or other
  misc_feature (305)..(308): n is a, c, g, or t

SEQ ID NO: 8776 - DNA, 307 bp, Homo sapiens
  misc_feature: GYAE6OF01A5E62.30.30.C08.1.454.CMB.1.raw
  modified_base (304)..(307): a, c, t, g, unknown or other
  misc_feature (304)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnn

SEQ ID NO: 8777 - DNA, 307 bp, Homo sapiens; identical to SEQ ID NO: 8705
  misc_feature: GYAE6OF01B9WHK.30.30.C08.1.454.CMB.1.raw
  modified_base (304)..(307): a, c, t, g, unknown or other
  misc_feature (304)..(307): n is a, c, g, or t

SEQ ID NO: 8778 - DNA, 308 bp, Homo sapiens
  misc_feature: GYAE6OF01CS7KD.30.30.C08.1.454.CMB.1.raw
  modified_base (304)..(308): a, c, t, g, unknown or other
  misc_feature (304)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcacgtagcgtgctgagcgggctggcaaggcgcatagnnnnn

SEQ ID NO: 8779 - DNA, 308 bp, Homo sapiens; identical to SEQ ID NO: 8721
  misc_feature: GYAE6OF01DIIDZ.30.30.C08.1.454.CMB.1.raw
  modified_base (305)..(308): a, c, t, g, unknown or other
  misc_feature (305)..(308): n is a, c, g, or t

SEQ ID NO: 8780 - DNA, 310 bp, Homo sapiens
  misc_feature: GYAE6OF01DTJTO.30.30.C08.1.454.CMB.1.raw
  modified_base (288)..(288): a, c, t, g, unknown or other
  misc_feature (288)..(288): n is a, c, g, or t
  modified_base (305)..(310): a, c, t, g, unknown or other
  misc_feature (305)..(310): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggntggcaaggcgcataggnnnnnn

SEQ ID NO: 8781 - DNA, 310 bp, Homo sapiens
  misc_feature: GYAE6OF01D2LSX.30.30.C08.1.454.CMB.1.raw
  modified_base (306)..(310): a, c, t, g, unknown or other
  misc_feature (306)..(310): n is a, c, g, or t
tcagcacgctacgtcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 8782 - DNA, 309 bp, Homo sapiens
  misc_feature: GYAE6OF01BO0KM.30.30.C08.1.454.CMB.1.raw
  modified_base (304)..(309): a, c, t, g, unknown or other
  misc_feature (304)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnn

SEQ ID NO: 8783 - DNA, 307 bp, Homo sapiens; identical to SEQ ID NO: 8705
  misc_feature: GYAE6OF01BQHS3.30.30.C08.1.454.CMB.1.raw
  modified_base (304)..(307): a, c, t, g, unknown or other
  misc_feature (304)..(307): n is a, c, g, or t

SEQ ID NO: 8784 - DNA, 311 bp, Homo sapiens
  misc_feature: GYAE6OF01CMZN0.30.30.C08.1.454.CMB.1.raw
  modified_base (306)..(311): a, c, t, g, unknown or other
  misc_feature (306)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnnn

SEQ ID NO: 8785 - DNA, 310 bp, Homo sapiens; identical to SEQ ID NO: 8734
  misc_feature: GYAE6OF01BXTL0.30.30.C08.1.454.CMB.1.raw
  modified_base (305)..(310): a, c, t, g, unknown or other
  misc_feature (305)..(310): n is a, c, g, or t

SEQ ID NO: 8786 - DNA, 318 bp, Homo sapiens
  misc_feature: GYAE6OF01A9H1Q.30.30.C08.1.454.CMB.1.raw
  modified_base (306)..(318): a, c, t, g, unknown or other
  misc_feature (306)..(318): n is a, c, g, or t
tcagcacgctacgtcacgaccggtgctcgatttagtctgacgtcaaagggaaagggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagccacctccgagagcacagcggccctgggctgcctggtcaaggctacttccacgtagcgtgctgagcgggctggcaaggcgcatagnnnnnnnnnnnnn

SEQ ID NO: 8787 - DNA, 309 bp, Homo sapiens; identical to SEQ ID NO: 8724
  misc_feature: GYAE6OF01AS44V.30.30.C08.1.454.CMB.1.raw
  modified_base (305)..(309): a, c, t, g, unknown or other
  misc_feature (305)..(309): n is a, c, g, or t

SEQ ID NO: 8788 - DNA, 305 bp, Homo sapiens; identical to SEQ ID NO: 8745
  misc_feature: GYAE6OF01DLWS6.30.30.C08.1.454.CMB.1.raw
  modified_base (304)..(305): a, c, t, g, unknown or other
  misc_feature (304)..(305): n is a, c, g, or t

SEQ ID NO: 8789 - DNA, 312 bp, Homo sapiens
  misc_feature: GYAE6OF01DBS1E.30.30.C08.1.454.CMB.1.raw
  modified_base (306)..(312): a, c, t, g, unknown or other
  misc_feature (306)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnnnn

SEQ ID NO: 8790 - DNA, 309 bp, Homo sapiens; identical to SEQ ID NO: 8724
  misc_feature: GYAE6OF01BTXCY.30.30.C08.1.454.CMB.1.raw
  modified_base (305)..(309): a, c, t, g, unknown or other
  misc_feature (305)..(309): n is a, c, g, or t

SEQ ID NO: 8791 - DNA, 313 bp, Homo sapiens
  misc_feature: GYAE6OF01EOJ1I.30.30.C08.1.454.CMB.1.raw
  modified_base (305)..(313): a, c, t, g, unknown or other
  misc_feature (305)..(313): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnn

SEQ ID NO: 8792 - DNA, 308 bp, Homo sapiens
  misc_feature: GYAE6OF01CB6ZB.30.30.C08.1.454.CMB.1.raw
  modified_base (304)..(308): a, c, t, g, unknown or other
  misc_feature (304)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnn

SEQ ID NO: 8793 - DNA, 307 bp, Homo sapiens
  misc_feature: GYAE6OF01B72KQ.30.30.C08.1.454.CMB.1.raw
  modified_base (303)..(307): a, c, t, g, unknown or other
  misc_feature (303)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactattccacgtagcgtgctgagcgggctggcaggcgcatagnnnnn

SEQ ID NO: 8794 - DNA, 305 bp, Homo sapiens
  misc_feature: GYAE6OF01B460O.30.30.C08.1.454.CMB.1.raw
  modified_base (302)..(305): a, c, t, g, unknown or other
  misc_feature (302)..(305): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggctacttccacgtagcgtgctgagcgggctggcaaggcgcatagnnnn

SEQ ID NO: 8795 - DNA, 310 bp, Homo sapiens; identical to SEQ ID NO: 8734
  misc_feature: GYAE6OF01DDU1Q.30.30.C08.1.454.CMB.1.raw
  modified_base (305)..(310): a, c, t, g, unknown or other
  misc_feature (305)..(310): n is a, c, g, or t

SEQ ID NO: 8796 - DNA, 330 bp, Homo sapiens
  misc_feature: GYAE6OF01DSFH8.30.30.C08.1.454.CMB.1.raw
  modified_base (311)..(330): a, c, t, g, unknown or other
  misc_feature (311)..(330): n is a, c, g, or t
tcagcacgctacgtcacgaccggtgctcgatttagtctgacgtcaaagggaaagggcgtggagtgggtggccaacataaaccaagatggaagtgaacagtactatgtggactctgtgaagggcccgattcacccatctccagagacaacgccaagaactcacctgtctcctcagcctccaccaagggcccatcggtcttcccctggcgcccctgctccgaggagcacctccgagagcacagcggccctgggctgcctggtcaaggactacttccacgtagcgtgctgacgccggctggcaaggcgcatagnnnnnnnnnnnnnnnnnnnn

SEQ ID NO: 8797 - DNA, 307 bp, Homo sapiens
  misc_feature: GYAE6OF01BUZXF.30.30.C08.1.454.CMB.1.raw
  modified_base (306)..(307): a, c, t, g, unknown or other
  misc_feature (306)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnn

SEQ ID NO: 8798 - DNA, 324 bp, Homo sapiens
  misc_feature: GYAE6OF01BZXTP.30.30.C08.1.454.CMB.1.raw
  modified_base (291)..(291): a, c, t, g, unknown or other
  misc_feature (291)..(291): n is a, c, g, or t
  modified_base (318)..(324): a, c, t, g, unknown or other
  misc_feature (318)..(324): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtccttcccccgtggccgcccctgcctccgaggacgccacctccgagacgcacagccggcccgtgggctgcctggtcaaggctacttccacgtagcgtnctggagcgggctggcaaggcgcatagnnnnnnn

SEQ ID NO: 8799 - DNA, 303 bp, Homo sapiens
  misc_feature: GYAE6OF01DIWAT.30.30.C08.1.454.CMB.1.raw
  modified_base (300)..(303): a, c, t, g, unknown or other
  misc_feature (300)..(303): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctccgagagcacagcggccctgggctgcctggtcaaggctacttcacgtagcgtgctgagcggctggcaaggcgcatagnnnn

SEQ ID NO: 8800 - DNA, 312 bp, Homo sapiens; identical to SEQ ID NO: 8789
  misc_feature: GYAE6OF01CKKP7.30.30.C08.1.454.CMB.1.raw
  modified_base (306)..(312): a, c, t, g, unknown or other
  misc_feature (306)..(312): n is a, c, g, or t

SEQ ID NO: 8801 - DNA, 307 bp, Homo sapiens; identical to SEQ ID NO: 8705
  misc_feature: GYAE6OF01EIPF0.30.30.C08.1.454.CMB.1.raw
  modified_base (304)..(307): a, c, t, g, unknown or other
  misc_feature (304)..(307): n is a, c, g, or t

SEQ ID NO: 8802 - DNA, 312 bp, Homo sapiens; identical to SEQ ID NO: 8789
  misc_feature: GYAE6OF01DYIWY.30.30.C08.1.454.CMB.1.raw
  modified_base (306)..(312): a, c, t, g, unknown or other
  misc_feature (306)..(312): n is a, c, g, or t

SEQ ID NO: 8803 - DNA, 308 bp, Homo sapiens
  misc_feature: GYAE6OF01AZTFW.30.30.C08.1.454.CMB.1.raw
  modified_base (304)..(308): a, c, t, g, unknown or other
  misc_feature (304)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcggctggcaaggcgcatagnnnnn

SEQ ID NO: 8804 - DNA, 309 bp, Homo sapiens
  misc_feature: GYAE6OF01A5LIM.30.30.C08.1.454.CMB.1.raw
  modified_base (306)..(309): a, c, t, g, unknown or other
  misc_feature (306)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnn

SEQ ID NO: 8805 - DNA, 308 bp, Homo sapiens
  misc_feature: GYAE6OF01APPX7.30.30.C08.1.454.CMB.1.raw
  modified_base (306)..(308): a, c, t, g, unknown or other
  misc_feature (306)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnn

SEQ ID NO: 8806 - DNA, 308 bp, Homo sapiens; identical to SEQ ID NO: 8792
  misc_feature: GYAE6OF01D6YXD.30.30.C08.1.454.CMB.1.raw
  modified_base (304)..(308): a, c, t, g, unknown or other
  misc_feature (304)..(308): n is a, c, g, or t

SEQ ID NO: 8807 - DNA, 308 bp, Homo sapiens; identical to SEQ ID NO: 8721
  misc_feature: GYAE6OF01EWVAG.30.30.C08.1.454.CMB.1.raw
  modified_base (305)..(308): a, c, t, g, unknown or other
  misc_feature (305)..(308): n is a, c, g, or t

SEQ ID NO: 8808 - DNA, 310 bp, Homo sapiens
  misc_feature: GYAE6OF01EWCQW.30.30.C08.1.454.CMB.1.raw
  modified_base (304)..(310): a, c, t, g, unknown or other
  misc_feature (304)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcgccctgggctgcctggtcaaggactacttccacgtagcgtgctgagcgggctggcaaggcgcatagnnnnnnn

SEQ ID NO: 8809 - DNA, 304 bp, Homo sapiens
  misc_feature: GYAE6OF01C48CW.30.30.C08.1.454.CMB.1.raw
  modified_base (304)..(304): a, c, t, g, unknown or other
  misc_feature (304)..(304): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatgn

SEQ ID NO: 8810 - DNA, 307 bp, Homo sapiens; identical to SEQ ID NO: 8732
  misc_feature: GYAE6OF01C1VAS.30.30.C08.1.454.CMB.1.raw
  modified_base (305)..(307): a, c, t, g, unknown or other
  misc_feature (305)..(307): n is a, c, g, or t

SEQ ID NO: 8811 - DNA, 309 bp, Homo sapiens; identical to SEQ ID NO: 8782
  misc_feature: GYAE6OF01BAEZG.30.30.C08.1.454.CMB.1.raw
  modified_base (304)..(309): a, c, t, g, unknown or other
  misc_feature (304)..(309): n is a, c, g, or t

SEQ ID NO: 8812 - DNA, 310 bp, Homo sapiens; identical to SEQ ID NO: 8734
  misc_feature: GYAE6OF01BIEX4.30.30.C08.1.454.CMB.1.raw
  modified_base (305)..(310): a, c, t, g, unknown or other
  misc_feature (305)..(310): n is a, c, g, or t

SEQ ID NO: 8813 - DNA, 309 bp, Homo sapiens; identical to SEQ ID NO: 8782
  misc_feature: GYAE6OF01CL34M.30.30.C08.1.454.CMB.1.raw
  modified_base (304)..(309): a, c, t, g, unknown or other
  misc_feature (304)..(309): n is a, c, g, or t

SEQ ID NO: 8814 - DNA, 311 bp, Homo sapiens
  misc_feature: GYAE6OF01DC6H5.30.30.C08.1.454.CMB.1.raw
  modified_base (305)..(311): a, c, t, g, unknown or other
  misc_feature (305)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgctccaggagcacctccgagagcacagcggcctgggctgcctggtcaaggctacttccagtactctatctgagcgggctggcaaggcgcatagnnnnnnn

SEQ ID NO: 8815 - DNA, 378 bp, Homo sapiens
  misc_feature: GYAE6OF01B6VQF.30.30.C08.1.454.CMB.1.raw
  modified_base (233)..(233): a, c, t, g, unknown or other
  misc_feature (233)..(233): n is a, c, g, or t
  modified_base (329)..(330): a, c, t, g, unknown or other
  misc_feature (329)..(330): n is a, c, g, or t
  modified_base (332)..(378): a, c, t, g, unknown or other
  misc_feature (332)..(378): n is a, c, g, or t
tcagcacgctacgtcacgaccggtgctcgatttagtctgacgtcaaagggaaagggggcgtggagtgggtaggcccaacattaaacccaagataggaagtcgaacagtactatgtggactctgtgaagggccgattcaccatctccagagacaacgccaagaactcactgtctcctcagccctccaccaagggcccatccggtccttccccctggccgccctgctccaggacncacctccgagagcacagccggccctgggctggcctggtcaaggcctacttccagtagcgtgctggacgcggggctgggacaagggcgctagtaggnngnnnnnnnnnnnnnnnnnnnnnnnnnnnnnnnnnnnnnnnnnnnnnnn

SEQ ID NO: 8816 - DNA, 310 bp, Homo sapiens
  misc_feature: GYAE6OF01A0GOZ.30.30.C08.1.454.CMB.1.raw
  modified_base (307)..(310): a, c, t, g, unknown or other
  misc_feature (307)..(310): n is a, c, g, or t
tcagcacgctacgtcacgaccggtgctcgatttagtctgacgtcaaagggaaaggggctggagtgggtgggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnn

SEQ ID NO: 8817 - DNA, 312 bp, Homo sapiens
  misc_feature: GYAE6OF01D39SA.30.30.C08.1.454.CMB.1.raw
  modified_base (306)..(312): a, c, t, g, unknown or other
  misc_feature (306)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttccccctggcgccctgctccaggagcacctccgagagcacagcggccctgggctgcctggtcaaggactacttccacgtagcgtgctgagcgggctggcaaggcgcagtagnnnnnnn

SEQ ID NO: 8818 - DNA, 308 bp, Homo sapiens
  misc_feature: GYAE6OF01BT1R7.30.30.C08.1.454.CMB.1.raw
  modified_base (218)..(218): a, c, t, g, unknown or other
  misc_feature (218)..(218): n is a, c, g, or t
  modified_base (294)..(294): a, c, t, g, unknown or other
  misc_feature (294)..(294): n is a, c, g, or t
  modified_base (300)..(308): a, c, t, g, unknown or other
  misc_feature (300)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccacaagggcccatcggtcttcccctggcgccctgctccaggancactcgagagcacagcggcctgggctgcctggtcaaggctacttccacgtagcgtgctgagcgggctggcaaggcncatagnnnnnnnnn

SEQ ID NO: 8819 - DNA, 307 bp, Homo sapiens
  misc_feature: GYAE6OF01EYJSY.30.30.C08.1.454.CMB.1.raw
  modified_base (305)..(307): a, c, t, g, unknown or other
  misc_feature (305)..(307): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnn

SEQ ID NO: 8820 - DNA, 305 bp, Homo sapiens
  misc_feature: GYAE6OF01EHF8C.30.30.C08.1.454.CMB.1.raw
  modified_base (303)..(305): a, c, t, g, unknown or other
  misc_feature (303)..(305): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnn

SEQ ID NO: 8821 - DNA, 452 bp, Homo sapiens
  misc_feature: GYAE6OF01C7W4U.30.30.C08.1.454.CMB.1.raw
  modified_base (414)..(415): a, c, t, g, unknown or other
  misc_feature (414)..(415): n is a, c, g, or t
  modified_base (417)..(452): a, c, t, g, unknown or other
  misc_feature (417)..(452): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactccactgtctacctcagcctaccaaccgaagggcccatccggtccttccccctggccgcccctgcctcccgagggacggccaacctccggaagacgaccgaacgacggccgggtccccgtggggccttcggcccgttagggtacccgaaagggaaccttaccttttaccccgaaccggtttaagccggttacgcctttaggggaacggccgggggtccttggggaccgaaaaggggccggttaccaaaagtttcgggnngnnnnnnnnnnnnnnnnnnnnnnnnnnnnnnnnnnnn

SEQ ID NO: 8822 - DNA, 333 bp, Homo sapiens
  misc_feature: GYAE6OF01DZ166.30.30.C08.1.454.CMB.1.raw
  modified_base (290)..(290): a, c, t, g, unknown or other
  misc_feature (290)..(290): n is a, c, g, or t
  modified_base (306)..(308): a, c, t, g, unknown or other
  misc_feature (306)..(308): n is a, c, g, or t
  modified_base (310)..(333): a, c, t, g, unknown or other
  misc_feature (310)..(333): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcacttgtctcctcagcctccaccaagggcccatcggtcttccccctggcgccctgctccaggagcacctccgagagcacagcggcccctgggctgcctggtcaaggctacttccagtactctatctgagcggntggcaaggcgcatagnnngnnnnnnnnnnnnnnnnnnnnnnnn

SEQ ID NO: 8823 - DNA, 308 bp, Homo sapiens; identical to SEQ ID NO: 8721
  misc_feature: GYAE6OF01BABZB.30.30.C08.1.454.CMB.1.raw
  modified_base (305)..(308): a, c, t, g, unknown or other
  misc_feature (305)..(308): n is a, c, g, or t

SEQ ID NO: 8824 - DNA, 307 bp, Homo sapiens; identical to SEQ ID NO: 8797
  misc_feature: GYAE6OF01B19D8.30.30.C08.1.454.CMB.1.raw
  modified_base (306)..(307): a, c, t, g, unknown or other
  misc_feature (306)..(307): n is a, c, g, or t

SEQ ID NO: 8825 - DNA, 308 bp, Homo sapiens; identical to SEQ ID NO: 8721
  misc_feature: GYAE6OF01BB0VQ.30.30.C08.1.454.CMB.1.raw
  modified_base (305)..(308): a, c, t, g, unknown or other
  misc_feature (305)..(308): n is a, c, g, or t

SEQ ID NO: 8826 - DNA, 307 bp, Homo sapiens; identical to SEQ ID NO: 8776
  misc_feature: GYAE6OF01BVCNH.30.30.C08.1.454.CMB.1.raw
  modified_base (304)..(307): a, c, t, g, unknown or other
  misc_feature (304)..(307): n is a, c, g, or t

SEQ ID NO: 8827 - DNA, 307 bp, Homo sapiens
  misc_feature: GYAE6OF01ADX0Y.30.30.C08.1.454.CMB.1.raw
  modified_base (303)..(307): a, c, t, g, unknown or other
  misc_feature (303)..(307): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnn

SEQ ID NO: 8828 - DNA, 305 bp, Homo sapiens
  misc_feature: GYAE6OF01EJ6D9.30.30.C08.1.454.CMB.1.raw
  modified_base (305)..(305): a, c, t, g, unknown or other
  misc_feature (305)..(305): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccagggcccatcggtcttcccctggcgccctgctcaggagcacctccgagagcacagccggcctgggctggcctggtcaaaggactacttccacgtagcgtgctgagcgggctggcaaggcgcatagn

SEQ ID NO: 8829 - DNA, 309 bp, Homo sapiens
  misc_feature: GYAE6OF01CHKI0.30.30.C08.1.454.CMB.1.raw
  modified_base (298)..(298): a, c, t, g, unknown or other
  misc_feature (298)..(298): n is a, c, g, or t
  modified_base (304)..(309): a, c, t, g, unknown or other
  misc_feature (304)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcncatagnnnnnn

SEQ ID NO: 8830 - DNA, 310 bp, Homo sapiens; identical to SEQ ID NO: 8734
  misc_feature: GYAE6OF01BDZXO.30.30.C08.1.454.CMB.1.raw
  modified_base (305)..(310): a, c, t, g, unknown or other
  misc_feature (305)..(310): n is a, c, g, or t

SEQ ID NO: 8831 - DNA, 310 bp, Homo sapiens; identical to SEQ ID NO: 8734
  misc_feature: GYAE6OF01B6DWJ.30.30.C08.1.454.CMB.1.raw
  modified_base (305)..(310): a, c, t, g, unknown or other
  misc_feature (305)..(310): n is a, c, g, or t

SEQ ID NO: 8832 - DNA, 312 bp, Homo sapiens; identical to SEQ ID NO: 8789
  misc_feature: GYAE6OF01B1HQT.30.30.C08.1.454.CMB.1.raw
  modified_base (306)..(312): a, c, t, g, unknown or other
  misc_feature (306)..(312): n is a, c, g, or t

SEQ ID NO: 8833 - DNA, 308 bp, Homo sapiens; identical to SEQ ID NO: 8805
  misc_feature: GYAE6OF01AWDH5.30.30.C08.1.454.CMB.1.raw
  modified_base (306)..(308): a, c, t, g, unknown or other
  misc_feature (306)..(308): n is a, c, g, or t

SEQ ID NO: 8834 - DNA, 315 bp, Homo sapiens
  misc_feature: GYAE6OF01DOL6Z.30.30.C08.1.454.CMB.1.raw
  modified_base (304)..(315): a, c, t, g, unknown or other
  misc_feature (304)..(315): n is a, c, g, or t
tcagcacgctacgtcacgaccggtgctcgatttagtctgacgtcaaagggaaaggggctgggagtgggtggccaacataaaccaagatggaagtgaacagtactatgtggactctgtgaaggccgattcaccatctccagagacaacgccaagaactcactgtctcctcagcctcaccaagggcccatcggtcttcccctggcgccctgctccaggagcacctccgagagcacagcggccctgggctgcctggtcaaggctacttcacgtagcgtagctgagcgggactggcaaggcgcatagnnnnnnnnnnnn

SEQ ID NO: 8835 - DNA, 308 bp, Homo sapiens; identical to SEQ ID NO: 8721
  misc_feature: GYAE6OF01E4CJG.30.30.C08.1.454.CMB.1.raw
  modified_base (305)..(308): a, c, t, g, unknown or other
  misc_feature (305)..(308): n is a, c, g, or t

SEQ ID NO: 8836 - DNA, 310 bp, Homo sapiens
  misc_feature: GYAE6OF01E23E5.30.30.C08.1.454.CMB.1.raw
  modified_base (219)..(219): a, c, t, g, unknown or other
  misc_feature (219)..(219): n is a, c, g, or t
  modified_base (306)..(310): a, c, t, g, unknown or other
  misc_feature (306)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagccggccctgggctgcctggtcaaggactacttccacgtagcgtgctgagcgggctggcaaggcgcatagnnnnn

SEQ ID NO: 8837 - DNA, 306 bp, Homo sapiens
  misc_feature: GYAE6OF01AF7QF.30.30.C08.1.454.CMB.1.raw
  modified_base (304)..(306): a, c, t, g, unknown or other
  misc_feature (304)..(306): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcactccgagagcacagcggccctgggctgcctggtcaaggactacttccacgtagcgtgctgagcggctggcaaggcgcatagnnn

SEQ ID NO: 8838 - DNA, 307 bp, Homo sapiens
  misc_feature: GYAE6OF01CWBJF.30.30.C08.1.454.CMB.1.raw
  modified_base (304)..(307): a, c, t, g, unknown or other
  misc_feature (304)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcggctggcaaggcgcatagnnnn

SEQ ID NO: 8839 - DNA, 315 bp, Homo sapiens
  misc_feature: GYAE6OF01CI2FZ.30.30.C08.1.454.CMB.1.raw
  modified_base (306)..(315): a, c, t, g, unknown or other
  misc_feature (306)..(315): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcagtagnnnnnnnnnn

SEQ ID NO: 8840 - DNA, 331 bp, Homo sapiens
  misc_feature: GYAE6OF01DYJPW.30.30.C08.1.454.CMB.1.raw
  modified_base (303)..(306): a, c, t, g, unknown or other
  misc_feature (303)..(306): n is a, c, g, or t
  modified_base (308)..(331): a, c, t, g, unknown or other
  misc_feature (308)..(331): n is a, c, g, or t
tcagcacgctacgtcacgaccggtgctcgatttagtctgacgtcaaagggaaaggggtctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcgccctgggctgcctggtcaaggctacttccacgtagcgtgctgagcggctggcaaggcgcatagnnnngnnnnnnnnnnnnnnnnnnnnnnnn

SEQ ID NO: 8841 - DNA, 312 bp, Homo sapiens
  misc_feature: GYAE6OF01DT49O.30.30.C08.1.454.CMB.1.raw
  modified_base (221)..(221): a, c, t, g, unknown or other
  misc_feature (221)..(221): n is a, c, g, or t
  modified_base (306)..(312): a, c, t, g, unknown or other
  misc_feature (306)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcatccaccaagggcccatcggtcttccccctggccgccctgctccaggancacctccgagagcacagcggccctgggctgcctggtcaaggactacttccacgtagcgtgctgagcggctggcaaggcgcatagnnnnnnn

SEQ ID NO: 8842 - DNA, 309 bp, Homo sapiens; identical to SEQ ID NO: 8724
  misc_feature: GYAE6OF01AHCQ0.30.30.C08.1.454.CMB.1.raw
  modified_base (305)..(309): a, c, t, g, unknown or other
  misc_feature (305)..(309): n is a, c, g, or t

SEQ ID NO: 8843 - DNA, 309 bp, Homo sapiens
  misc_feature: GYAE6OF01AY3QN.30.30.C08.1.454.CMB.1.raw
  modified_base (305)..(309): a, c, t, g, unknown or other
  misc_feature (305)..(309): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnn

SEQ ID NO: 8844 - DNA, 309 bp, Homo sapiens; identical to SEQ ID NO: 8709
  misc_feature: GYAE6OF01CYUIE.30.30.C08.1.454.CMB.1.raw
  modified_base (304)..(309): a, c, t, g, unknown or other
  misc_feature (304)..(309): n is a, c, g, or t

SEQ ID NO: 8845 - DNA, 318 bp, Homo sapiens
  misc_feature: GYAE6OF01CT61G.30.30.C08.1.454.CMB.1.raw
  modified_base (309)..(318): a, c, t, g, unknown or other
  misc_feature (309)..(318): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgctccaggagcacctccgagagcacagccggccctgggctgcctggtcaaggactacttccacgtagcgtgctgagcgggctggcaagggcgcatagnnnnnnnnnn

SEQ ID NO: 8846 - DNA, 310 bp, Homo sapiens; identical to SEQ ID NO: 8756
  misc_feature: GYAE6OF01B2FAX.30.30.C08.1.454.CMB.1.raw
  modified_base (304)..(310): a, c, t, g, unknown or other
  misc_feature (304)..(310): n is a, c, g, or t

SEQ ID NO: 8847 - DNA, 311 bp, Homo sapiens
  misc_feature: GYAE6OF01APN91.30.30.C08.1.454.CMB.1.raw
  modified_base (305)..(311): a, c, t, g, unknown or other
  misc_feature (305)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcatagnnnnnnn

SEQ ID NO: 8848 - DNA, 305 bp, Homo sapiens
  misc_feature: GYAE6OF01DPQ5C.30.30.C08.1.454.CMB.1.raw
  modified_base (301)..(305): a, c, t, g, unknown or other
  misc_feature (301)..(305): n is a, c, g, or t
tcagcacgctacgtcacgaccggtgctcgatttagtctgacgtcaaagggaaaggggctggagtggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctccgagagcacagcggcctgggctgcctggtcaaggactacttccacgtagcgtgctgagcggctggcaaggcgcatagnnnnn

SEQ ID NO: 8849 - DNA, 311 bp, Homo sapiens
  misc_feature: GYAE6OF01DVT0Z.30.30.C08.1.454.CMB.1.raw
  modified_base (306)..(311): a, c, t, g, unknown or other
  misc_feature (306)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgtcatagnnnnnn

SEQ ID NO: 8850 - DNA, 361 bp, Homo sapiens
  misc_feature: GYAE6OF01DTAOC.30.30.C08.1.454.CMB.1.raw
  modified_base (328)..(361): a, c, t, g, unknown or other
  misc_feature (328)..(361): n is a, c, g, or t
tcagcacgctacgtcacgaccggtgctcgatttagtctgacgtcaaagggtaaagggggtcggtggagtgggtcggccaacagtaaaccaagatggaagtgaacagtactagtcgtggactctgtcgaagggcccgattcaccatctccagagaccaacgccaagaactcactgtctcctcagccctccaccaaggcccatccggtcttcccctggccgccctgctccgaggacgcacctccgagagcacaggccggccctgggctgcctggtcaaggactacttccacgtagcgtgctggagcgggactgggcaaggccgcagtagnnnnnnnnnnnnnnnnnnnnnnnnnnnnnnnnnn

SEQ ID NO: 8851 - DNA, 306 bp, Homo sapiens
  misc_feature: GYAE6OF01AXCG4.30.30.C08.1.454.CMB.1.raw
  modified_base (305)..(306): a, c, t, g, unknown or other
  misc_feature (305)..(306): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnn

SEQ ID NO: 8852 - DNA, 319 bp, Homo sapiens
  misc_feature: GYAE6OF01D0XYF.30.30.C08.1.454.CMB.1.raw
  modified_base (299)..(299): a, c, t, g, unknown or other
  misc_feature (299)..(299): n is a, c, g, or t
  modified_base (305)..(319): a, c, t, g, unknown or other
  misc_feature (305)..(319): n is a, c, g, or t
tcagcacgctacgtcacgaccggtgctcgatttagtctgacgtcaaaggggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcncatagnnnnnnnnnnnnnnn

SEQ ID NO: 8853 - DNA, 307 bp, Homo sapiens
  misc_feature: GYAE6OF01DZPMO.30.30.C08.1.454.CMB.1.raw
  modified_base (287)..(287): a, c, t, g, unknown or other
  misc_feature (287)..(287): n is a, c, g, or t
  modified_base (303)..(307): a, c, t, g, unknown or other
  misc_feature (303)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctactccacgtagcgtgctgagcgggntggcaaggcgcatagnnnnn

SEQ ID NO: 8854 - DNA, 311 bp, Homo sapiens; identical to SEQ ID NO: 8784
  misc_feature: GYAE6OF01CTJ6C.30.30.C08.1.454.CMB.1.raw
  modified_base (306)..(311): a, c, t, g, unknown or other
  misc_feature (306)..(311): n is a, c, g, or t

SEQ ID NO: 8855 - DNA, 308 bp, Homo sapiens; identical to SEQ ID NO: 8721
  misc_feature: GYAE6OF01ES0IK.30.30.C08.1.454.CMB.1.raw
  modified_base (305)..(308): a, c, t, g, unknown or other
  misc_feature (305)..(308): n is a, c, g, or t

SEQ ID NO: 8856 - DNA, 309 bp, Homo sapiens
  misc_feature: GYAE6OF01EELNG.30.30.C08.1.454.CMB.1.raw
  modified_base (305)..(309): a, c, t, g, unknown or other
  misc_feature (305)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactactccacgtagcgtgctgagcgggctggcaaggcgcatagnnnnn

SEQ ID NO: 8857 - DNA, 356 bp, Homo sapiens
  misc_feature: GYAE6OF01DNJI2.30.30.C08.1.454.CMB.1.raw
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (322)..(356): a, c, t, g, unknown or other
  misc_feature (322)..(356): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtccttccccctggcgccctgctccgaggacncacctccgaganccacaggccggccctgggctcggcctggtacaaggactacgttccaggtancgtagcngaacgcggctggccaaggcgacagtagcannnnnnnnnnnnnnnnnnnnnnnnnnnnnnnnnnn

SEQ ID NO: 8858 - DNA, 309 bp, Homo sapiens; identical to SEQ ID NO: 8724
  misc_feature: GYAE6OF01B8GEW.30.30.C08.1.454.CMB.1.raw
  modified_base (305)..(309): a, c, t, g, unknown or other
  misc_feature (305)..(309): n is a, c, g, or t

SEQ ID NO: 8859 - DNA, 312 bp, Homo sapiens
  misc_feature: GYAE6OF01EU5B4.30.30.C08.1.454.CMB.1.raw
  modified_base (297)..(297): a, c, t, g, unknown or other
  misc_feature (297)..(297): n is a, c, g, or t
  modified_base (303)..(312): a, c, t, g, unknown or other
  misc_feature (303)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaggcncatagnnnnnnnnnn

SEQ ID NO: 8860 - DNA, 309 bp, Homo sapiens; identical to SEQ ID NO: 8782
  misc_feature: GYAE6OF01EURUD.30.30.C08.1.454.CMB.1.raw
  modified_base (304)..(309): a, c, t, g, unknown or other
  misc_feature (304)..(309): n is a, c, g, or t

SEQ ID NO: 8861 - DNA, 309 bp, Homo sapiens; identical to SEQ ID NO: 8724
  misc_feature: GYAE6OF01B8X8X.30.30.C08.1.454.CMB.1.raw
  modified_base (305)..(309): a, c, t, g, unknown or other
  misc_feature (305)..(309): n is a, c, g, or t

SEQ ID NO: 8862 - DNA, 309 bp, Homo sapiens
  misc_feature: GYAE6OF01A1TYB.30.30.C08.1.454.CMB.1.raw
  modified_base (304)..(309): a, c, t, g, unknown or other
  misc_feature (304)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgcgagcgggctggcaaggcgcatagnnnnnn

SEQ ID NO: 8863 - DNA, 308 bp, Homo sapiens
  misc_feature: GYAE6OF01E2K8Q.30.30.C08.1.454.CMB.1.raw
  modified_base (304)..(308): a, c, t, g, unknown or other
  misc_feature (304)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaggcgcatagnnnnn

SEQ ID NO: 8864 - DNA, 310 bp, Homo sapiens; identical to SEQ ID NO: 8734
  misc_feature: GYAE6OF01BA6QU.30.30.C08.1.454.CMB.1.raw
  modified_base (305)..(310): a, c, t, g, unknown or other
  misc_feature (305)..(310): n is a, c, g, or t

SEQ ID NO: 8865 - DNA, 314 bp, Homo sapiens
  misc_feature: GYAE6OF01DGIHG.30.30.C08.1.454.CMB.1.raw
  modified_base (306)..(314): a, c, t, g, unknown or other
  misc_feature (306)..(314): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggacgccacctcgagagcacagccggcctgggctgcctggtacaaggctacttccacgtagcgtgctgagcgggctggcaaggcgcatagnnnnnnnnn

SEQ ID NO: 8866 - DNA, 309 bp, Homo sapiens; identical to SEQ ID NO: 8724
  misc_feature: GYAE6OF01EOAUP.30.30.C08.1.454.CMB.1.raw
  modified_base (305)..(309): a, c, t, g, unknown or other
  misc_feature (305)..(309): n is a, c, g, or t

SEQ ID NO: 8867 - DNA, 313 bp, Homo sapiens
  misc_feature: GYAE6OF01D0EAD.30.30.C08.1.454.CMB.1.raw
  modified_base (306)..(313): a, c, t, g, unknown or other
  misc_feature (306)..(313): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggactacttccacgtagcgtgctgagcgggctggcaaggcgcatagnnnnnnnn

SEQ ID NO: 8868 - DNA, 309 bp, Homo sapiens
  misc_feature: GYAE6OF01BDPLD.30.30.C08.1.454.CMB.1.raw
  modified_base (306)..(309): a, c, t, g, unknown or other
  misc_feature (306)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagccacctccgagacgcacagccggccctgggctgcctggtcaaggctacttccacgtagcgtgctgagcgggctggcaaggcgcatgnnnn

SEQ ID NO: 8869 - DNA, 310 bp, Homo sapiens; identical to SEQ ID NO: 8734
  misc_feature: GYAE6OF01A7JS2.30.30.C08.1.454.CMB.1.raw
  modified_base (305)..(310): a, c, t, g, unknown or other
  misc_feature (305)..(310): n is a, c, g, or t

SEQ ID NO: 8870 - DNA, 371 bp, Homo sapiens
  misc_feature: GYAE6OF01ACR82.30.30.C08.1.454.CMB.1.raw
  modified_base (356)..(371): a, c, t, g, unknown or other
  misc_feature (356)..(371): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtcctcctcagccctccaccaagggcccatccggtccttccccctggccgcccctgcctccgaggacgccaccgtccgagacgccacacggccggccccgtggggcctcggcccgttggtaccaaacggaccttacgttcccacggttagccgttgccttggacgccggggctgggacctaagggccgacatagnnnnnnnnnnnnnnnn

SEQ ID NO: 8871 - DNA, 319 bp, Homo sapiens
  misc_feature: GYAE6OF01A4SZD.30.30.C08.1.454.CMB.1.raw
  modified_base (311)..(319): a, c, t, g, unknown or other
  misc_feature (311)..(319): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtccttccccctggccgccctgcctccaggagcacctccgagagcacagcggccctgggctgcctggtcaaggactacttccacgtagcgtgctgagcgggctggcaagggcgcatagnnnnnnnnn

SEQ ID NO: 8872 - DNA, 311 bp, Homo sapiens; identical to SEQ ID NO: 8741
  misc_feature: GYAE6OF01CB634.30.30.C08.1.454.CMB.1.raw
  modified_base (305)..(311): a, c, t, g, unknown or other
  misc_feature (305)..(311): n is a, c, g, or t

SEQ ID NO: 8873 - DNA, 368 bp, Homo sapiens
  misc_feature: GYAE6OF01D7J2M.30.30.C08.1.454.CMB.1.raw
  modified_base (221)..(221): a, c, t, g, unknown or other
  misc_feature (221)..(221): n is a, c, g, or t
  modified_base (305)..(305): a, c, t, g, unknown or other
  misc_feature (305)..(305): n is a, c, g, or t
  modified_base (307)..(309): a, c, t, g, unknown or other
  misc_feature (307)..(309): n is a, c, g, or t
  modified_base (311)..(368): a, c, t, g, unknown or other
  misc_feature (311)..(368): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttccccctggccgccctgctccaggacncacctcgagagcacagtggccctgggctgcctggtcaaggctacttccacgtagcgtgctgagcggctggcaaggcacatagcntnnncnnnnnnnnnnnnnnnnnnnnnnnnnnnnnnnnnnnnnnnnnnnnnnnnnnnnnnnnnn

SEQ ID NO: 8874 - DNA, 308 bp, Homo sapiens
  misc_feature: GYAE6OF01C2ARX.30.30.C08.1.454.CMB.1.raw
  modified_base (303)..(308): a, c, t, g, unknown or other
  misc_feature (303)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagtgctgagcgggctggcaaggcgcatagnnnnnn

SEQ ID NO: 8875 - DNA, 317 bp, Homo sapiens
  misc_feature: GYAE6OF01EPS6N.30.30.C08.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (307)..(317): a, c, t, g, unknown or other
  misc_feature (307)..(317): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttccccnggcgccctgctccaggancacctccgagagcacagccggccctgggctgcctggtcaaggactacttccacgtagcgtgctggagcgggctggcaaggcgacatagnnnnnnnnnnn

SEQ ID NO: 8876 - DNA, 315 bp, Homo sapiens
  misc_feature: GYAE6OF01DL7UE.30.30.C08.1.454.CMB.1.raw
  modified_base (307)..(315): a, c, t, g, unknown or other
  misc_feature (307)..(315): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagccacctccgagagcacagccggccctgggctgcctggtcaaggactacttccacgtagcgtgctgagcgggctggcaaggcgcatagnnnnnnnnn

SEQ ID NO: 8877 - DNA, 306 bp, Homo sapiens
  misc_feature: GYAE6OF01DY4X7.30.30.C08.1.454.CMB.1.raw
  modified_base (298)..(298): a, c, t, g, unknown or other
  misc_feature (298)..(298): n is a, c, g, or t
  modified_base (303)..(306): a, c, t, g, unknown or other
  misc_feature (303)..(306): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcgtcttcccctggcgccctgctccaggagcacctccgagagcacagccggccctgggctgcctggtcaaggactacttccagtagcgtgctgagcggctggcaaggcgnatagnnnn

SEQ ID NO: 8878 - DNA, 313 bp, Homo sapiens
  misc_feature: GYAE6OF01C3EG4.30.30.C08.1.454.CMB.1.raw
  modified_base (307)..(313): a, c, t, g, unknown or other
  misc_feature (307)..(313): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggccaagggcgcatagnnnnnnn

SEQ ID NO: 8879 - DNA, 321 bp, Homo sapiens
  misc_feature: GYAE6OF01A4563.30.30.C08.1.454.CMB.1.raw
  modified_base (220)..(220): a, c, t, g, unknown or other
  misc_feature (220)..(220): n is a, c, g, or t
  modified_base (301)..(301): a, c, t, g, unknown or other
  misc_feature (301)..(301): n is a, c, g, or t
  modified_base (307)..(321): a, c, t, g, unknown or other
  misc_feature (307)..(321): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggancacctccgagagcacagccggccctgggctgcctggtcaaggctacttccacgtagcgtgctgacgcgggctggcaaggcncatagnnnnnnnnnnnnnnn

SEQ ID NO: 8880 - DNA, 311 bp, Homo sapiens
  misc_feature: GYAE6OF01BYALQ.30.30.C08.1.454.CMB.1.raw
  modified_base (306)..(311): a, c, t, g, unknown or other
  misc_feature (306)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggactacttccacgtagcgtgctgagcgggctggcaaggcgcatagnnnnnn

SEQ ID NO: 8881 - DNA, 311 bp, Homo sapiens; identical to SEQ ID NO: 8741
  misc_feature: GYAE6OF01BUU6E.30.30.C08.1.454.CMB.1.raw
  modified_base (305)..(311): a, c, t, g, unknown or other
  misc_feature (305)..(311): n is a, c, g, or t

SEQ ID NO: 8882 - DNA, 305 bp, Homo sapiens
  misc_feature: GYAE6OF01D61O7.30.30.C08.1.454.CMB.1.raw
  modified_base (303)..(305): a, c, t, g, unknown or other
  misc_feature (303)..(305): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggctacttccagtagcgtgctgagcggctggcaaggcgcatagnnn

SEQ ID NO: 8883 - DNA, 312 bp, Homo sapiens
  misc_feature: GYAE6OF01BMLLM.30.30.C08.1.454.CMB.1.raw
  modified_base (308)..(312): a, c, t, g, unknown or other
  misc_feature (308)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgctccaggacgcacctccgagagcacagcggccctgggctgcctggtcaaggactacttccacgtagcgtgctgagcgggctggcaaggcgcatagnnnnn

SEQ ID NO: 8884 - DNA, 362 bp, Homo sapiens
  misc_feature: GYAE6OF01CHK6O.30.30.C08.1.454.CMB.1.raw
  modified_base (347)..(362): a, c, t, g, unknown or other
  misc_feature (347)..(362): n is a, c, g, or t
tcagcacgctacgtcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaaccaacgggcccatccggtccttccccctggccgcccctgcctccaggacgccaccctccggagagccacgagccggccctggggcctcgccgtggtaccaaaggtccttacttccgacggttagccgttgctaggacggcgggtcgtgggaccaagggccgcaagtcggnnnnnnnnnnnnnnnn

SEQ ID NO: 8885 - DNA, 308 bp, Homo sapiens
  misc_feature: GYAE6OF01BRJWV.30.30.C08.1.454.CMB.1.raw
  modified_base (298)..(298): a, c, t, g, unknown or other
  misc_feature (298)..(298): n is a, c, g, or t
  modified_base (304)..(308): a, c, t, g, unknown or other
  misc_feature (304)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcncatagnnnnn

SEQ ID NO: 8886 - DNA, 312 bp, Homo sapiens
  misc_feature: GYAE6OF01ER17W.30.30.C08.1.454.CMB.1.raw
  modified_base (219)..(219): a, c, t, g, unknown or other
  misc_feature (219)..(219): n is a, c, g, or t
  modified_base (306)..(312): a, c, t, g, unknown or other
  misc_feature (306)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagccggccctgggctgcctggtcaaggactacttccacgtagcgtgctgagcgggctggcaaggcgcatagnnnnnnn

SEQ ID NO: 8887 - DNA, 314 bp, Homo sapiens
  misc_feature: GYAE6OF01DJMIG.30.30.C08.1.454.CMB.1.raw
  modified_base (306)..(314): a, c, t, g, unknown or other
  misc_feature (306)..(314): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggccgccctgctccaggacgcacctccgagagcacagccggcctgggctgcctggtcaaggctactccacgtagcgtgctgagcgggctggcaagggcgacatagnnnnnnnnn

SEQ ID NO: 8888 - DNA, 317 bp, Homo sapiens
  misc_feature: GYAE6OF01ES0CD.30.30.C08.1.454.CMB.1.raw
  modified_base (305)..(317): a, c, t, g, unknown or other
  misc_feature (305)..(317): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctctagacgcacagccggccctgggctgcctggcaaggctacttccagtagcgtgctgaggcgggctggcaagggcgcatagnnnnnnnnnnnnn

SEQ ID NO: 8889 - DNA, 553 bp, Homo sapiens
  misc_feature: GYAE6OF01BTGNP.30.30.C08.1.454.CMB.1.raw
  modified_base (169)..(169): a, c, t, g, unknown or other
  misc_feature (169)..(169): n is a, c, g, or t
  modified_base (214)..(214): a, c, t, g, unknown or other
  misc_feature (214)..(214): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
tcagcacgctacgtcacgaccggtgctcgattttagtctgacgtcaaagggaaaggggcgtggagtgggtggccaacataaaccaagatggaagtgaacagtactatgtggactctgtgaaggccattcaccatctccagagacaacgccaagaactcactgtctcctnagcctcacgaaggccatcggtctcccgtgcgcctgctcgaggacncaccgtcgagacgtcaacgtaggccgcctagggctgccgtggtacaaaggtaccttacttaccgaacggtacgcgtgctggaacggtcgggactggacacgggcgactaagtggntacgcgagctngacgntagcnggncgtgatgcagngtcgngctcggtatcgntaacgcgatcgctaagccgtaancgtagctacgacgtancgtacgtgaacnctaacgcgagttacacgtacgtacgtacgcgtacgtacggtactacgacgcgtacgtgaacgtacgtagtcgacgtttagacggcgtaaacgcgtttacacgtacgtacgtctcgtcgtcg

SEQ ID NO: 8890 - DNA, 312 bp, Homo sapiens
  misc_feature: GYAE6OF01BDWR4.30.30.C08.1.454.CMB.1.raw
  modified_base (307)..(312): a, c, t, g, unknown or other
  misc_feature (307)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaagggcgacatagnnnnnn

SEQ ID NO: 8891 - DNA, 331 bp, Homo sapiens
  misc_feature: GYAE6OF01BJR3S.30.30.C08.1.454.CMB.1.raw
  modified_base (220)..(220): a, c, t, g, unknown or other
  misc_feature (220)..(220): n is a, c, g, or t
  modified_base (305)..(331): a, c, t, g, unknown or other
  misc_feature (305)..(331): n is a, c, g, or t
tcagcacgctacgtcacgaccggtgctcgatttagtctgacgtcaaagggaagggggctggagtgggtggccaacagtaaaccaagatggaagtgaacagtactatgtggactctgtgaagggccgattcaccatctccagagacaacgccaagaactcactgtctcctcagcctccaccaagggcccatcggtcttcccctggcgccctgctccaggancactcgagagcacagcggccctgggctgcctggtacaaaggactacttccagtagcgttgctgagcggctggcaaggcgcatagnnnnnnnnnnnnnnnnnnnnnnnnnnn

SEQ ID NO: 8892 - DNA, 308 bp, Homo sapiens
  misc_feature: GYAE6OF01C6TCN.30.30.C08.1.454.CMB.1.raw
  modified_base (301)..(308): a, c, t, g, unknown or other
  misc_feature (301)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggcctgggctgtctggtcaaggactctcacgtagcgtgctgagcggctggcaaggcgcatagnnnnnnnn

SEQ ID NO: 8893 - DNA, 313 bp, Homo sapiens
  misc_feature: GYAE6OF01DD5Z7.30.30.C08.1.454.CMB.1.raw
  modified_base (301)..(301): a, c, t, g, unknown or other
  misc_feature (301)..(301): n is a, c, g, or t
  modified_base (307)..(313): a, c, t, g, unknown or other
  misc_feature (307)..(313): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggacgcacctccgagagcacagccggccctgggctgccgtggtcaaggacttactccacgtagcgtgctgagcgggctggcaaggcncatagnnnnnnn

SEQ ID NO: 8894 - DNA, 390 bp, Homo sapiens
  misc_feature: GYAE6OF01EWWBE.30.30.C08.1.454.CMB.1.raw
  modified_base (234)..(234): a, c, t, g, unknown or other
  misc_feature (234)..(234): n is a, c, g, or t
  modified_base (328)..(330): a, c, t, g, unknown or other
  misc_feature (328)..(330): n is a, c, g, or t
  modified_base (334)..(336): a, c, t, g, unknown or other
  misc_feature (334)..(336): n is a, c, g, or t
  modified_base (338)..(390): a, c, t, g, unknown or other
  misc_feature (338)..(390): n is a, c, g, or t
tcagcacgctacgtcacgaccggtgctcgattttagtctgacgtcaaagggaaaggggctggggagtgggtggccaacataaaccaagatgggaagtgaacagtactatgtgggactctgtgaagggccgattcaccatctccagagacaacgccaaggaactcgactgtctcctcagcctccaccaagggcccatcggtcttccccctgggccgcccctggcctccgagggancaccctccgagagcacagccggccctgggctgcctggtactaaggactacgttccacgtagcgtgctgagcgggctggacaaggcgacataggnnnagcnnntnnnnnnnnnnnnnnnnnnnnnnnnnnnnnnnnnnnnnnnnnnnnnnnnnnnnn

SEQ ID NO: 8895 - DNA, 307 bp, Homo sapiens; identical to SEQ ID NO: 8776
  misc_feature: GYAE6OF01EYR1M.30.30.C08.1.454.CMB.1.raw
  modified_base (304)..(307): a, c, t, g, unknown or other
  misc_feature (304)..(307): n is a, c, g, or t

SEQ ID NO: 8896 - DNA, 319 bp, Homo sapiens
  misc_feature: GYAE6OF01BIDBW.30.30.C08.1.454.CMB.1.raw
  modified_base (205)..(205): a, c, t, g, unknown or other
  misc_feature (205)..(205): n is a, c, g, or t
  modified_base (306)..(319): a, c, t, g, unknown or other
  misc_feature (306)..(319): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcnccctgctccaggagcacctccgagagcacagccgccctgggctgcctggtcaaggctacttccacgtagcgtgctgacgcgggctggacaaggcgcatagnnnnnnnnnnnnnn

SEQ ID NO: 8897 - DNA, 314 bp, Homo sapiens
  misc_feature: GYAE6OF01DDWSX.30.30.C08.1.454.CMB.1.raw
  modified_base (308)..(314): a, c, t, g, unknown or other
  misc_feature (308)..(314): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtccttcccctggccgccctgctccaggagcacctccgagagcacagccggcctgggctgcctggtccaaggactacttccacgtagccgtgctgagcgggctggcaaggcgcatagnnnnnnn

SEQ ID NO: 8898 - DNA, 315 bp, Homo sapiens
  misc_feature: GYAE6OF01DVTPQ.30.30.C08.1.454.CMB.1.raw
  modified_base (307)..(315): a, c, t, g, unknown or other
  misc_feature (307)..(315): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccgaggagcacctccgagagcacagccggcctgggctcgcctggtcaaggactacttccacgtagcgtgctgagcgggctggcaggcgcatagnnnnnnnnn

SEQ ID NO: 8899 - DNA, 312 bp, Homo sapiens
  misc_feature: GYAE6OF01D9F3U.30.30.C08.1.454.CMB.1.raw
  modified_base (306)..(312): a, c, t, g, unknown or other
  misc_feature (306)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggacgcacctccgagagcacagcggccctgggctgcctggtcaaggactacttccacgtagcgtgctgagcgggctggcaaggcgcatagnnnnnnn

SEQ ID NO: 8900 - DNA, 324 bp, Homo sapiens
  misc_feature: GYAE6OF01AUEZI.30.30.C08.1.454.CMB.1.raw
  modified_base (309)..(324): a, c, t, g, unknown or other
  misc_feature (309)..(324): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgcctccaggagccacctccgagacgcacagccggccctgggctgcctggtcaaggctactccagtagcgtgctgagcgggctggcaagggcgcatagcnnnnnnnnnnnnnnnn

SEQ ID NO: 8901 - DNA, 310 bp, Homo sapiens
  misc_feature: GYAE6OF01EXGZP.30.30.C08.1.454.CMB.1.raw
  modified_base (306)..(310): a, c, t, g, unknown or other
  misc_feature (306)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactacttccacgtagcgtgctgagcgggctggcaaggcgcatagnnnnn

SEQ ID NO: 8902 - DNA, 307 bp, Homo sapiens
  misc_feature: GYAE6OF01C6B51.30.30.C08.1.454.CMB.1.raw
  modified_base (304)..(307): a, c, t, g, unknown or other
  misc_feature (304)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggcctgggctgcctggtcaaggactacttccacgtagcgtgctgagcgggctggcaaggcgcatgnnnn

SEQ ID NO: 8903 - DNA, 309 bp, Homo sapiens
  misc_feature: GYAE6OF01BQDWM.30.30.C08.1.454.CMB.1.raw
  modified_base (219)..(219): a, c, t, g, unknown or other
  misc_feature (219)..(219): n is a, c, g, or t
  modified_base (302)..(309): a, c, t, g, unknown or other
  misc_feature (302)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagccggccctgggctgcctggcaaggtctactcacgtagctgctgagcgggctggcaaggcgcatagnnnnnnnn

SEQ ID NO: 8904 - DNA, 352 bp, Homo sapiens
  misc_feature: GYAE6OF01B2DQS.30.30.C08.1.454.CMB.1.raw
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (303)..(304): a, c, t, g, unknown or other
  misc_feature (303)..(304): n is a, c, g, or t
  modified_base (306)..(307): a, c, t, g, unknown or other
  misc_feature (306)..(307): n is a, c, g, or t
  modified_base (309)..(352): a, c, t, g, unknown or other
  misc_feature (309)..(352): n is a, c, g, or t
tcagcacgctacgtcacgaccggtgctcgatttagtctgacgtcaaagggaaaggggctgggagtgggtggccaacataaaccaagatggaagtgaacagtactatgtggactctgtgaagggccgattcaccatctcagagacaacgccaagaactcactgtctcctcagcctccaccaagggcccatcggtcttccccctggcgccctgctccgaggagccacctcgagagcacagcgcctgggctgcctgtcaaggctacttccacgtangtgctgagcgggntggctaaggcgcatagnngnngnnnnnnnnnnnnnnnnnnnnnnnnnnnnnnnnnnnnnnnnnnnn

SEQ ID NO: 8905 - DNA, 330 bp, Homo sapiens
  misc_feature: GYAE6OF01CMSO2.30.30.C08.1.454.CMB.1.raw
  modified_base (312)..(330): a, c, t, g, unknown or other
  misc_feature (312)..(330): n is a, c, g, or t
tcagcacgctacgtcacgaccggtgctcgatttagtctgacgtcaaagggaaagggggctggagtgggtggccaacataaaccaagatggaagtgaacagtactatgtggactctgtgaagggccgattcaccatctccagagacaacgccaagaactcactgtctcctcagcctcccaccaagggcccagtcggtcttccccctggccgccctgctccaggagccacctccggagcgcacagccggccctgggctgcctggtcaaggctacttccacgtagcgtgctgagcgggctggcaaggcgcatagnnnnnnnnnnnnnnnnnnn

SEQ ID NO: 8906 - DNA, 624 bp, Homo sapiens
  misc_feature: GYAE6OF01CBK38.30.30.C08.1.454.CMB.1.raw
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (468)..(468): a, c, t, g, unknown or other
  misc_feature (468)..(468): n is a, c, g, or t
  modified_base (517)..(517): a, c, t, g, unknown or other
  misc_feature (517)..(517): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
tcagcacgctacgtcacgaccggtgctcgatttagtctgacgtcaaagggaaaggggctggggagtgggtggccgaaacataaaaccgaagatgggaaggtgaactagtacctatagtggactcctgttgaaggccgtattttcaccatctccgagtacgacaacgtccaacgtaactcaactagtctccgtctacgcctccaccaagggccccagtcgggtcctttcccccgtggaccgccctgccttccggacggtacgccgaacctccgagacggtcgaactagtccggtccctgggccttcgacccgttggtccaaaccggacttaacctttccccacggtaccgccgtacgctggacggccgggcctcggctaaggcccgtcgaacgttaggctgacgngcncgtcgnganagtgancgactactagtgtgtcgtgcgtcacgacgacgacgtcgcgactacnctcactctcgtagcttacgtacgtcgtcgtacggcggtcccggagtccngtacgtgtacngtacgngtacgtagtgcgagcgagtacgtcgtacgacgtacgtacgacgtcgagacgcgtacgtaggacggtacgtagagtaggttgttggttcgg

SEQ ID NO: 8907 - DNA, 317 bp, Homo sapiens
  misc_feature: GYAE6OF01AIFQY.30.30.C08.1.454.CMB.1.raw
  modified_base (303)..(303): a, c, t, g, unknown or other
  misc_feature (303)..(303): n is a, c, g, or t
  modified_base (310)..(317): a, c, t, g, unknown or other
  misc_feature (310)..(317): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccagtccggtccttcccctggccgccctgctccaggagcacctccgagagcacagccggccctgggctgccgtggtcaaggactacttccagtagcgtgctgagcgggctggcaggcncagtagnnnnnnnn

SEQ ID NO: 8908 - DNA, 309 bp, Homo sapiens
  misc_feature: GYAE6OF01D3V89.30.30.C08.1.454.CMB.1.raw
  modified_base (288)..(288): a, c, t, g, unknown or other
  misc_feature (288)..(288): n is a, c, g, or t
  modified_base (305)..(309): a, c, t, g, unknown or other
  misc_feature (305)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggccgccctgctccaggagcacctcgagagcacagccggccctgggctgcctggtcaaggactacttccagtagcgtgctgagcgggntggcgaaggcgcatagnnnnn

SEQ ID NO: 8909 - DNA, 325 bp, Homo sapiens
  misc_feature: GYAE6OF01AGW3K.30.30.C08.1.454.CMB.1.raw
  modified_base (317)..(325): a, c, t, g, unknown or other
  misc_feature (317)..(325): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttccccctggccgccctgctccaggacgccacctccgagagccacagccggcccgtgggcctgccgtggtacaacggactaccttccgacgtagcgtgctggagcgggctggcaaggcgcatgnnnnnnnnn

SEQ ID NO: 8910 - DNA, 214 bp, Homo sapiens
  misc_feature: GYAE6OF01EPJWR.30.30.C08.1.454.CMB.1.raw
  modified_base (214)..(214): a, c, t, g, unknown or other
  misc_feature (214)..(214): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgcctn

SEQ ID NO: 8911 - DNA, 309 bp, Homo sapiens
  misc_feature: GYAE6OF01CQQVG.30.30.C08.1.454.CMB.1.raw
  modified_base (307)..(309): a, c, t, g, unknown or other
  misc_feature (307)..(309): n is a, c, g, or t
tcagcacgctacgtcacgaccggtgctcgatttagtctgacgtcaaagggaaagggctggagtgggtggccaacataaaccaagatggaagtgaacagtactatgtggactctggtgaagggccgattcaccatctccagagacaacgccaagaactcactgtctcctcagcctccaccaagggcccatcggtcttccccctggccgccctgcctccgaggagccacctccgagagcacagcggccctgggctgcctggtcaaggctacttcaacgtgcgtgctgagcggctggacaggtcgcatgnnn

SEQ ID NO: 8912 - DNA, 347 bp, Homo sapiens
  misc_feature: GYAE6OF01BR4IR.30.30.C08.1.454.CMB.1.raw
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
  modified_base (338)..(347): a, c, t, g, unknown or other
  misc_feature (338)..(347): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctcagagacaacgccaagactcactgtctcctcagcctccaccgaacgggcccagtccggtccttcccccgtggccgccctgcctccgagggacgccaccctccgagacgcacgacggccggcccgtgggcctcggccgtggtaaaaaaacnggacctacttccacgtagcggtgctgagcgggctggcgaaggcncgataggnnnnnnnnnn

SEQ ID NO: 8913 - DNA, 320 bp, Homo sapiens
  misc_feature: GYAE6OF01AKPQX.30.30.C08.1.454.CMB.1.raw
  modified_base (304)..(320): a, c, t, g, unknown or other
  misc_feature (304)..(320): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctactccacgtagcgtgctgagcgggctggcaaggcgcatagnnnnnnnnnnnnnnnnn

SEQ ID NO: 8914 - DNA, 318 bp, Homo sapiens
  misc_feature: GYAE6OF01CEM8R.30.30.C08.1.454.CMB.1.raw
  modified_base (309)..(318): a, c, t, g, unknown or other
  misc_feature (309)..(318): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggacgcacctccgagagcacagccggccctgggctgcctggtcaaggactacttccacgtagcgtgctgagcgggctggcaaggcgacatagnnnnnnnnnn

SEQ ID NO: 8915 - DNA, 319 bp, Homo sapiens
  misc_feature: GYAE6OF01AIW9D.30.30.C08.1.454.CMB.1.raw
  modified_base (302)..(302): a, c, t, g, unknown or other
  misc_feature (302)..(302): n is a, c, g, or t
  modified_base (307)..(319): a, c, t, g, unknown or other
  misc_feature (307)..(319): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctgccgccctgctccaggagccacctccgagagcacgagccggcccgtgggctgcctggtcaaggactacttccacgtagcgtgctgagcgggctggcaaggcncatgnnnnnnnnnnnnn

SEQ ID NO: 8916 - DNA, 310 bp, Homo sapiens
  misc_feature: GYAE6OF01CBIJQ.30.30.C08.1.454.CMB.1.raw
  modified_base (305)..(310): a, c, t, g, unknown or other
  misc_feature (305)..(310): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctcgagagcacagcggccctgggctgcctggtcaaggactacttccacgtagcgtgcctgagcgggctggcaaggcgcatagnnnnnn

SEQ ID NO: 8917 - DNA, 321 bp, Homo sapiens
  misc_feature: GYAE6OF01EPO4R.30.30.C08.1.454.CMB.1.raw
  modified_base (222)..(222): a, c, t, g, unknown or other
  misc_feature (222)..(222): n is a, c, g, or t
  modified_base (316)..(321): a, c, t, g, unknown or other
  misc_feature (316)..(321): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaaccaagggcccatccggtcttcccctggcgccctgctccagggancacctccgagagcacagccggccctgggctgcctggtcaaggctacttcccacgtagcgtgactgacgcggggctgggacaagggcgcagtagnnnnnn

SEQ ID NO: 8918 - DNA, 307 bp, Homo sapiens
  misc_feature: GYAE6OF01DUY3F.30.30.C08.1.454.CMB.1.raw
  modified_base (158)..(158): a, c, t, g, unknown or other
  misc_feature (158)..(158): n is a, c, g, or t
  modified_base (305)..(307): a, c, t, g, unknown or other
  misc_feature (305)..(307): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcnctgtctcctcagcctccaccaagggcccatcggtcttcccctggccgccctgctccaggagcacctccgagagcacagcggccctgggctgcctggtcaaggactactccacgtagcgtgctgagcgggctcggcaaggcgcatagnnn

SEQ ID NO: 8919 - DNA, 314 bp, Homo sapiens
  misc_feature: GYAE6OF01E1VNO.30.30.C08.1.454.CMB.1.raw
  modified_base (302)..(302): a, c, t, g, unknown or other
  misc_feature (302)..(302): n is a, c, g, or t
  modified_base (308)..(314): a, c, t, g, unknown or other
  misc_feature (308)..(314): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggacgcacctccgagacgcacagccggccctgggctgcctggtcaaggactacttccacgtagcgtgctgagcgggctggcaaggcncatagnnnnnnn

SEQ ID NO: 8920 - DNA, 331 bp, Homo sapiens
  misc_feature: GYAE6OF01CG8SE.30.30.C08.1.454.CMB.1.raw
  modified_base (313)..(313): a, c, t, g, unknown or other
  misc_feature (313)..(313): n is a, c, g, or t
  modified_base (319)..(331): a, c, t, g, unknown or other
  misc_feature (319)..(331): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttccccctggccgccctgcctccgaggacgcacctccgagacgcacagccggccctgggctgccgtggtacaaggaccttacgttccacggtagcgtgctgagcgggctggcaaggcncatagnnnnnnnnnnnnn

SEQ ID NO: 8921 - DNA, 328 bp, Homo sapiens
  misc_feature: GYAE6OF01BJX3T.30.30.C08.1.454.CMB.1.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (302)..(302): a, c, t, g, unknown or other
  misc_feature (302)..(302): n is a, c, g, or t
  modified_base (308)..(328): a, c, t, g, unknown or other
  misc_feature (308)..(328): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaaagaactcactgtctcctcagcctccacaagggcccatcggtcttcccctggcgccctgctccaggancacctcganagcacagcggcctgggctgcctggtacaaggactacttccaacgtagacgtgctggagcgggctggcaagggcncatagnnnnnnnnnnnnnnnnnnnnn

SEQ ID NO: 8922 - DNA, 311 bp, Homo sapiens
  misc_feature: GYAE6OF01DWPHA.30.30.C08.1.454.CMB.1.raw
  modified_base (306)..(311): a, c, t, g, unknown or other
  misc_feature (306)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatccggtcttcccctggcgccctgctccaggagcacctccgagagcacagccggcctgggctgcctggtcaaggactacttccacgtagcgtgctgagcgggctgggcaaggcgcatagnnnnnn

SEQ ID NO: 8923 - DNA, 312 bp, Homo sapiens
  misc_feature: GYAE6OF01BGELY.30.30.C08.1.454.CMB.1.raw
  modified_base (308)..(312): a, c, t, g, unknown or other
  misc_feature (308)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccaagggcccatccggtcttccccctggccgccctgcctccaggagcacctccgagagcacagccggccctgggctgcctggtcaaggactactccagtagcgtgctgagcggctggcaaggcgcatagnnnnn

SEQ ID NO: 8924 - DNA, 312 bp, Homo sapiens
  misc_feature: GYAE6OF01AIB0P.30.30.C08.1.454.CMB.1.raw
  modified_base (219)..(219): a, c, t, g, unknown or other
  misc_feature (219)..(219): n is a, c, g, or t
  modified_base (306)..(312): a, c, t, g, unknown or other
  misc_feature (306)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacaggccggccctgggctgcctggtcaaggctacttccacgtagcgtgctgagcgggctggcaaggcgcatagnnnnnnn

SEQ ID NO: 8925 - DNA, 344 bp, Homo sapiens
  misc_feature: GYAE6OF01CEHUA.30.30.C08.1.454.CMB.1.raw
  modified_base (137)..(137): a, c, t, g, unknown or other
  misc_feature (137)..(137): n is a, c, g, or t
  modified_base (156)..(156): a, c, t, g, unknown or other
  misc_feature (156)..(156): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (331)..(344): a, c, t, g, unknown or other
  misc_feature (331)..(344): n is a, c, g, or t
tcagcacgctacgtcacgaccggtgctcgatttagtctgacgtcaaagggaaggggctggaggtgggtggccaacataaaaccaagatggaagtgaacagtactatgtggactctgtgaagggcctattcaccatcncagagacaacgcaagaacncactgtctcctcagcctccaacgacgggcccatccggtccttcccccgtggccgccctgacctcgaggctccactcgganagcaacnggccgccgtagggctagcccgtggtacaaggtaccttcttaccgagtagcgtgtaccgtggaggcggtcnggacaagggcactanagnnnnnnnnnnnnnn

SEQ ID NO: 8926 - DNA, 311 bp, Homo sapiens
  misc_feature: GYAE6OF01EL9JI.30.30.C08.1.454.CMB.1.raw
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (302)..(311): a, c, t, g, unknown or other
  misc_feature (302)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaaggccatcggtcttcccnggcnccctgctccgaggcgcacctcgagagcacgagccggccctgggctgcctggtacaaggctacttccagtagcgtgctgagcggctggcaagggcacatagnnnnnnnnnn

SEQ ID NO: 8927 - DNA, 351 bp, Homo sapiens
  misc_feature: GYAE6OF01C1ZDP.30.30.C08.1.454.CMB.1.raw
  modified_base (311)..(312): a, c, t, g, unknown or other
  misc_feature (311)..(312): n is a, c, g, or t
  modified_base (314)..(351): a, c, t, g, unknown or other
  misc_feature (314)..(351): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaaagaactcactgtctcctcagcctccaccaaggcccatcggtcttcccctggcgccctgctccaggacgcacctccgagagcacacgcggcctgggctgccgtggtcaaggactacttccacggtagcgttgctgagcgggctgggcaaggcgcagtagnngnnnnnnnnnnnnnnnnnnnnnnnnnnnnnnnnnnnnnn

SEQ ID NO: 8928 - DNA, 344 bp, Homo sapiens
  misc_feature: GYAE6OF01CT5W2.30.30.C08.1.454.CMB.1.raw
  modified_base (228)..(228): a, c, t, g, unknown or other
  misc_feature (228)..(228): n is a, c, g, or t
  modified_base (312)..(312): a, c, t, g, unknown or other
  misc_feature (312)..(312): n is a, c, g, or t
  modified_base (330)..(344): a, c, t, g, unknown or other
  misc_feature (330)..(344): n is a, c, g, or t
tcagcacgctacgtcacgaccggtgctcgatttagtctgacgtcaaagggaaaggggctggagtgggtggccaacataaaccaagatggaagtgaacagtactatgtggactctgtggaaggccgattcaccatctccagagacaacgccaagaactcactgtctcctcagccctccaccgaagggcccatccggtccttccccctggccgccctgcctccgaggacnccacctccgagagccacaggccggcccgtgggcctcgccgtggtacaaaggccttactccacgtagcgtgccgtgacggcgggntggcgaaggcgacatagnnnnnnnnnnnnnnn

SEQ ID NO: 8929 - DNA, 427 bp, Homo sapiens
  misc_feature: GYAE6OF01DZ61N.30.30.C08.1.454.CMB.1.raw
  modified_base (392)..(427): a, c, t, g, unknown or other
  misc_feature (392)..(427): n is a, c, g, or t
tcagcacgctacgtcacgaccggtgctcgatttagtctgacgtcaaaggggaaaggggctggagtgggtggccaacataaaccaagatggaagtgaacagtactatgtggactctgtgaagggccgattccaccatctccagagaccaacgccaaagaactcactgtctcctcagccctccaaccgaacgggccccagttccggtccctttccccccgtgggcccgtccctgcctcccgaggacgccacccgtccgaaggacgccacgacgtcccgggccccgtgggacctcggccgttaggtaccgaaaggtaccttaccttacccgacggttacgccggtgcgttagggacggtcgggtacgtcgggaacgtacggggctacgaagtagnnnnnnnnnnnnnnnnnnnnnnnnnnnnnnnnnnnn

SEQ ID NO: 8930 - DNA, 329 bp, Homo sapiens
  misc_feature: GYAE6OF01DJ5VN.30.30.C08.1.454.CMB.1.raw
  modified_base (295)..(295): a, c, t, g, unknown or other
  misc_feature (295)..(295): n is a, c, g, or t
  modified_base (314)..(329): a, c, t, g, unknown or other
  misc_feature (314)..(329): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcacgcctccaccaagggccccatcggtccttccccctggccgccctgctccaggacgccacctccgagacgcacaggccgccgtgggctgcctggtcaaggactactccacgtagctgctgagcggntggcaaggcgtacagtagnnnnnnnnnnnnnnnn

SEQ ID NO: 8931 - DNA, 329 bp, Homo sapiens
  misc_feature: GYAE6OF01CEFX7.30.30.C08.1.454.CMB.1.raw
  modified_base (315)..(315): a, c, t, g, unknown or other
  misc_feature (315)..(315): n is a, c, g, or t
  modified_base (319)..(329): a, c, t, g, unknown or other
  misc_feature (319)..(329): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccacgagggcccatcggtccttccccgtggccgccctgctccgaggcgccacctccgagacgcacgaggccggtccgtgggcctgccgtggtacaaggcctactccacgtagcgtagctgaggcggcgtggcaaggccganatgnnnnnnnnnnn

SEQ ID NO: 8932 - DNA, 308 bp, Homo sapiens
  misc_feature: GYAE6OF01EZ75O.30.30.C08.1.454.CMB.1.raw
  modified_base (300)..(300): a, c, t, g, unknown or other
  misc_feature (300)..(300): n is a, c, g, or t
  modified_base (306)..(308): a, c, t, g, unknown or other
  misc_feature (306)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacacgcggccctgggctgcctggtcaaggactacttccacgtagcgtgctgagcgggctggcaaggcncatagnnn

SEQ ID NO: 8933 - DNA, 356 bp, Homo sapiens
  misc_feature: GYAE6OF01DJSAB.30.30.C08.1.454.CMB.1.raw
  modified_base (333)..(333): a, c, t, g, unknown or other
  misc_feature (333)..(333): n is a, c, g, or t
  modified_base (338)..(356): a, c, t, g, unknown or other
  misc_feature (338)..(356): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatcctccagagacaacgccaaagaactcactgtcctcctcagccctccaaccgaacgggcccatccggtccttcccccgtggccgccctgcctccgaggacgccaccgtccgagagccaacgcgccgccgtgggctcgccgtggtacgaacgtacctactccacgtagcgtgcgtggacgcgggcgtaggacgaaggcganagtgnnnnnnnnnnnnnnnnnnn

SEQ ID NO: 8934 - DNA, 372 bp, Homo sapiens
  misc_feature: GYAE6OF01DRX6O.30.30.C08.1.454.CMB.1.raw
  modified_base (361)..(372): a, c, t, g, unknown or other
  misc_feature (361)..(372): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcacgccctccaccgaacgggccccagtccggtccttcccccgtggccgtcccctgcctccgagggacgcctacccgtccgaagacgaccacgacggcccggcccgtgggcctcggcccgttaggtaccgaaggtaccttaccgttcccgacggttagccgtgcctggacggcgggctggcgaaggcgcagtagnnnnnnnnnnnn

SEQ ID NO: 8935 - DNA, 340 bp, Homo sapiens
  misc_feature: GYAE6OF01A937L.30.30.C08.1.454.CMB.1.raw
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (324)..(340): a, c, t, g, unknown or other
  misc_feature (324)..(340): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtcctcctcagcctccacaacgggcccatcggtccttcccgnggcnccctgcctccaggganccacctcgagacgcacaggccgccgtgggctgccgtggacaaggaccttactcccgaaggtnccggtgactggacgngggcctggacgacggcgacgatggnnnnnnnnnnnnnnnnn

SEQ ID NO: 8936 - DNA, 342 bp, Homo sapiens
  misc_feature: GYAE6OF01BXGB3.30.30.C08.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (313)..(342): a, c, t, g, unknown or other
  misc_feature (313)..(342): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccacaggccatcggtcttcccctggcnccctgctccaggagcacctcgagngcacagccggccctgggctcgcctggtcaacggtcctacttcccacgttcgcggtgactggacgcgggctgggacaaggcgctagtgnnnnnnnnnnnnnnnnnnnnnnnnnnnnnn

SEQ ID NO: 8937 - DNA, 321 bp, Homo sapiens
  misc_feature: GYAE6OF01BDEUK.30.30.C08.1.454.CMB.1.raw
  modified_base (312)..(312): a, c, t, g, unknown or other
  misc_feature (312)..(312): n is a, c, g, or t
  modified_base (316)..(321): a, c, t, g, unknown or other
  misc_feature (316)..(321): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtccttcccccgtggccgccctgcctccgaggacgcaccctccgagacgcacacgccggcccgtgggctgccgtggtacaaggactacttccacgtagcgtgctgagcggctggcaaggcgnatgnnnnnn

SEQ ID NO: 8938 - DNA, 326 bp, Homo sapiens
  misc_feature: GYAE6OF01BD0G9.30.30.C08.1.454.CMB.1.raw
  modified_base (289)..(289): a, c, t, g, unknown or other
  misc_feature (289)..(289): n is a, c, g, or t
  modified_base (319)..(326): a, c, t, g, unknown or other
  misc_feature (319)..(326): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtcctcctcagcctccaccgaagggcccatccggtccttcccccgtggccgccctgcctccaggacgccacctccgagagcacacgccggcccgtgggctgcctggtcaaggctaccttccacggtancgtgctgagcgggctggacaggcgcagtgnnnnnnnn

SEQ ID NO: 8939 - DNA, 356 bp, Homo sapiens
  misc_feature: GYAE6OF01AS6KH.30.30.C08.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (307)..(356): a, c, t, g, unknown or other
  misc_feature (307)..(356): n is a, c, g, or t
tcagcacgctacgtcacgaccggtgctcgatttagtctgacgtcaaaggggaaagggggctggagtgggtggccaacataaaaccaagatggaagtgaacagtactatgtggactctgtgaagggccgattcaccatctccagagacaacgccaagaactcactgtctcctcagcctccacgaaggcccatcggtcttccccnggccncctgctcaggancactcgagncacagccggccctgggctgcctgtcaaggctacttccacgtancgtgctgagcgggctggcaaggcncgatagncgannnnnnnnnnnnnnnnnnnnnnnnnnnnnnnnnnnnnnnnnnnnnnnnnn

SEQ ID NO: 8940 - DNA, 459 bp, Homo sapiens
  misc_feature: GYAE6OF01EKH6Q.30.30.C08.1.454.CMB.1.raw
  modified_base (391)..(393): a, c, t, g, unknown or other
  misc_feature (391)..(393): n is a, c, g, or t
  modified_base (395)..(459): a, c, t, g, unknown or other
  misc_feature (395)..(459): n is a, c, g, or t
tcagcacgctacgtcacgaccggtgctcgatttagtctgacgtcaaaaggggaaagggggctggagtgggtggccaacataaaccaagatggaagtgaacagtactatgtggactctgtgaagggccgattcaccatctccagagacaacgccaagaactcactgtcctcctcacgccctccaaccgaagggccccagtccggtcccttcccccgtggccgcccctgcctcccgaggacgccaccctccgagacgcacgacggccggcccgtgggctcggtccgtggtacaacggtaccttaccttccgaaccggtagccggttgccgttaggacgggccgggggtcgtacggggaccgtaaacgggggccgaccgaaaggttaggctgcnnncnnnnnnnnnnnnnnnnnnnnnnnnnnnnnnnnnnnnnnnnnnnnnnnnnnnnnnnnnnnnnnnnn

SEQ ID NO: 8941 - DNA, 329 bp, Homo sapiens
  misc_feature: GYAE6OF01CKADW.30.30.C08.1.454.CMB.1.raw
  modified_base (317)..(317): a, c, t, g, unknown or other
  misc_feature (317)..(317): n is a, c, g, or t
  modified_base (320)..(329): a, c, t, g, unknown or other
  misc_feature (320)..(329): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaaagaactcactgtctcctcagcctccaccaacgggcccagtccggtccttccccccgtggccgccctgcctccaggatcacctcgagagcacagccggccctgggctgcctggtacaaggctaccttccagtagcgtgctggaggcgggctggacaacggcgacanagnnnnnnnnnn

SEQ ID NO: 8942 - DNA, 313 bp, Homo sapiens
  misc_feature: GYAE6OF01A3NZ8.30.30.C08.1.454.CMB.1.raw
  modified_base (304)..(313): a, c, t, g, unknown or other
  misc_feature (304)..(313): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnnnnn

SEQ ID NO: 8943 - DNA, 339 bp, Homo sapiens
  misc_feature: GYAE6OF01DMFUR.30.30.C08.1.454.CMB.1.raw
  modified_base (171)..(171): a, c, t, g, unknown or other
  misc_feature (171)..(171): n is a, c, g, or t
  modified_base (243)..(243): a, c, t, g, unknown or other
  misc_feature (243)..(243): n is a, c, g, or t
  modified_base (321)..(339): a, c, t, g, unknown or other
  misc_feature (321)..(339): n is a, c, g, or t
tcagcacgctacgtcacgaccggtgctcgatttagtctgacgtcaaagggaaaggggctggagtgggtggccaacataaaccaagatggaagtgaacagtactatgtggactctgtggaaggccgattcaccatctccagagacaacgccaagaactcactgtctcctcancctccaccaagggcccatcggtccttcccccgtggccgccctgctccgaggacgcaccgtccgagagcaacnggccggccctgggctcgcctggtcaaggactaccttccacgtagctgcgtggagcgggctggacgaggccgacagagnnnnnnnnnnnnnnnnnnn

SEQ ID NO: 8944 - DNA, 430 bp, Homo sapiens
  misc_feature: GYAE6OF01AVA7P.30.30.C08.1.454.CMB.1.raw
  modified_base (372)..(430): a, c, t, g, unknown or other
  misc_feature (372)..(430): n is a, c, g, or t
tcagcacgctacgtcacgaccggtgctcgatttagtctgacgtcaaagggaaaggggctggagtgggtggccaacataaaaccaagatggaagtgaacagtactatgtggactctgtgaagggccgattcaccatctccagagacaacgccaagaactcactgtcctcctcagccctccaccaagggcccatccggtccttccccctggccgccctgcctccaggagccacctccggagagccacgacggccgggtcccgtgggggcctcggcccgtgggtaccgaaacggaccttaccttcccgaaccggttaggccgttcggctgggacggccggggtcgtgggactaacgggggccgcaagtaggcagnnnnnnnnnnnnnnnnnnnnnnnnnnnnnnnnnnnnnnnnnnnnnnnnnnnnnnnnnnn

SEQ ID NO: 8945 - DNA, 646 bp, Homo sapiens
  misc_feature: GYAE6OF01DE58A.30.30.C08.1.454.CMB.1.raw
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
  modified_base (628)..(628): a, c, t, g, unknown or other
  misc_feature (628)..(628): n is a, c, g, or t
tcagcacgctacgtcacgaccggtgctcgatttagtctgacgtcaaagggaaagggggctggagtgggtggccaacataaaccaagatggaagtgaacagtactatgtggactctgtgaggccgtacttcaccatctccagacgacacgcaagactcactgtctcctcacgcctccaacgaacggccctagtcggtccttcccgtggcccgccctagacctccgaggacgtaccaccgttcgagacgcgaacgacggtccggaccgtgggacctaggtcctaggtacgaacggtacttacttaccgaaggtaggtcggtacgtaccgtggacggtccggtactgggacctaacggcgactaagtacggcncgngtcgancgtaacgntcgagctanacgtacggttcagtgacaccttagcacgttggaaacctggaccnacgtcgancgtacgngcgtagtacgtgagtacgtcgtagtactacgtcgtgtacgcgtaaccgcgtactggtacgtaacgtgtaaccgtacggtaggtacggttacgttaggtaccgggtacgtaagtccgttaccgtaggtaccgtacggttactacggtaccaggtaccgacccgtagttaaccgngtcttacgtcccggtccg

SEQ ID NO: 8946 - DNA, 394 bp, Homo sapiens
  misc_feature: GYAE6OF01AK742.30.30.C08.1.454.CMB.1.raw
  modified_base (356)..(394): a, c, t, g, unknown or other
  misc_feature (356)..(394): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcacgccctccaaccgaacgggccccagttccggtccctttccccgtggcccgcccctgcctccgaggacgccacctccgagagcacgacgtccggcccgtgggcctcggtccgtggtaccgaacggtacctaccctcgacggtacgcgtgccgtgacggcgggcgtgggcaacgggccgactagtagnnnnnnnnnnnnnnnnnnnnnnnnnnnnnnnnnnnnnnn

SEQ ID NO: 8947 - DNA, 464 bp, Homo sapiens
  misc_feature: GYAE6OF01EALJ0.30.30.C08.1.454.CMB.1.raw
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (396)..(397): a, c, t, g, unknown or other
  misc_feature (396)..(397): n is a, c, g, or t
  modified_base (399)..(400): a, c, t, g, unknown or other
  misc_feature (399)..(400): n is a, c, g, or t
  modified_base (402)..(464): a, c, t, g, unknown or other
  misc_feature (402)..(464): n is a, c, g, or t
tcagcacgctacgtcacgaccggtgctcgatttagtctgacgtcaaagggaagggggctggagtgggtgccaacataaaccaagatggaagtgaaccagtactatgtggactctggtgaaggccgattcaccatctccagagacaacgccaagactcactgtctcctcagccctccaccaagggccccagtccggtccttcccccgtggccgtccctgcctcccgaggtacgccacccgtccggagacgcgacgtacggccgggtccccgtgggcctcggtccgttacggtcgaaacgggtaccttactttcccgaccggttaggtccgtagcccttaaggggacggtccggggtctcgggaccaaagggccganaaacgttagancgtgnaacgnncnngnnnnnnnnnnnnnnnnnnnnnnnnnnnnnnnnnnnnnnnnnnnnnnnnnnnnnnnnnnnnnnn

SEQ ID NO: 8948 - DNA, 437 bp, Homo sapiens
  misc_feature: GYAE6OF01AQ2QH.30.30.C08.1.454.CMB.1.raw
  modified_base (266)..(266): a, c, t, g, unknown or other
  misc_feature (266)..(266): n is a, c, g, or t
  modified_base (385)..(437): a, c, t, g, unknown or other
  misc_feature (385)..(437): n is a, c, g, or t
tcagcacgctacgtcacgaccggtgctcgatttagtctgacgtcaaagggaaaggggctggagtgggtggccaacataaaccaagatggaagtgaacagtactatgtggactctgtggaaggcccgattcaccatctaccagagacaaccgccaaagaactcactgtcctcctcacgccctccaacccgaacgggcccatccggttccctccccgtggccgccctcgactccgagggccgacctaccctccggagacgaccgaacncgggtcccggcccgttgggcctacggccggttacggtacaaccggttacctaccgtaccgtaacggtacgcgtcgtcggtagggacggcggtacggcggaccgacggcgacgtagcgannnnnnnnnnnnnnnnnnnnnnnnnnnnnnnnnnnnnnnnnnnnnnnnnnnnn

SEQ ID NO: 8949 - DNA, 413 bp, Homo sapiens
  misc_feature: GYAE6OF01CNWM3.30.30.C08.1.454.CMB.1.raw
  modified_base (134)..(134): a, c, t, g, unknown or other
  misc_feature (134)..(134): n is a, c, g, or t
  modified_base (154)..(154): a, c, t, g, unknown or other
  misc_feature (154)..(154): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (360)..(361): a, c, t, g, unknown or other
  misc_feature (360)..(361): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (372)..(413): a, c, t, g, unknown or other
  misc_feature (372)..(413): n is a, c, g, or t
tcagcacgctacgtcacgaccggtgctcgatttagtctgacgtcaaaggggaaggggctggagtgggtggccaacataaaccaagatggaagtgaacagtactatgtggactctgtgaagggccattcacatcncagagacaacgcaagaactnacttgtctcctcgagtccctcaacccgaagggccccaagttccggtccttcccccgngggccnccctagcctccgaggactctaccncggaancgacagtagccggtcctagggctagccgttggtcaaggtctaccttcacgtancgttgctacggagccgggtctgggccaaaggtcgaccaggtcgtgccagcttagacncannagcntgntnannnnnnnnnnnnnnnnnnnnnnnnnnnnnnnnnnnnnnnnnn

SEQ ID NO: 8950 - DNA, 415 bp, Homo sapiens
  misc_feature: GYAE6OF01AO8PI.30.30.C08.1.454.CMB.1.raw
  modified_base (380)..(380): a, c, t, g, unknown or other
  misc_feature (380)..(380): n is a, c, g, or t
  modified_base (384)..(415): a, c, t, g, unknown or other
  misc_feature (384)..(415): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccattcaccatcctccagagacaacgccaagaactcactgtcctcctcagccctccaccgacgggcccagtccggtccttcccccgtggccgcccctgcctccgaggacgccaccctcgagacgacacgacggcccggccccgtggggcctcggccgttacgggtaccgtaaacgggtacctttaacccgttcccgaaccggttacgttcggtgtacgggagggtccggacgggtacgacggaccgccgtacagtcanacgnnnnnnnnnnnnnnnnnnnnnnnnnnnnnnnn

SEQ ID NO: 8951 - DNA, 423 bp, Homo sapiens
  misc_feature: GYAE6OF01CU3SX.30.30.C08.1.454.CMB.1.raw
  modified_base (234)..(234): a, c, t, g, unknown or other
  misc_feature (234)..(234): n is a, c, g, or t
  modified_base (384)..(423): a, c, t, g, unknown or other
  misc_feature (384)..(423): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccattcaccatctccagagacaacgccaagaactcactgtctcctcagccctccaaccaagggccccagttcccggtccttccccccgtggccgcccctgcctccgagggacncacccgtcgagacgccaacaggcccggcccgtgggccttggacccgtgggtacctaagggaaccttccgtttaccgacggtaacggtccggtagccgtaggaggtccgggggctagggaccggaaacggccggaccttaagtaggcacgnnnnnnnnnnnnnnnnnnnnnnnnnnnnnnnnnnnnnnnn

SEQ ID NO: 8952 - DNA, 552 bp, Homo sapiens
  misc_feature: GYAE6OF01BRB2X.30.30.C08.1.454.CMB.1.raw
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (340)..(341): a, c, t, g, unknown or other
  misc_feature (340)..(341): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
tcagcacgctacgtcacgaccggtgctcgatttagtctgacgtcaaagggaaaggggctggagtgggtggccaacataaacccaagatggaagtgaacagtactatgtggactcgtgtgaagggccgattcaccatctccgagagacaacgccaagaactcactgtctcctcagccctccaccgaacggccagtccggtccttccccgtggccgccctgcctaccgaggaccncctaccgtcgagacgcacgacggccgtcccgtggcctggctggtacaacggtctacgttccgacgtcgcgtgcgtgaggtccggngtgacgagcganagtagcngtnncgnacgtctgctcgngactgacngntagctcgctacgcagttcgacacgtcgactcacgtcgcacggtcgcgtagctaacnggtacnccgacgtgacgcgtcgtccngtactcacggcngtcgacgtacacgtacgtcgcgtacgtacgtcgtcgtacgtcgacgtacgacggtcgacgcgtacgtaccgtacgtagaccgtcgtcgtacg

SEQ ID NO: 8953 - DNA, 312 bp, Homo sapiens
  misc_feature: GYAE6OF01CYGXI.30.30.C08.1.454.CMB.1.raw
  modified_base (216)..(216): a, c, t, g, unknown or other
  misc_feature (216)..(216): n is a, c, g, or t
  modified_base (303)..(312): a, c, t, g, unknown or other
  misc_feature (303)..(312): n is a, c, g, or t
tcagcacgctacgtcacgaccggtgctcgatttagtctgacgtcaaagggaaagggggctggagtgggtggccaacataaaccaagatggaagtgaacagtactatgtggactctgtgaagggccgattcaccatctccagagacaacgccaagaactcactgtctcctcagcctccaccaggcccatcggtcttcccctggcgccctgctcaggngcacctccgagagcacagcggccctgggctgctggtcaaggactacttccacgtagcgtgctgagcgggctggcaaggcgcagtagnnnnnnnnnn

SEQ ID NO: 8954 - DNA, 372 bp, Homo sapiens
  misc_feature: GYAE6OF01APP19.30.30.C08.1.454.CMB.1.raw
  modified_base (342)..(343): a, c, t, g, unknown or other
  misc_feature (342)..(343): n is a, c, g, or t
  modified_base (345)..(372): a, c, t, g, unknown or other
  misc_feature (345)..(372): n is a, c, g, or t
tcagcacgctacgtcacgaccggtgctcgatttagtctgacgtcaaagggaaagggggcgtggagtgggtgggccaacataaaccaagatggaagtgaacagtactatgtggactctgtgaagggccgattcaccatctccagagacaacgccaagaactcactgtctcctcagcctcccaccaacggggcccctatccgggtccttccccctggccgccctcgctccaggagccacctcggagacgcacacgcggtcccgtcgggctcgccgtggtacaacggacttaccctccaccgtaggccgtgacctgcgacggggctcggcaacggcgacaatcgnngnnnnnnnnnnnnnnnnnnnnnnnnnnnn

SEQ ID NO: 8955 - DNA, 416 bp, Homo sapiens
  misc_feature: GYAE6OF01BKZBD.30.30.C08.1.454.CMB.1.raw
  modified_base (256)..(256): a, c, t, g, unknown or other
  misc_feature (256)..(256): n is a, c, g, or t
  modified_base (375)..(416): a, c, t, g, unknown or other
  misc_feature (375)..(416): n is a, c, g, or t
tcagcacgctacgtcacgaccggtgctcgatttagtctgacgtcaaaggggaaaggggctggagtgggtggccaacataaaccaagatggaagtgaacagtactatgtggactctgtgaagggccgattcaccatctccagagacaacgccaagaactcactgtcctcctcacgcctccaccgaacgggcccagtccggtccttcccccgtgggcccgtccctgcctccaggacgccaccgtccaggggggggacnccacgacggccggcccgtcgggctcggccgtggtacgaacggtaccttaccttccgacggtacggtcgtcggtcgtaggacgggccgggtccggtacggacgaacgggcgacgagtagnnnnnnnnnnnnnnnnnnnnnnnnnnnnnnnnnnnnnnnnnn

SEQ ID NO: 8956 - DNA, 539 bp, Homo sapiens
  misc_feature: GYAE6OF01C13K2.30.30.C08.1.454.CMB.1.raw
  modified_base (69)..(69): a, c, t, g, unknown or other
  misc_feature (69)..(69): n is a, c, g, or t
  modified_base (158)..(158): a, c, t, g, unknown or other
  misc_feature (158)..(158): n is a, c, g, or t
  modified_base (168)..(168): a, c, t, g, unknown or other
  misc_feature (168)..(168): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (395)..(396): a, c, t, g, unknown or other
  misc_feature (395)..(396): n is a, c, g, or t
  modified_base (405)..(405): a, c, t, g, unknown or other
  misc_feature (405)..(405): n is a, c, g, or t
  modified_base (407)..(408): a, c, t, g, unknown or other
  misc_feature (407)..(408): n is a, c, g, or t
  modified_base (413)..(414): a, c, t, g, unknown or other
  misc_feature (413)..(414): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (440)..(441): a, c, t, g, unknown or other
  misc_feature (440)..(441): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (484)..(484): a, c, t, g, unknown or other
  misc_feature (484)..(484): n is a, c, g, or t
  modified_base (519)..(519): a, c, t, g, unknown or other
  misc_feature (519)..(519): n is a, c, g, or t
  modified_base (522)..(523): a, c, t, g, unknown or other
  misc_feature (522)..(523): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
  modified_base (531)..(532): a, c, t, g, unknown or other
  misc_feature (531)..(532): n is a, c, g, or t
  modified_base (537)..(537): a, c, t, g, unknown or other
  misc_feature (537)..(537): n is a, c, g, or t
tcagcacgctacgtcacgaccggtgctcgatttagtctgacgtcaaaggggaaaggggctggagtgggnggccaacataaaccaagatggaagtgaacagtactatgtgactctgtgaacggccgattcaccatctccagagaccaacgcaagactcnctgtctcctnacgccctccaaccgacgggccctagtcccggttccttccccgtggcctcccgtgcctccgagggaccgccctacccgtaccggaagacgaccgacgtacggacccggtcccgtgggccttcggaccggtacggtaccgaacggtaccttacctaccgaacggttacgtgcgtggacggtcggactcggacggtacgccgtacgactgntcnggntacgntgctntgnngactgctgnannagcanncaagtntangctngtaancgattcgnngccngttcagcngactgctganacgtttgcaattcgaagcctnaagcccttgggaacttgattcgaaatccagcgagngcnncanctncnngactngc

SEQ ID NO: 8957 - DNA, 348 bp, Homo sapiens
  misc_feature: GYAE6OF01BXKAA.30.30.C08.1.454.CMB.1.raw
  modified_base (324)..(348): a, c, t, g, unknown or other
  misc_feature (324)..(348): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtcctcctcagcctccaccgaagggcccagtcggtccttccccctggccgccctgctccgaggacgcacctccgagagcacagccggcccgtgggctgcctggtacgaaggacctaccttcacgtagcgtgctagaggcgggctggcgaagggcgcaagtagnnnnnnnnnnnnnnnnnnnnnnnnn

SEQ ID NO: 8958 - DNA, 334 bp, Homo sapiens
  misc_feature: GYAE6OF02I0VO4.30.30.C08.1.454.CMB.1.raw
  modified_base (307)..(334): a, c, t, g, unknown or other
  misc_feature (307)..(334): n is a, c, g, or t
tcagcacgctacgtcacgaccggtgctcgatttagtctgacgtcaaaggaaagggcgtggagtgggtggccaacataaaccaagatggaagtgaaccagtacctatgtggactctggtgaaggccgattcaccatcctccagagacaacgccaagaactcactgtctcctcagcctccaccaaggcccatcggtcttcccctggcgccctgcctccaggagcacctccgagagccacagcggccctggctgcctggtcaggactacttccacgtagcgtgctgagcggctaggctaaggcgcatagnnnnnnnnnnnnnnnnnnnnnnnnnnnn

SEQ ID NO: 8959 - DNA, 340 bp, Homo sapiens
  misc_feature: GYAE6OF02G8YF6.30.30.C08.1.454.CMB.1.raw
  modified_base (315)..(340): a, c, t, g, unknown or other
  misc_feature (315)..(340): n is a, c, g, or t
tcagcacgctacgtcacgaccggtgctcgatttagtctgacgtcaaagggaaaggggcggtggagtggggtgggccaacataaaccaagagtggaagtgaacagtactatggtggactctgtgaagggccgattcaccatctccgagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggcctaggcaaggcgttcatagnnnnnnnnnnnnnnnnnnnnnnnnnn

SEQ ID NO: 8960 - DNA, 307 bp, Homo sapiens; identical to SEQ ID NO: 8732
  misc_feature: GYAE6OF02IJVZA.30.30.C08.1.454.CMB.1.raw
  modified_base (305)..(307): a, c, t, g, unknown or other
  misc_feature (305)..(307): n is a, c, g, or t

SEQ ID NO: 8961 - DNA, 307 bp, Homo sapiens; identical to SEQ ID NO: 8732
  misc_feature: GYAE6OF02IPUBT.30.30.C08.1.454.CMB.1.raw
  modified_base (305)..(307): a, c, t, g, unknown or other
  misc_feature (305)..(307): n is a, c, g, or t

SEQ ID NO: 8962 - DNA, 306 bp, Homo sapiens
  misc_feature: GYAE6OF02GRI6W.30.30.C08.1.454.CMB.1.raw
  modified_base (304)..(306): a, c, t, g, unknown or other
  misc_feature (304)..(306): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagataacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 8963 - DNA, 307 bp, Homo sapiens; identical to SEQ ID NO: 8705
  misc_feature: GYAE6OF02F0MX2.30.30.C08.1.454.CMB.1.raw
  modified_base (304)..(307): a, c, t, g, unknown or other
  misc_feature (304)..(307): n is a, c, g, or t

SEQ ID NO: 8964 - DNA, 308 bp, Homo sapiens; identical to SEQ ID NO: 8735
  misc_feature: GYAE6OF02HXEFE.30.30.C08.1.454.CMB.1.raw
  modified_base (304)..(308): a, c, t, g, unknown or other
  misc_feature (304)..(308): n is a, c, g, or t

SEQ ID NO: 8965 - DNA, 404 bp, Homo sapiens
  misc_feature: GYAE6OF02HP39T.30.30.C08.1.454.CMB.1.raw
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
  modified_base (367)..(367): a, c, t, g, unknown or other
  misc_feature (367)..(367): n is a, c, g, or t
  modified_base (369)..(404): a, c, t, g, unknown or other
  misc_feature (369)..(404): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggtccgactgtcgttccccttccggnggccctccgtcgtccnccgaggcacctaccgacgagcaccacgcggcccgtccggtcggtcgtccgtcggttcgtaacggaacgtacctttccctacccgtaacggtcggtcgctcggtaggccggggccggtggccgaacggacgggccaagtaagtgngnnnnnnnnnnnnnnnnnnnnnnnnnnnnnnnnnnnn

SEQ ID NO: 8966 - DNA, 310 bp, Homo sapiens; identical to SEQ ID NO: 8734
  misc_feature: GYAE6OF02H2HVZ.30.30.C08.1.454.CMB.1.raw
  modified_base (305)..(310): a, c, t, g, unknown or other
  misc_feature (305)..(310): n is a, c, g, or t

SEQ ID NO: 8967 - DNA, 306 bp, Homo sapiens; identical to SEQ ID NO: 8716
  misc_feature: GYAE6OF02GKKZ2.30.30.C08.1.454.CMB.1.raw
  modified_base (304)..(306): a, c, t, g, unknown or other
  misc_feature (304)..(306): n is a, c, g, or t

SEQ ID NO: 8968 - DNA, 308 bp, Homo sapiens; identical to SEQ ID NO: 8721
  misc_feature: GYAE6OF02G8VCM.30.30.C08.1.454.CMB.1.raw
  modified_base (305)..(308): a, c, t, g, unknown or other
  misc_feature (305)..(308): n is a, c, g, or t

SEQ ID NO: 8969 - DNA, 331 bp, Homo sapiens
  misc_feature: GYAE6OF02IIO9N.30.30.C08.1.454.CMB.1.raw
  modified_base (309)..(331): a, c, t, g, unknown or other
  misc_feature (309)..(331): n is a, c, g, or t
tcagcacgctacgtcacgaccggtgctcgatttagtctgacgtcaaagggaaaggggtcgtggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagacgcacagcggccctgggctgcctggtcaaggactacttaccacgtagcgtgcctgagcgggctggcaaggcgcatagnnnnnnnnnnnnnnnnnnnnnnn

SEQ ID NO: 8970 - DNA, 310 bp, Homo sapiens; identical to SEQ ID NO: 8711
  misc_feature: GYAE6OF02G4R91.30.30.C08.1.454.CMB.1.raw
  modified_base (304)..(310): a, c, t, g, unknown or other
  misc_feature (304)..(310): n is a, c, g, or t

SEQ ID NO: 8971 - DNA, 310 bp, Homo sapiens; identical to SEQ ID NO: 8711
  misc_feature: GYAE6OF02FVZNX.30.30.C08.1.454.CMB.1.raw
  modified_base (304)..(310): a, c, t, g, unknown or other
  misc_feature (304)..(310): n is a, c, g, or t

SEQ ID NO: 8972 - DNA, 306 bp, Homo sapiens
  misc_feature: GYAE6OF02IAFKB.30.30.C08.1.454.CMB.1.raw
  modified_base (303)..(306): a, c, t, g, unknown or other
  misc_feature (303)..(306): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccatgggctgcctggtcaaggctacttccacgtagcgtgctgagcgggctggcaaggcgcatagnnnn

SEQ ID NO: 8973 - DNA, 309 bp, Homo sapiens; identical to SEQ ID NO: 8709
  misc_feature: GYAE6OF02I6Y9V.30.30.C08.1.454.CMB.1.raw
  modified_base (304)..(309): a, c, t, g, unknown or other
  misc_feature (304)..(309): n is a, c, g, or t

SEQ ID NO: 8974 - DNA, 309 bp, Homo sapiens
  misc_feature: GYAE6OF02I88QP.30.30.C08.1.454.CMB.1.raw
  modified_base (306)..(309): a, c, t, g, unknown or other
  misc_feature (306)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggcctgcctggtcaaggactacttccacgtagcgtgctgagcgggctggcaaggcgcatagnnnn

SEQ ID NO: 8975 - DNA, 351 bp, Homo sapiens
  misc_feature: GYAE6OF02IGWDJ.30.30.C08.1.454.CMB.1.raw
  modified_base (321)..(323): a, c, t, g, unknown or other
  misc_feature (321)..(323): n is a, c, g, or t
  modified_base (325)..(351): a, c, t, g, unknown or other
  misc_feature (325)..(351): n is a, c, g, or t
tcagcacgctacgtcacgaccggtgctcgatttagtctgacgtcaaagggaaagggggctggagtgggtggccaacataaacccaagactgggaagttgaacagttactattgtggactctgtgaagggccgattcaccatctccagagactaacggccaagaactcactgttctcctcagccttaccaccaagggcccatcgggtcttccccctggcgccctgctccaggaggcacctcggagagcacgagcggccctgggcctgcctggtcaaggctacttccacgtagccgtgctgagcggctggcaaggcgcatagnnngnnnnnnnnnnnnnnnnnnnnnnnnnnn

SEQ ID NO: 8976 - DNA, 372 bp, Homo sapiens
  misc_feature: GYAE6OF02GSW2J.30.30.C08.1.454.CMB.1.raw
  modified_base (309)..(309): a, c, t, g, unknown or other
  misc_feature (309)..(309): n is a, c, g, or t
  modified_base (326)..(372): a, c, t, g, unknown or other
  misc_feature (326)..(372): n is a, c, g, or t
tcagcacgctacgtcacgaccggtgctcgatttagtctgacgtcaaagggaaaggggtcgtggtagtgggtgggccaacataaaccaagatggaagtcgaaccagtactatggtggactcgtgtggaacgggccgattcacccatctccagagacaacgccaagaactcgactgtctcctcagcctccaccaagggcccatcggtcttcccctggcgccctgctccaggagcaccttccgaagagcacagcgggcccctgggcctcgcctggtacaacggactacttccacgtagcgtgctgagcgggntgggcaaggcgcatagnnnnnnnnnnnnnnnnnnnnnnnnnnnnnnnnnnnnnnnnnnnnnnn

SEQ ID NO: 8977 - DNA, 311 bp, Homo sapiens
  misc_feature: GYAE6OF02GBVYE.30.30.C08.1.454.CMB.1.raw
  modified_base (305)..(311): a, c, t, g, unknown or other
  misc_feature (305)..(311): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnnnn

SEQ ID NO: 8978 - DNA, 310 bp, Homo sapiens
  misc_feature: GYAE6OF02GIGH1.30.30.C08.1.454.CMB.1.raw
  modified_base (303)..(310): a, c, t, g, unknown or other
  misc_feature (303)..(310): n is a, c, g, or t
tcagcacgctacgtcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnnnnnnn

SEQ ID NO: 8979 - DNA, 308 bp, Homo sapiens
  misc_feature: GYAE6OF02FKYDC.30.30.C08.1.454.CMB.1.raw
  modified_base (304)..(308): a, c, t, g, unknown or other
  misc_feature (304)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnnnn

SEQ ID NO: 8980 - DNA, 326 bp, Homo sapiens
  misc_feature: GYAE6OF02GR7PD.30.30.C08.1.454.CMB.1.raw
  modified_base (308)..(326): a, c, t, g, unknown or other
  misc_feature (308)..(326): n is a, c, g, or t
tcagcacgctacgtcacgaccggtgctcgatttagtctgacgtcaaagggaaaggggctggagtgggtggccaacataaaccaagatggaagtgaaccagtactatgtggactctgtgaagggccgattcaccatctccagagacaacgccaagaactcactgtctcctcagcctccaccaagggtcccatcggtcttcccctggcgccctgctccaggagcacctccgagagcacagcggccctgggctgcctggtcaaggactacttccacgtagcgtgcctgagcgggctggcaaggcgcatagnnnnnnnnnnnnnnnnnnn

SEQ ID NO: 8981 - DNA, 306 bp, Homo sapiens
  misc_feature: GYAE6OF02FFAIF.30.30.C08.1.454.CMB.1.raw
  modified_base (303)..(306): a, c, t, g, unknown or other
  misc_feature (303)..(306): n is a, c, g, or t
tcagcacgctacgtcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnnn

SEQ ID NO: 8982 - DNA, 307 bp, Homo sapiens; identical to SEQ ID NO: 8705
  misc_feature: GYAE6OF02G21KV.30.30.C08.1.454.CMB.1.raw
  modified_base (304)..(307): a, c, t, g, unknown or other
  misc_feature (304)..(307): n is a, c, g, or t

SEQ ID NO: 8983 - DNA, 310 bp, Homo sapiens
  misc_feature: GYAE6OF02HTERD.30.30.C08.1.454.CMB.1.raw
  modified_base (303)..(310): a, c, t, g, unknown or other
  misc_feature (303)..(310): n is a, c, g, or t
tcagcacgctacgtcacgaccggtgctcgatttagtctgacgtcaaagggaaaggggctggagtggggtggccaacataaaccaagatggaagtgaacagtactatgtggactctgtgaagggccgattcaccatctcagagacaacgccaagaactcactgtctcctcagcctccaccaagggcccatcggtcttcccctggcgccctgctccaggagcacctccgagagcacagcggccctgggctgcctggtcaaggctacttcacgtagcgtgctgagcgggctggcaaggcgcatagnnnnnnnn

SEQ ID NO: 8984 - DNA, 310 bp, Homo sapiens
  misc_feature: GYAE6OF02GO964.30.30.C08.1.454.CMB.1.raw
  modified_base (305)..(310): a, c, t, g, unknown or other
  misc_feature (305)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtctccccctggcgccctgctccaggagcacctccgagagcacagcggccctgggctgcctggtcaaggactacttccacgtagcgtgctgagcgggctggcaaggcgcatagnnnnnn

SEQ ID NO: 8985 - DNA, 309 bp, Homo sapiens; identical to SEQ ID NO: 8724
  misc_feature: GYAE6OF02FPF9Y.30.30.C08.1.454.CMB.1.raw
  modified_base (305)..(309): a, c, t, g, unknown or other
  misc_feature (305)..(309): n is a, c, g, or t

SEQ ID NO: 8986 - DNA, 308 bp, Homo sapiens; identical to SEQ ID NO: 8721
  misc_feature: GYAE6OF02G8RTO.30.30.C08.1.454.CMB.1.raw
  modified_base (305)..(308): a, c, t, g, unknown or other
  misc_feature (305)..(308): n is a, c, g, or t

SEQ ID NO: 8987 - DNA, 306 bp, Homo sapiens; identical to SEQ ID NO: 8851
  misc_feature: GYAE6OF02G0MIS.30.30.C08.1.454.CMB.1.raw
  modified_base (305)..(306): a, c, t, g, unknown or other
  misc_feature (305)..(306): n is a, c, g, or t

SEQ ID NO: 8988 - DNA, 311 bp, Homo sapiens; identical to SEQ ID NO: 8741
  misc_feature: GYAE6OF02GWUDR.30.30.C08.1.454.CMB.1.raw
  modified_base (305)..(311): a, c, t, g, unknown or other
  misc_feature (305)..(311): n is a, c, g, or t

SEQ ID NO: 8989 - DNA, 388 bp, Homo sapiens
  misc_feature: GYAE6OF02G4XYF.30.30.C08.1.454.CMB.1.raw
  modified_base (314)..(314): a, c, t, g, unknown or other
  misc_feature (314)..(314): n is a, c, g, or t
  modified_base (321)..(322): a, c, t, g, unknown or other
  misc_feature (321)..(322): n is a, c, g, or t
  modified_base (324)..(325): a, c, t, g, unknown or other
  misc_feature (324)..(325): n is a, c, g, or t
  modified_base (327)..(328): a, c, t, g, unknown or other
  misc_feature (327)..(328): n is a, c, g, or t
  modified_base (331)..(388): a, c, t, g, unknown or other
  misc_feature (331)..(388): n is a, c, g, or t
tcagcacgctacgtcacgaccggtgctcgatttagtctgacgtcaaaggggaaaggggctggagtcgggtggccaaacataaaccaagatggaagtgaacagtacctatgtggactctgtgaagggccgattcaccatctccagagacaacgccaaggaactcactgtctcctcagccctccacccaagggcccatcggtcttccccctgggcgccctgctccaggagccacctccggagagccacacgcgggccctgggctgccctggtcaaggctacttccagtagcgtgctgagcgggcctggcaagggcncataggnngnngnnacnnnnnnnnnnnnnnnnnnnnnnnnnnnnnnnnnnnnnnnnnnnnnnnnnnnnnnnnnn

SEQ ID NO: 8990 - DNA, 306 bp, Homo sapiens; identical to SEQ ID NO: 8716
  misc_feature: GYAE6OF02GMSPD.30.30.C08.1.454.CMB.1.raw
  modified_base (304)..(306): a, c, t, g, unknown or other
  misc_feature (304)..(306): n is a, c, g, or t

SEQ ID NO: 8991 - DNA, 308 bp, Homo sapiens
  misc_feature: GYAE6OF02GQVO9.30.30.C08.1.454.CMB.1.raw
  modified_base (305)..(308): a, c, t, g, unknown or other
  misc_feature (305)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccaagtagcgtgctgagcgggctggcaaggcgcatagnnnn

SEQ ID NO: 8992 - DNA, 306 bp, Homo sapiens
  misc_feature: GYAE6OF02GZPHQ.30.30.C08.1.454.CMB.1.raw
  modified_base (304)..(306): a, c, t, g, unknown or other
  misc_feature (304)..(306): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtaggtgctgagcgggctggcaaggcgcatagnnn

SEQ ID NO: 8993 - DNA, 309 bp, Homo sapiens
  misc_feature: GYAE6OF02H5YAL.30.30.C08.1.454.CMB.1.raw
  modified_base (303)..(309): a, c, t, g, unknown or other
  misc_feature (303)..(309): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnn

SEQ ID NO: 8994 - DNA, 308 bp, Homo sapiens; identical to SEQ ID NO: 8721
  misc_feature: GYAE6OF02HR8EC.30.30.C08.1.454.CMB.1.raw
  modified_base (305)..(308): a, c, t, g, unknown or other
  misc_feature (305)..(308): n is a, c, g, or t

SEQ ID NO: 8995 - DNA, 309 bp, Homo sapiens; identical to SEQ ID NO: 8724
  misc_feature: GYAE6OF02F524E.30.30.C08.1.454.CMB.1.raw
  modified_base (305)..(309): a, c, t, g, unknown or other
  misc_feature (305)..(309): n is a, c, g, or t

SEQ ID NO: 8996 - DNA, 309 bp, Homo sapiens; identical to SEQ ID NO: 8724
  misc_feature: GYAE6OF02GW43H.30.30.C08.1.454.CMB.1.raw
  modified_base (305)..(309): a, c, t, g, unknown or other
  misc_feature (305)..(309): n is a, c, g, or t

SEQ ID NO: 8997 - DNA, 307 bp, Homo sapiens
  misc_feature: GYAE6OF02H3ET1.30.30.C08.1.454.CMB.1.raw
  modified_base (303)..(307): a, c, t, g, unknown or other
  misc_feature (303)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgctggtcaaggctacttccacgtagcgtgctgagcgggctggcaaggcgcatagnnnnn

SEQ ID NO: 8998 - DNA, 307 bp, Homo sapiens
  misc_feature: GYAE6OF02HV0GU.30.30.C08.1.454.CMB.1.raw
  modified_base (304)..(307): a, c, t, g, unknown or other
  misc_feature (304)..(307): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctgggcaaggcgcatagnnnn

SEQ ID NO: 8999 - DNA, 309 bp, Homo sapiens; identical to SEQ ID NO: 8724
  misc_feature: GYAE6OF02GHBW8.30.30.C08.1.454.CMB.1.raw
  modified_base (305)..(309): a, c, t, g, unknown or other
  misc_feature (305)..(309): n is a, c, g, or t

SEQ ID NO: 9000 - DNA, 306 bp, Homo sapiens
  misc_feature: GYAE6OF02F2W7T.30.30.C08.1.454.CMB.1.raw
  modified_base (305)..(306): a, c, t, g, unknown or other
  misc_feature (305)..(306): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcatagnn

SEQ ID NO: 9001 - DNA, 307 bp, Homo sapiens; identical to SEQ ID NO: 8705
  misc_feature: GYAE6OF02GJRSN.30.30.C08.1.454.CMB.1.raw
  modified_base (304)..(307): a, c, t, g, unknown or other
  misc_feature (304)..(307): n is a, c, g, or t

SEQ ID NO: 9002 - DNA, 316 bp, Homo sapiens
  misc_feature: GYAE6OF02IYVT4.30.30.C08.1.454.CMB.1.raw
  modified_base (306)..(316): a, c, t, g, unknown or other
  misc_feature (306)..(316): n is a, c, g, or t
tcagcacgctacgtcacgaccggtgctcgatttagtctgacgtcaaagggaaagggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnnn

SEQ ID NO: 9003 - DNA, 312 bp, Homo sapiens
  misc_feature: GYAE6OF02JC1YP.30.30.C08.1.454.CMB.1.raw
  modified_base (305)..(312): a, c, t, g, unknown or other
  misc_feature (305)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccagtagcacctccgagagcacagcggccctgggctgcctggtcaaggactacttccacgtagcgtgctgagcgggctggcaaggcgcatagnnnnnnnn

SEQ ID NO: 9004 - DNA, 311 bp, Homo sapiens; identical to SEQ ID NO: 8741
  misc_feature: GYAE6OF02HNA1Z.30.30.C08.1.454.CMB.1.raw
  modified_base (305)..(311): a, c, t, g, unknown or other
  misc_feature (305)..(311): n is a, c, g, or t

SEQ ID NO: 9005 - DNA, 307 bp, Homo sapiens
  misc_feature: GYAE6OF02HFEHH.30.30.C08.1.454.CMB.1.raw
  modified_base (304)..(307): a, c, t, g, unknown or other
  misc_feature (304)..(307): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccgagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 9006 - DNA, 312 bp, Homo sapiens
  misc_feature: GYAE6OF02H5J1S.30.30.C08.1.454.CMB.1.raw
  modified_base (306)..(312): a, c, t, g, unknown or other
  misc_feature (306)..(312): n is a, c, g, or t
tcagcacgctacgtcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnn

SEQ ID NO: 9007 - DNA, 315 bp, Homo sapiens
  misc_feature: GYAE6OF02F6FPT.30.30.C08.1.454.CMB.1.raw
  modified_base (305)..(315): a, c, t, g, unknown or other
  misc_feature (305)..(315): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcgaccatctccagagacaacgccaagaactcactgtctcctcagcctccaccaagggcccatcggtcttccccctggccgccctgctccaggagcacctccgagagcacagcgcctgggctgcctggtcaaggactacttccacgtagcgtgctgagcgggctggcaaggcgcatgnnnnnnnnnnn

SEQ ID NO: 9008 - DNA, 309 bp, Homo sapiens; identical to SEQ ID NO: 8724
  misc_feature: GYAE6OF02F1C48.30.30.C08.1.454.CMB.1.raw
  modified_base (305)..(309): a, c, t, g, unknown or other
  misc_feature (305)..(309): n is a, c, g, or t

SEQ ID NO: 9009 - DNA, 395 bp, Homo sapiens
  misc_feature: GYAE6OF02I5K06.30.30.C08.1.454.CMB.1.raw
  modified_base (245)..(245): a, c, t, g, unknown or other
  misc_feature (245)..(245): n is a, c, g, or t
  modified_base (290)..(290): a, c, t, g, unknown or other
  misc_feature (290)..(290): n is a, c, g, or t
  modified_base (379)..(395): a, c, t, g, unknown or other
  misc_feature (379)..(395): n is a, c, g, or t
tcagcacgctacgtcacgaccggtgctcgatttagtctgacgtcaaagggaaaggggcgtggagtgggtgggccaacaataaaccaagatggaagtgaacagtactatgtggactctgtgaagggccgattcaccatctccagagacaacgaccaacgaactacactgtctcctcacgcctccaccaacggacccgactccggtccttcccctcggccgccctcgctccacggacgccacctccnggagacgacaacgaacggaccggtccggtcgggtcgtcgtccgtncggtacgaacggtaccttaccttaccgtaagcgtacggtcgtcgtacgtacggacggcggtcggacgggacggacggacgacgtagagnnnnnnnnnnnnnnnnn

SEQ ID NO: 9010 - DNA, 357 bp, Homo sapiens
  misc_feature: GYAE6OF02H739R.30.30.C08.1.454.CMB.1.raw
  modified_base (334)..(357): a, c, t, g, unknown or other
  misc_feature (334)..(357): n is a, c, g, or t
tcagcacgctacgtcacgaccggtgctcgatttagtctgacgtcaaagggaaggggcggtggagtggggtggccaacataaaccaagagtggaagtgaacagtactatggtggactctgtgaagggccgattcaccatctcaggagacaacggccaagaacgtcactgtctcctccagcctccaccaagggcccatcggtcttccccctgggcgcccctggcctccaggagccacctccgagacgcacagcggacccctggggctgcctggtcaagggcttacttccacgtagccgttgcctagagccggggctgggccaacgggcgcattagnnnnnnnnnnnnnnnnnnnnnnnn

SEQ ID NO: 9011 - DNA, 308 bp, Homo sapiens; identical to SEQ ID NO: 8721
  misc_feature: GYAE6OF02I22TR.30.30.C08.1.454.CMB.1.raw
  modified_base (305)..(308): a, c, t, g, unknown or other
  misc_feature (305)..(308): n is a, c, g, or t

SEQ ID NO: 9012 - DNA, 308 bp, Homo sapiens; identical to SEQ ID NO: 8721
  misc_feature: GYAE6OF02IP9RA.30.30.C08.1.454.CMB.1.raw
  modified_base (305)..(308): a, c, t, g, unknown or other
  misc_feature (305)..(308): n is a, c, g, or t

SEQ ID NO: 9013 - DNA, 307 bp, Homo sapiens; identical to SEQ ID NO: 8776
  misc_feature: GYAE6OF02IAG5X.30.30.C08.1.454.CMB.1.raw
  modified_base (304)..(307): a, c, t, g, unknown or other
  misc_feature (304)..(307): n is a, c, g, or t

SEQ ID NO: 9014 - DNA, 312 bp, Homo sapiens
  misc_feature: GYAE6OF02F1UX3.30.30.C08.1.454.CMB.1.raw
  modified_base (305)..(312): a, c, t, g, unknown or other
  misc_feature (305)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcatagnnnnnnnn

SEQ ID NO: 9015 - DNA, 310 bp, Homo sapiens
  misc_feature: GYAE6OF02GWG7D.30.30.C08.1.454.CMB.1.raw
  modified_base (305)..(310): a, c, t, g, unknown or other
  misc_feature (305)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaatgccaagaactcactgtctcctcagcctccaccaagggcccatcggtcttcccctggcgccctgctccaggagcacctccgagagcacagccggcctgggctgcctggtcaaggactacttccacgtagcgtgctgagcgggctggcaaggcgcatagnnnnnn

SEQ ID NO: 9016 - DNA, 310 bp, Homo sapiens; identical to SEQ ID NO: 8734
  misc_feature: GYAE6OF02FUZ69.30.30.C08.1.454.CMB.1.raw
  modified_base (305)..(310): a, c, t, g, unknown or other
  misc_feature (305)..(310): n is a, c, g, or t

SEQ ID NO: 9017 - DNA, 315 bp, Homo sapiens
  misc_feature: GYAE6OF02IIE6C.30.30.C08.1.454.CMB.1.raw
  modified_base (307)..(315): a, c, t, g, unknown or other
  misc_feature (307)..(315): n is a, c, g, or t
tcagcacgctacgtcacgaccggtgctcgatttagtctgacgtcaaagggaaaggggctgggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctggggctcgcctggtcaaggactacttccacgtagcgtgctgagcggctggcaggcgcatagnnnnnnnnn

SEQ ID NO: 9018 - DNA, 307 bp, Homo sapiens; identical to SEQ ID NO: 8776
  misc_feature: GYAE6OF02HHLHS.30.30.C08.1.454.CMB.1.raw
  modified_base (304)..(307): a, c, t, g, unknown or other
  misc_feature (304)..(307): n is a, c, g, or t

SEQ ID NO: 9019 - DNA, 309 bp, Homo sapiens; identical to SEQ ID NO: 8724
  misc_feature: GYAE6OF02G7N5B.30.30.C08.1.454.CMB.1.raw
  modified_base (305)..(309): a, c, t, g, unknown or other
  misc_feature (305)..(309): n is a, c, g, or t

SEQ ID NO: 9020 - DNA, 309 bp, Homo sapiens
  misc_feature: GYAE6OF02FPOW6.30.30.C08.1.454.CMB.1.raw
  modified_base (306)..(309): a, c, t, g, unknown or other
  misc_feature (306)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttacccctggcgccctgctccaggagcacctccgagagcacagcggccctgggctgcctggtcaaggactacttccacgtagcgtgctgagcgggctggcaaggcgcatagnnnn

SEQ ID NO: 9021 - DNA, 323 bp, Homo sapiens
  misc_feature: GYAE6OF02GUG44.30.30.C08.1.454.CMB.1.raw
  modified_base (308)..(323): a, c, t, g, unknown or other
  misc_feature (308)..(323): n is a, c, g, or t
tcagcacgctacgtcacgaccggtgctcgatttagtctgacgtcaaagggaaaggggctgggagtgggtggccaacataaaaccaagatggaaggtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnnnnnnnn

SEQ ID NO: 9022 - DNA, 309 bp, Homo sapiens; identical to SEQ ID NO: 8724
  misc_feature: GYAE6OF02FZ69D.30.30.C08.1.454.CMB.1.raw
  modified_base (305)..(309): a, c, t, g, unknown or other
  misc_feature (305)..(309): n is a, c, g, or t

SEQ ID NO: 9023 - DNA, 314 bp, Homo sapiens
  misc_feature: GYAE6OF02F0DL9.30.30.C08.1.454.CMB.1.raw
  modified_base (305)..(314): a, c, t, g, unknown or other
  misc_feature (305)..(314): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnn

SEQ ID NO: 9024 - DNA, 307 bp, Homo sapiens
  misc_feature: GYAE6OF02H7RMS.30.30.C08.1.454.CMB.1.raw
  modified_base (303)..(307): a, c, t, g, unknown or other
  misc_feature (303)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcggctggcaaggcgcatgnnnnn

SEQ ID NO: 9025 - DNA, 311 bp, Homo sapiens
  misc_feature: GYAE6OF02GRGUG.30.30.C08.1.454.CMB.1.raw
  modified_base (303)..(311): a, c, t, g, unknown or other
  misc_feature (303)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccagtagcgtgctgagcgggctggcaaggcgcatagnnnnnnnnn

SEQ ID NO: 9026 - DNA, 369 bp, Homo sapiens
  misc_feature: GYAE6OF02FSYYY.30.30.C08.1.454.CMB.1.raw
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
  modified_base (313)..(314): a, c, t, g, unknown or other
  misc_feature (313)..(314): n is a, c, g, or t
  modified_base (317)..(318): a, c, t, g, unknown or other
  misc_feature (317)..(318): n is a, c, g, or t
  modified_base (320)..(369): a, c, t, g, unknown or other
  misc_feature (320)..(369): n is a, c, g, or t
tcagcacgctacgtcacgaccggtgctcgatttagtctgacgtcaaagggaaaggggcgggtggagtgggtgggccaacataaaccaagagtggaagtgaacagtactatggtggactctgtgaagggcccgattcaccatctccagagacaacgccaagaactcactgtctcctcagcctccaccaagggcccatcggtcttccccgtggccgccctgctccaggagcacctccgagagcacagcggcctgggctgccgtgtcaaggctactccagtancgtgctgagcgggctggcaaggcgcataggnanngcnngnnnnnnnnnnnnnnnnnnnnnnnnnnnnnnnnnnnnnnnnnnnnnnnnnn

SEQ ID NO: 9027 - DNA, 311 bp, Homo sapiens; identical to SEQ ID NO: 8741
  misc_feature: GYAE6OF02IYR1X.30.30.C08.1.454.CMB.1.raw
  modified_base (305)..(311): a, c, t, g, unknown or other
  misc_feature (305)..(311): n is a, c, g, or t

SEQ ID NO: 9028 - DNA, 309 bp, Homo sapiens
  misc_feature: GYAE6OF02H1PBZ.30.30.C08.1.454.CMB.1.raw
  modified_base (306)..(309): a, c, t, g, unknown or other
  misc_feature (306)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcccctgggctgcctggtcaaggactacttccacgtagcgtgctgagcgggctggcaaggcgcatagnnnn

SEQ ID NO: 9029 - DNA, 309 bp, Homo sapiens; identical to SEQ ID NO: 8724
  misc_feature: GYAE6OF02F2W8L.30.30.C08.1.454.CMB.1.raw
  modified_base (305)..(309): a, c, t, g, unknown or other
  misc_feature (305)..(309): n is a, c, g, or t

SEQ ID NO: 9030 - DNA, 311 bp, Homo sapiens; identical to SEQ ID NO: 8784
  misc_feature: GYAE6OF02FXRIJ.30.30.C08.1.454.CMB.1.raw
  modified_base (306)..(311): a, c, t, g, unknown or other
  misc_feature (306)..(311): n is a, c, g, or t

SEQ ID NO: 9031 - DNA, 307 bp, Homo sapiens; identical to SEQ ID NO: 8732
  misc_feature: GYAE6OF02F8F3B.30.30.C08.1.454.CMB.1.raw
  modified_base (305)..(307): a, c, t, g, unknown or other
  misc_feature (305)..(307): n is a, c, g, or t

SEQ ID NO: 9032 - DNA, 308 bp, Homo sapiens; identical to SEQ ID NO: 8721
  misc_feature: GYAE6OF02GKQKP.30.30.C08.1.454.CMB.1.raw
  modified_base (305)..(308): a, c, t, g, unknown or other
  misc_feature (305)..(308): n is a, c, g, or t

SEQ ID NO: 9033 - DNA, 308 bp, Homo sapiens; identical to SEQ ID NO: 8792
  misc_feature: GYAE6OF02IFSK9.30.30.C08.1.454.CMB.1.raw
  modified_base (304)..(308): a, c, t, g, unknown or other
  misc_feature (304)..(308): n is a, c, g, or t

SEQ ID NO: 9034 - DNA, 329 bp, Homo sapiens
  misc_feature: GYAE6OF02HRTAW.30.30.C08.1.454.CMB.1.raw
  modified_base (318)..(329): a, c, t, g, unknown or other
  misc_feature (318)..(329): n is a, c, g, or t
tcagcacgctacgtcacgaccggtgctcgatttagtctgacgtcaaagggaaaggggacgtggaggtgggtggccgaacataaaccaagatggaagtgaacagtactatgtggactctgtgaagggccgattcaccatctccagagacaacgccaagaactcactgtctcctcagcctccaccgaagggccctactcggtcttccccctggcgcccctgctaccaggacgcacctccgagagcacagcggccctgggctgctggtacaaggctacgttccacgtagcgtgctgagcgggctggcaaggcgctataggnnnnnnnnnnnn

SEQ ID NO: 9035 - DNA, 310 bp, Homo sapiens; identical to SEQ ID NO: 8734
  misc_feature: GYAE6OF02JHW1S.30.30.C08.1.454.CMB.1.raw
  modified_base (305)..(310): a, c, t, g, unknown or other
  misc_feature (305)..(310): n is a, c, g, or t

SEQ ID NO: 9036 - DNA, 306 bp, Homo sapiens
  misc_feature: GYAE6OF02HWWQQ.30.30.C08.1.454.CMB.1.raw
  modified_base (299)..(306): a, c, t, g, unknown or other
  misc_feature (299)..(306): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctcgagagcacagcggcctgggctgcctggtcaaggctacttcacgtagcgtgctgagcggctggcaaggcgcatagnnnnnnnn

SEQ ID NO: 9037 - DNA, 450 bp, Homo sapiens
  misc_feature: GYAE6OF02J2X3T.30.30.C08.1.454.CMB.1.raw
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
  modified_base (388)..(389): a, c, t, g, unknown or other
  misc_feature (388)..(389): n is a, c, g, or t
  modified_base (391)..(450): a, c, t, g, unknown or other
  misc_feature (391)..(450): n is a, c, g, or t
tcagcacgctacgtcacgaccggtgctcgatttagtctgacgtcaaagggaaggggctggagtgggtggccaacataaaccaagatggaagtgaacagtactatgtggactctgtgaagggccattcaccatctccagagacaacgccaagactcactgtctcctcacgccctccaccgacgggccccatccggtccttcccccgnggcccgccctgcctccgagggacnccacctccgagcgccaccgacggcccggtcccgtgggaccttcggccccgttaggtaaccgaacggtacccctttaccgttcccgacggttaggccggttgccggttagggaaccgggccggggtacctcgggactaaacggggcccataagttcggnncnnnnnnnnnnnnnnnnnnnnnnnnnnnnnnnnnnnnnnnnnnnnnnnnnnnnnnnnnnnn

SEQ ID NO: 9038 - DNA, 310 bp, Homo sapiens; identical to SEQ ID NO: 8756
  misc_feature: GYAE6OF02IYDKD.30.30.C08.1.454.CMB.1.raw
  modified_base (304)..(310): a, c, t, g, unknown or other
  misc_feature (304)..(310): n is a, c, g, or t

SEQ ID NO: 9039 - DNA, 338 bp, Homo sapiens
  misc_feature: GYAE6OF02F28KM.30.30.C08.1.454.CMB.1.raw
  modified_base (305)..(338): a, c, t, g, unknown or other
  misc_feature (305)..(338): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcacccatctccagagacaacgccaagaactcactgtctcctcagcctccaccaagggcccatcggtcttccccctggcgccctgctccaggagcacctccgagagcacagcggccctgggctgcctggtcaaggactactccagtagcgtgctgagcgggctggcaaggcgcatagnnnnnnnnnnnnnnnnnnnnnnnnnnnnnnnnnn

SEQ ID NO: 9040 - DNA, 307 bp, Homo sapiens; identical to SEQ ID NO: 8827
  misc_feature: GYAE6OF02H6KTB.30.30.C08.1.454.CMB.1.raw
  modified_base (303)..(307): a, c, t, g, unknown or other
  misc_feature (303)..(307): n is a, c, g, or t

SEQ ID NO: 9041 - DNA, 309 bp, Homo sapiens; identical to SEQ ID NO: 8724
  misc_feature: GYAE6OF02IJCQK.30.30.C08.1.454.CMB.1.raw
  modified_base (305)..(309): a, c, t, g, unknown or other
  misc_feature (305)..(309): n is a, c, g, or t

SEQ ID NO: 9042 - DNA, 345 bp, Homo sapiens
  misc_feature: GYAE6OF02IC0NF.30.30.C08.1.454.CMB.1.raw
  modified_base (311)..(312): a, c, t, g, unknown or other
  misc_feature (311)..(312): n is a, c, g, or t
  modified_base (314)..(345): a, c, t, g, unknown or other
  misc_feature (314)..(345): n is a, c, g, or t
tcagcacgctacgtcacgaccggtgctcgatttagtctgacgtcaaagggaaaggggtctggagtgggtggccaacataaaccaagatggaagtgaacagtactatgtggactctgtgaagggccgattcaccatcctccagagacaacggccaagaactcacttgtctcctcagtcctccaccaagggcccatcggtttctccccctggcgccctgctccaggagcacctcgagagcacgagcggcccctgggctgcctggtcaaggctacttccagtactctatctgagcggctggcaggccgcatagnngnnnnnnnnnnnnnnnnnnnnnnnnnnnnnnnn

SEQ ID NO: 9043 - DNA, 339 bp, Homo sapiens
  misc_feature: GYAE6OF02HQR7E.30.30.C08.1.454.CMB.1.raw
  modified_base (314)..(339): a, c, t, g, unknown or other
  misc_feature (314)..(339): n is a, c, g, or t
tcagcacgctacgtcacgaccggtgctcgatttagtctgacgtcaaagggaaagggggtcgtggagtgggtcggccaacataaaccaagatggaagtgaacagtactatcgtggactctgtgaagggccgattcaccatctccagagacaacgccaagaactcactgtctcctcagccctccaccaagggcccatccggtcttccccctggcgccctgctccaggagcacctccgagagcacagcggccctgggctgcctggtcaaggctacttccacgtagcgtgctgagcgggactggcaaggccgcatagnnnnnnnnnnnnnnnnnnnnnnnnnn

SEQ ID NO: 9044 - DNA, 311 bp, Homo sapiens; identical to SEQ ID NO: 8741
  misc_feature: GYAE6OF02GZBYH.30.30.C08.1.454.CMB.1.raw
  modified_base (305)..(311): a, c, t, g, unknown or other
  misc_feature (305)..(311): n is a, c, g, or t

SEQ ID NO: 9045 - DNA, 304 bp, Homo sapiens
  misc_feature: GYAE6OF02FK5PM.30.30.C08.1.454.CMB.1.raw
  modified_base (301)..(304): a, c, t, g, unknown or other
  misc_feature (301)..(304): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactaccacgtagctgctgagcgggctggcaaggcgcatagnnnn

SEQ ID NO: 9046 - DNA, 401 bp, Homo sapiens
  misc_feature: GYAE6OF02JLNFT.30.30.C08.1.454.CMB.1.raw
  modified_base (281)..(281): a, c, t, g, unknown or other
  misc_feature (281)..(281): n is a, c, g, or t
  modified_base (325)..(325): a, c, t, g, unknown or other
  misc_feature (325)..(325): n is a, c, g, or t
  modified_base (329)..(333): a, c, t, g, unknown or other
  misc_feature (329)..(333): n is a, c, g, or t
  modified_base (335)..(401): a, c, t, g, unknown or other
  misc_feature (335)..(401): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgccctgggtcaagctatccacgtagcgtgccngtacgggacgtcgggctggggacctaaggggcctaacgagtagnacgnnnnngnnnnnnnnnnnnnnnnnnnnnnnnnnnnnnnnnnnnnnnnnnnnnnnnnnnnnnnnnnnnnnnnnnn

SEQ ID NO: 9047 - DNA, 312 bp, Homo sapiens
  misc_feature: GYAE6OF02JIZLT.30.30.C08.1.454.CMB.1.raw
  modified_base (218)..(218): a, c, t, g, unknown or other
  misc_feature (218)..(218): n is a, c, g, or t
  modified_base (305)..(312): a, c, t, g, unknown or other
  misc_feature (305)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggngcacctccgagagcacagccggccctgggctgcctggtcaaggctacttccacgtagcgtgctgagcgggctggcaaggcgcatagnnnnnnnn

SEQ ID NO: 9048 - DNA, 311 bp, Homo sapiens; identical to SEQ ID NO: 8741
  misc_feature: GYAE6OF02JFNQ9.30.30.C08.1.454.CMB.1.raw
  modified_base (305)..(311): a, c, t, g, unknown or other
  misc_feature (305)..(311): n is a, c, g, or t

SEQ ID NO: 9049 - DNA, 319 bp, Homo sapiens
  misc_feature: GYAE6OF02JBRIO.30.30.C08.1.454.CMB.1.raw
  modified_base (307)..(319): a, c, t, g, unknown or other
  misc_feature (307)..(319): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgctccaggagcacctccgagagcacagcggcctgggctgcctggtcaaggctacttccacgtagcgtgctgagcgggctggccaaggcgacatagnnnnnnnnnnnnn

SEQ ID NO: 9050 - DNA, 309 bp, Homo sapiens; identical to SEQ ID NO: 8804
  misc_feature: GYAE6OF02FROLX.30.30.C08.1.454.CMB.1.raw
  modified_base (306)..(309): a, c, t, g, unknown or other
  misc_feature (306)..(309): n is a, c, g, or t

SEQ ID NO: 9051 - DNA, 373 bp, Homo sapiens
  misc_feature: GYAE6OF02HXQN3.30.30.C08.1.454.CMB.1.raw
  modified_base (314)..(319): a, c, t, g, unknown or other
  misc_feature (314)..(319): n is a, c, g, or t
  modified_base (321)..(321): a, c, t, g, unknown or other
  misc_feature (321)..(321): n is a, c, g, or t
  modified_base (323)..(324): a, c, t, g, unknown or other
  misc_feature (323)..(324): n is a, c, g, or t
  modified_base (326)..(373): a, c, t, g, unknown or other
  misc_feature (326)..(373): n is a, c, g, or t
tcagcacgctacgtcacgaccggtgctcgatttagtctgacgtcaaagggaaagggggacgtggagtgggtcggccaacataaaccaagatggaagtggaacagtactagtcgtggactctgtgaaggggccgattcaccatctccagagaccaacggccaagaactcactgtctcctcagcctcaccaaggccatcgtcttcccctgcgccctgctccaggagcacctccgagagcacagcggccctggggctgcctggtcaaggctacttccacgtagccgtgctgagcgggactgggcaacggcgcatagnnnnnntngnncnnnnnnnnnnnnnnnnnnnnnnnnnnnnnnnnnnnnnnnnnnnnnnnn

SEQ ID NO: 9052 - DNA, 310 bp, Homo sapiens
  misc_feature: GYAE6OF02G0JRX.30.30.C08.1.454.CMB.1.raw
  modified_base (306)..(310): a, c, t, g, unknown or other
  misc_feature (306)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcagtagnnnnn

SEQ ID NO: 9053 - DNA, 310 bp, Homo sapiens; identical to SEQ ID NO: 8734
  misc_feature: GYAE6OF02HWUHV.30.30.C08.1.454.CMB.1.raw
  modified_base (305)..(310): a, c, t, g, unknown or other
  misc_feature (305)..(310): n is a, c, g, or t

SEQ ID NO: 9054 - DNA, 310 bp, Homo sapiens; identical to SEQ ID NO: 8734
  misc_feature: GYAE6OF02HFWSL.30.30.C08.1.454.CMB.1.raw
  modified_base (305)..(310): a, c, t, g, unknown or other
  misc_feature (305)..(310): n is a, c, g, or t

SEQ ID NO: 9055 - DNA, 309 bp, Homo sapiens
  misc_feature: GYAE6OF02FHD97.30.30.C08.1.454.CMB.1.raw
  modified_base (306)..(309): a, c, t, g, unknown or other
  misc_feature (306)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccaagtagcgtgctgagcgggctggcaaggcgcatagnnnn

SEQ ID NO: 9056 - DNA, 309 bp, Homo sapiens
  misc_feature: GYAE6OF02J1ZKT.30.30.C08.1.454.CMB.1.raw
  modified_base (303)..(309): a, c, t, g, unknown or other
  misc_feature (303)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaggcgcatagnnnnnnn

SEQ ID NO: 9057 - DNA, 310 bp, Homo sapiens; identical to SEQ ID NO: 8756
  misc_feature: GYAE6OF02HH7Z4.30.30.C08.1.454.CMB.1.raw
  modified_base (304)..(310): a, c, t, g, unknown or other
  misc_feature (304)..(310): n is a, c, g, or t

SEQ ID NO: 9058 - DNA, 311 bp, Homo sapiens
  misc_feature: GYAE6OF02HZ7K6.30.30.C08.1.454.CMB.1.raw
  modified_base (306)..(311): a, c, t, g, unknown or other
  misc_feature (306)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctgggcaaggcgcatagnnnnnn

SEQ ID NO: 9059 - DNA, 311 bp, Homo sapiens; identical to SEQ ID NO: 8741
  misc_feature: GYAE6OF02GQ27D.30.30.C08.1.454.CMB.1.raw
  modified_base (305)..(311): a, c, t, g, unknown or other
  misc_feature (305)..(311): n is a, c, g, or t

SEQ ID NO: 9060 - DNA, 312 bp, Homo sapiens
  misc_feature: GYAE6OF02G6LF9.30.30.C08.1.454.CMB.1.raw
  modified_base (306)..(312): a, c, t, g, unknown or other
  misc_feature (306)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggactacttccacgtagcgtgctgagcgggctggcaaggcgcatagnnnnnnn

SEQ ID NO: 9061 - DNA, 305 bp, Homo sapiens
  misc_feature: GYAE6OF02HRETV.30.30.C08.1.454.CMB.1.raw
  modified_base (304)..(305): a, c, t, g, unknown or other
  misc_feature (304)..(305): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgcctccaggagcacctccgagagcacagcggccctgggctgcctggtcaaggctacttccacgtagcgtgctgagcgggctggcaaggcgcatagnn

SEQ ID NO: 9062 - DNA, 310 bp, Homo sapiens; identical to SEQ ID NO: 8756
  misc_feature: GYAE6OF02JB1HE.30.30.C08.1.454.CMB.1.raw
  modified_base (304)..(310): a, c, t, g, unknown or other
  misc_feature (304)..(310): n is a, c, g, or t

SEQ ID NO: 9063 - DNA, 315 bp, Homo sapiens
  misc_feature: GYAE6OF02JZI97.30.30.C08.1.454.CMB.1.raw
  modified_base (308)..(315): a, c, t, g, unknown or other
  misc_feature (308)..(315): n is a, c, g, or t
tcagcacgctacgtcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggacgcacctccgagacgcacagccggccctgggctgcctggtcaaggactacttccacgtagcgtgctgagcggctggcaaggcgcatagnnnnnnnn

SEQ ID NO: 9064 - DNA, 309 bp, Homo sapiens; identical to SEQ ID NO: 8724
  misc_feature: GYAE6OF02IN8SK.30.30.C08.1.454.CMB.1.raw
  modified_base (305)..(309): a, c, t, g, unknown or other
  misc_feature (305)..(309): n is a, c, g, or t

SEQ ID NO: 9065 - DNA, 400 bp, Homo sapiens
  misc_feature: GYAE6OF02IGUCC.30.30.C08.1.454.CMB.1.raw
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (330)..(334): a, c, t, g, unknown or other
  misc_feature (330)..(334): n is a, c, g, or t
  modified_base (336)..(336): a, c, t, g, unknown or other
  misc_feature (336)..(336): n is a, c, g, or t
  modified_base (338)..(400): a, c, t, g, unknown or other
  misc_feature (338)..(400): n is a, c, g, or t
tcagcacgctacgtcacgaccggtgctcgattttagtctgacgtcaaagggaaagggggacgtggagtgggtggccaacataaaccaagatggaagtgaacagtacgtactgtggactctgtgaagggccgattcaccatctccagaggacaacgccaagaactcactgtctcctcagccctccaccaagggcccatcggtcttcccctggcgccctgctcaagagcacctctgggggcacagcggccctgggctgcctggtcaaggactacttccagtagacgtgctgagcgggactgggactaaacggccgacacgtaggntngatcnnnnngngnnnnnnnnnnnnnnnnnnnnnnnnnnnnnnnnnnnnnnnnnnnnnnnnnnnnnnnnnnnnnnn

SEQ ID NO: 9066 - DNA, 593 bp, Homo sapiens
  misc_feature: GYAE6OF02FGS1Z.30.30.C08.1.454.CMB.1.raw
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (440)..(441): a, c, t, g, unknown or other
  misc_feature (440)..(441): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagcacgctacgtcacgaccggtgctcgatttagtctgacgtcaaagggtaaggggtcgtggaggtgggtgggccaacactaaaccaacgtagtggtaacgtgaaccagtactactgtgggactctggtgaagggccgattcaaccatcctccacgagacgaacgtccgaagaactcacctggttccttccttcagtcctttaccgaccaacgggcccatccggtcgttccccctggcgcccctggcgtccgacggggaggcctaccgtcccggaggaccggggccacgaacgtccggccctgggcttggccctgggtccaacggtcctactttccacgttagtcgtgcgtcggacggccgggacttcgggaccaacggggtccgaccagttacgngcgagctgcgtgctgctatanacctaacngacacgcgcatatnncgtcgcgtcgcgcgacgcgcgtcncncncncaganagncnagacgacgacgcatcngacanagacacgacgacgaacgacgacgcgcgtagtactacgcgcgacgacacgtacgtacgtcgttacgttacgttacgtttacgtacgtcgtcg

SEQ ID NO: 9067 - DNA, 308 bp, Homo sapiens; identical to SEQ ID NO: 8792
  misc_feature: GYAE6OF02HWQGV.30.30.C08.1.454.CMB.1.raw
  modified_base (304)..(308): a, c, t, g, unknown or other
  misc_feature (304)..(308): n is a, c, g, or t

SEQ ID NO: 9068 - DNA, 308 bp, Homo sapiens; identical to SEQ ID NO: 8805
  misc_feature: GYAE6OF02FWM2X.30.30.C08.1.454.CMB.1.raw
  modified_base (306)..(308): a, c, t, g, unknown or other
  misc_feature (306)..(308): n is a, c, g, or t

SEQ ID NO: 9069 - DNA, 308 bp, Homo sapiens; identical to SEQ ID NO: 8792
  misc_feature: GYAE6OF02GDTRK.30.30.C08.1.454.CMB.1.raw
  modified_base (304)..(308): a, c, t, g, unknown or other
  misc_feature (304)..(308): n is a, c, g, or t

SEQ ID NO: 9070 - DNA, 318 bp, Homo sapiens
  misc_feature: GYAE6OF02HKZ6A.30.30.C08.1.454.CMB.1.raw
  modified_base (304)..(318): a, c, t, g, unknown or other
  misc_feature (304)..(318): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagacgcacagcggccctgggctgcctggtcaaggctacttcacgtagcgtgctgagcgggctggcaaggcgcatagnnnnnnnnnnnnnnn

SEQ ID NO: 9071 - DNA, 307 bp, Homo sapiens
  misc_feature: GYAE6OF02I5THM.30.30.C08.1.454.CMB.1.raw
  modified_base (305)..(307): a, c, t, g, unknown or other
  misc_feature (305)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttccccctggcgccctgctccaggagcacctccgagagcacagcggccctgggctgcctggtcaaggactacttccacgtagcgtgctgagcgggctggcaaggcgcatagnnn

SEQ ID NO: 9072 - DNA, 308 bp, Homo sapiens; identical to SEQ ID NO: 8721
  misc_feature: GYAE6OF02GAEBG.30.30.C08.1.454.CMB.1.raw
  modified_base (305)..(308): a, c, t, g, unknown or other
  misc_feature (305)..(308): n is a, c, g, or t

SEQ ID NO: 9073 - DNA, 580 bp, Homo sapiens
  misc_feature: GYAE6OF02GEQ62.30.30.C08.1.454.CMB.1.raw
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
tcagcacgctacgtcacgaccggtgctcgattttagtctgacgtcaaagggtaaagggggtcggtaggaggtagggtggccaacgactaaaccaagatgggaaggtgaacaggtactagtggtggactctgtgaaagggccgtattcaccataccttccgagtagaccaacgtccaagaacgtcactgtctcgtgagccggtccacctaaggtcccagtcggtcggttcccctggcgccctgctcgaggcgcacctcgagancacngcggcctggctgctggtcaggctctccagtcgcgngcgngaggcgggtcgtgacgaaggtcgtactagtacgngngngangacagtnacgcgtctgagacggtcatcacnctncaganaccaagcaaacgtnaccgtntcatcgagatagacgagacgtcgagacgacgacgacgacgacgcgtgtcgtagtacgtacgagagagtagtacgtacgacgacgacgtacgtacgtacgtacgtacgtacggtacggtacggacggtaccggtaccggtaccgtccgtaccgtaccgtaccgtaccgtaccgaccg

SEQ ID NO: 9074 - DNA, 307 bp, Homo sapiens
  misc_feature: GYAE6OF02I054J.30.30.C08.1.454.CMB.1.raw
  modified_base (304)..(307): a, c, t, g, unknown or other
  misc_feature (304)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 9075 - DNA, 308 bp, Homo sapiens; identical to SEQ ID NO: 8792
  misc_feature: GYAE6OF02HZAEJ.30.30.C08.1.454.CMB.1.raw
  modified_base (304)..(308): a, c, t, g, unknown or other
  misc_feature (304)..(308): n is a, c, g, or t

SEQ ID NO: 9076 - DNA, 325 bp, Homo sapiens
  misc_feature: GYAE6OF02HFHTZ.30.30.C08.1.454.CMB.1.raw
  modified_base (317)..(325): a, c, t, g, unknown or other
  misc_feature (317)..(325): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagacgccacacggccggccccgtgggctcgcccgtggtcaaggaccttacttccacgtagcgtgctgagcgggctggcaaggcgcatagnnnnnnnnn

SEQ ID NO: 9077 - DNA, 307 bp, Homo sapiens
  misc_feature: GYAE6OF02F1TIV.30.30.C08.1.454.CMB.1.raw
  modified_base (304)..(307): a, c, t, g, unknown or other
  misc_feature (304)..(307): n is a, c, g, or t
tcagcacgctacgtcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 9078 - DNA, 308 bp, Homo sapiens
  misc_feature: GYAE6OF02IM3CK.30.30.C08.1.454.CMB.1.raw
  modified_base (289)..(289): a, c, t, g, unknown or other
  misc_feature (289)..(289): n is a, c, g, or t
  modified_base (305)..(308): a, c, t, g, unknown or other
  misc_feature (305)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggntggcaaggcgcatagnnnn

SEQ ID NO: 9079 - DNA, 385 bp, Homo sapiens
  misc_feature: GYAE6OF02GHP52.30.30.C08.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
  modified_base (314)..(317): a, c, t, g, unknown or other
  misc_feature (314)..(317): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (334)..(385): a, c, t, g, unknown or other
  misc_feature (334)..(385): n is a, c, g, or t
tcagcacgctacgtcacgaccggtgctcgatttagtctgacgtcaaaggggaaagggggctggagtgggtggccaacataaaccaagatggaagtgaacagtactatgtggactctgtgaagggccgattcaccatctccagagacaacgccaagaactcactgtctcctcagcctccacaagggcccatcggtcttccccnggcgccctgctccaggagcacctccgagngcacagccgggccctgggctgcctggtacaaggctacttccagtacgaccgtgactgagcgggctggcaagggcncagtagcnnnngacncgncancncgtannnnnnnnnnnnnnnnnnnnnnnnnnnnnnnnnnnnnnnnnnnnnnnnnnnn

SEQ ID NO: 9080 - DNA, 315 bp, Homo sapiens
  misc_feature: GYAE6OF02HLH4N.30.30.C08.1.454.CMB.1.raw
  modified_base (304)..(315): a, c, t, g, unknown or other
  misc_feature (304)..(315): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcacgtagcgtgctgagcgggctggcaaggcgcatagnnnnnnnnnnnn

SEQ ID NO: 9081 - DNA, 318 bp, Homo sapiens
  misc_feature: GYAE6OF02HIUN2.30.30.C08.1.454.CMB.1.raw
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (308)..(318): a, c, t, g, unknown or other
  misc_feature (308)..(318): n is a, c, g, or t
tcagcacgctacgtcacgaccggtgctcgatttagtctgacgtcaagggaaagggacgtggagtgggtggccgaacataaaccaagatggaagtgaacagtactatgtggactctgtgaaggccgattcaccatctccagagacaacgccaagaactcaactgtctcctcagcctccaccaaggcccatcggtccttcccctggcgccctgctaccaggagctacctccgagagcacagcggtccngggctgcctaggtcaaggactacttccgacgagcgtgctgagcggtngcaaggcgntacagnnnnnnnnnnn

SEQ ID NO: 9082 - DNA, 311 bp, Homo sapiens; identical to SEQ ID NO: 8741
  misc_feature: GYAE6OF02F2HHH.30.30.C08.1.454.CMB.1.raw
  modified_base (305)..(311): a, c, t, g, unknown or other
  misc_feature (305)..(311): n is a, c, g, or t

SEQ ID NO: 9083 - DNA, 308 bp, Homo sapiens; identical to SEQ ID NO: 8792
  misc_feature: GYAE6OF02HWASO.30.30.C08.1.454.CMB.1.raw
  modified_base (304)..(308): a, c, t, g, unknown or other
  misc_feature (304)..(308): n is a, c, g, or t

SEQ ID NO: 9084 - DNA, 322 bp, Homo sapiens
  misc_feature: GYAE6OF02I29KC.30.30.C08.1.454.CMB.1.raw
  modified_base (233)..(233): a, c, t, g, unknown or other
  misc_feature (233)..(233): n is a, c, g, or t
  modified_base (310)..(322): a, c, t, g, unknown or other
  misc_feature (310)..(322): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcgactgtctcctcagcctccaccaagggcccatcggtcttccccctggcgccctgcctccaggagcacctccgagngcacagcggcctgggctgcctggtcaaggctacttccacgtagcgtgctgacgcgggctgggcaaggcgcgataggnnnnnnnnnnnnn

SEQ ID NO: 9085 - DNA, 310 bp, Homo sapiens
  misc_feature: GYAE6OF02H4GY0.30.30.C08.1.454.CMB.1.raw
  modified_base (304)..(310): a, c, t, g, unknown or other
  misc_feature (304)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttcacgtagcgtgctgagcgggctggcaaggcgacatagnnnnnnn

SEQ ID NO: 9086 - DNA, 309 bp, Homo sapiens; identical to SEQ ID NO: 8724
  misc_feature: GYAE6OF02HE1IC.30.30.C08.1.454.CMB.1.raw
  modified_base (305)..(309): a, c, t, g, unknown or other
  misc_feature (305)..(309): n is a, c, g, or t

SEQ ID NO: 9087 - DNA, 307 bp, Homo sapiens
  misc_feature: GYAE6OF02HAKCX.30.30.C08.1.454.CMB.1.raw
  modified_base (305)..(307): a, c, t, g, unknown or other
  misc_feature (305)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcatagnnn

SEQ ID NO: 9088 - DNA, 307 bp, Homo sapiens
  misc_feature: GYAE6OF02H4FJV.30.30.C08.1.454.CMB.1.raw
  modified_base (304)..(307): a, c, t, g, unknown or other
  misc_feature (304)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 9089 - DNA, 218 bp, Homo sapiens
  misc_feature: GYAE6OF02H0NGU.30.30.C08.1.454.CMB.1.raw
  modified_base (218)..(218): a, c, t, g, unknown or other
  misc_feature (218)..(218): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggccatcggtcttcccctggcgccctgctccaggan

SEQ ID NO: 9090 - DNA, 314 bp, Homo sapiens
  misc_feature: GYAE6OF02G14RT.30.30.C08.1.454.CMB.1.raw
  modified_base (307)..(314): a, c, t, g, unknown or other
  misc_feature (307)..(314): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagacgcacagcggccctgggctgcctggtcaaggactacttccacgtagcgtgctgagcgggctggcaagggcgcatagnnnnnnnn

SEQ ID NO: 9091 - DNA, 309 bp, Homo sapiens
  misc_feature: GYAE6OF02FROHJ.30.30.C08.1.454.CMB.1.raw
  modified_base (304)..(309): a, c, t, g, unknown or other
  misc_feature (304)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnnnnn

SEQ ID NO: 9092 - DNA, 306 bp, Homo sapiens
  misc_feature: GYAE6OF02H2LF1.30.30.C08.1.454.CMB.1.raw
  modified_base (302)..(306): a, c, t, g, unknown or other
  misc_feature (302)..(306): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcggctggcaaggcgcatagnnnnn

SEQ ID NO: 9093 - DNA, 316 bp, Homo sapiens
  misc_feature: GYAE6OF02H7IJG.30.30.C08.1.454.CMB.1.raw
  modified_base (308)..(316): a, c, t, g, unknown or other
  misc_feature (308)..(316): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggactacttccacgtagcgttgctgagcgggctggcaaggcgcagtagnnnnnnnnn

SEQ ID NO: 9094 - DNA, 308 bp, Homo sapiens
  misc_feature: GYAE6OF02F86IV.30.30.C08.1.454.CMB.1.raw
  modified_base (304)..(308): a, c, t, g, unknown or other
  misc_feature (304)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccagtagcgtgctgagcgggctggcaaggcgcatagnnnnn

SEQ ID NO: 9095 - DNA, 307 bp, Homo sapiens
  misc_feature: GYAE6OF02G9ZZO.30.30.C08.1.454.CMB.1.raw
  modified_base (301)..(301): a, c, t, g, unknown or other
  misc_feature (301)..(301): n is a, c, g, or t
  modified_base (306)..(307): a, c, t, g, unknown or other
  misc_feature (306)..(307): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggcgccctgctccaggagcacctccgagagcacagcggccctgggctgcctggtcaaggactacttccacgtagcgtgctgagcgggctggcaaggcgnatagnn

SEQ ID NO: 9096 - DNA, 325 bp, Homo sapiens
  misc_feature: GYAE6OF02H45TQ.30.30.C08.1.454.CMB.1.raw
  modified_base (310)..(325): a, c, t, g, unknown or other
  misc_feature (310)..(325): n is a, c, g, or t
tcagcacgctacgtcacgaccggtgctcgatttagtctgacgtcaaagggaaagggggctggagtgggtggccaacataaaccaagatggaagtgaacagtactatgtggactctgtgaagggccgattcaccatctccagagacaacgccaaagaactcactgtctcctcagcctccaccagggcccatcggtctcccctggcgccctgctccaggagcaccgtccgagagcacaggcggccctgggctcgcctggtcaaggctaccttccagtagcgtgcctgagcggctggacaagggcgcataggnnnnnnnnnnnnnnnn

SEQ ID NO: 9097 - DNA, 309 bp, Homo sapiens
  misc_feature: GYAE6OF02HBXN4.30.30.C08.1.454.CMB.1.raw
  modified_base (305)..(309): a, c, t, g, unknown or other
  misc_feature (305)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggcgccctgctccaggagcacctccgagagcacagcggccctgggctgcctggtcaaggctacttccacgtagcgtgctgagcgggctggcaaggcgcatagnnnnn

SEQ ID NO: 9098 - DNA, 307 bp, Homo sapiens
  misc_feature: GYAE6OF02IE6JW.30.30.C08.1.454.CMB.1.raw
  modified_base (303)..(307): a, c, t, g, unknown or other
  misc_feature (303)..(307): n is a, c, g, or t
tcagcacgctacgtcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcggctggcaaggcgcatagnnnnn

SEQ ID NO: 9099 - DNA, 345 bp, Homo sapiens
  misc_feature: GYAE6OF02I6TG3.30.30.C08.1.454.CMB.1.raw
  modified_base (330)..(330): a, c, t, g, unknown or other
  misc_feature (330)..(330): n is a, c, g, or t
  modified_base (332)..(345): a, c, t, g, unknown or other
  misc_feature (332)..(345): n is a, c, g, or t
tcagcacgctacgtcacgaccggtgctcgatttagtctgacgtcaagggaaaggggacgtggaggtgggtggccgaacataaaccaagataggaagtgaacagtactatgtggactctgtgaagggccgattcaccatctccagagacaacgccaagaactcactgtctcctcagcctccaccaagggcccatcggtcttcccctggccgccctgcctcaaggacgctacctccgagacgcaacagccggtccctgggctgccctagggtcaagggaccttacgtccaacgtgcgtgcctagagccgggctgcgaaggtcgcattagctncnnnnnnnnnnnnnn

SEQ ID NO: 9100 - DNA, 310 bp, Homo sapiens
  misc_feature: GYAE6OF02IMOE3.30.30.C08.1.454.CMB.1.raw
  modified_base (288)..(288): a, c, t, g, unknown or other
  misc_feature (288)..(288): n is a, c, g, or t
  modified_base (304)..(310): a, c, t, g, unknown or other
  misc_feature (304)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggntggcaaggcgcatagnnnnnnn

SEQ ID NO: 9101 - DNA, 310 bp, Homo sapiens; identical to SEQ ID NO: 8734
  misc_feature: GYAE6OF02ITYF9.30.30.C08.1.454.CMB.1.raw
  modified_base (305)..(310): a, c, t, g, unknown or other
  misc_feature (305)..(310): n is a, c, g, or t

SEQ ID NO: 9102 - DNA, 327 bp, Homo sapiens
  misc_feature: GYAE6OF02JOWPG.30.30.C08.1.454.CMB.1.raw
  modified_base (315)..(327): a, c, t, g, unknown or other
  misc_feature (315)..(327): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagacgcacagcggccctggggcctgccctgggtccaaggacctacttcccacgtacgcgtgctgaggcggctgggcaaggcgcatagnnnnnnnnnnnnn

SEQ ID NO: 9103 - DNA, 311 bp, Homo sapiens
  misc_feature: GYAE6OF02IHEQW.30.30.C08.1.454.CMB.1.raw
  modified_base (305)..(311): a, c, t, g, unknown or other
  misc_feature (305)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctgggcaaggcgcatagnnnnnnn

SEQ ID NO: 9104 - DNA, 309 bp, Homo sapiens
  misc_feature: GYAE6OF02GY02G.30.30.C08.1.454.CMB.1.raw
  modified_base (299)..(299): a, c, t, g, unknown or other
  misc_feature (299)..(299): n is a, c, g, or t
  modified_base (305)..(309): a, c, t, g, unknown or other
  misc_feature (305)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcncatagnnnnn

SEQ ID NO: 9105 - DNA, 308 bp, Homo sapiens
  misc_feature: GYAE6OF02IIKSA.30.30.C08.1.454.CMB.1.raw
  modified_base (304)..(308): a, c, t, g, unknown or other
  misc_feature (304)..(308): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 9106 - DNA, 310 bp, Homo sapiens
  misc_feature: GYAE6OF02HD7OT.30.30.C08.1.454.CMB.1.raw
  modified_base (277)..(277): a, c, t, g, unknown or other
  misc_feature (277)..(277): n is a, c, g, or t
  modified_base (303)..(310): a, c, t, g, unknown or other
  misc_feature (303)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggactacttcacgtagcgtnctgagcgggctggcaaggcgcatagnnnnnnnn

SEQ ID NO: 9107 - DNA, 310 bp, Homo sapiens; identical to SEQ ID NO: 8734
  misc_feature: GYAE6OF02FK0QC.30.30.C08.1.454.CMB.1.raw
  modified_base (305)..(310): a, c, t, g, unknown or other
  misc_feature (305)..(310): n is a, c, g, or t

SEQ ID NO: 9108 - DNA, 309 bp, Homo sapiens; identical to SEQ ID NO: 8782
  misc_feature: GYAE6OF02GU0M8.30.30.C08.1.454.CMB.1.raw
  modified_base (304)..(309): a, c, t, g, unknown or other
  misc_feature (304)..(309): n is a, c, g, or t

SEQ ID NO: 9109 - DNA, 310 bp, Homo sapiens
  misc_feature: GYAE6OF02HZFRF.30.30.C08.1.454.CMB.1.raw
  modified_base (304)..(310): a, c, t, g, unknown or other
  misc_feature (304)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnn

SEQ ID NO: 9110 - DNA, 317 bp, Homo sapiens
  misc_feature: GYAE6OF02JQKVN.30.30.C08.1.454.CMB.1.raw
  modified_base (291)..(291): a, c, t, g, unknown or other
  misc_feature (291)..(291): n is a, c, g, or t
  modified_base (308)..(317): a, c, t, g, unknown or other
  misc_feature (308)..(317): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggacgccacctccgagacgcacaggccggccctgggctgccgtggtcaaggctcttccagtagcgtgctgagcgggntggcaaggcgcataggnnnnnnnnnn

SEQ ID NO: 9111 - DNA, 339 bp, Homo sapiens
  misc_feature: GYAE6OF02FZRJB.30.30.C08.1.454.CMB.1.raw
  modified_base (235)..(235): a, c, t, g, unknown or other
  misc_feature (235)..(235): n is a, c, g, or t
  modified_base (312)..(322): a, c, t, g, unknown or other
  misc_feature (312)..(322): n is a, c, g, or t
  modified_base (324)..(324): a, c, t, g, unknown or other
  misc_feature (324)..(324): n is a, c, g, or t
  modified_base (326)..(339): a, c, t, g, unknown or other
  misc_feature (326)..(339): n is a, c, g, or t
tcagcacgctacgtcacgaccggtgctcgatttagtctgacgtcaaagggaaaggggggctggagtggggtggccaacataaaccaagatggaagtgaacagtactatgtgggactctgtgaagggccgattcaccatctccagaggacaacgccaagaactcactgtctcctcagcctccaccagggcccatcggtcttccccgtggcgccctgctccaggagcacctccgagngccacagccggcctgggctgccgtgggtcaaggacttacttccagtagcgtgctgagcgggctggcaaggcgcatgnnnnnnnnnnnantnnnnnnnnnnnnnn

SEQ ID NO: 9112 - DNA, 313 bp, Homo sapiens
  misc_feature: GYAE6OF02H44ZI.30.30.C08.1.454.CMB.1.raw
  modified_base (307)..(313): a, c, t, g, unknown or other
  misc_feature (307)..(313): n is a, c, g, or t
tcagcacgctacgtcacgaccggtgctcgatttagtctgacgtcaaagggaaaggggccggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctcctccaagagcacctcgtgggggcacagccggccctgggctgcctggtcaaggactacttccagtagcgtgctgagcgggctggcaaggcgcatagnnnnnnn

SEQ ID NO: 9113 - DNA, 310 bp, Homo sapiens
  misc_feature: GYAE6OF02I2U2Z.30.30.C08.1.454.CMB.1.raw
  modified_base (272)..(272): a, c, t, g, unknown or other
  misc_feature (272)..(272): n is a, c, g, or t
  modified_base (302)..(303): a, c, t, g, unknown or other
  misc_feature (302)..(303): n is a, c, g, or t
  modified_base (305)..(310): a, c, t, g, unknown or other
  misc_feature (305)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctcgagagcacagcggccctgggctgcctggtcaaggctacttccacgtancgtgctgagcgggctggcaaggcgcatagnngnnnnnn

SEQ ID NO: 9114 - DNA, 323 bp, Homo sapiens
  misc_feature: GYAE6OF02ILDK2.30.30.C08.1.454.CMB.1.raw
  modified_base (169)..(169): a, c, t, g, unknown or other
  misc_feature (169)..(169): n is a, c, g, or t
  modified_base (289)..(289): a, c, t, g, unknown or other
  misc_feature (289)..(289): n is a, c, g, or t
  modified_base (304)..(323): a, c, t, g, unknown or other
  misc_feature (304)..(323): n is a, c, g, or t
tcagcacgctacgtcacgaccggtgctcgatttagtctgacgtcaaagggaaaggggctggagtgggtggccaacataaaaccaagatggaagtgaacagtactatgtggactctgtgaaggccgattcaccatctccagagacaacgccaagaactcactgtctcctnagcctccaccaagggcccatcggtcttcccctggcgccctgcctccaggagcacctcgagagcacagccggccctgggctgcctggtcaaggactactccacgtagcgtgctgagcgggntggcaagcgcatagnnnnnnnnnnnnnnnnnnnn

SEQ ID NO: 9115 - DNA, 511 bp, Homo sapiens
  misc_feature: GYAE6OF02FU0H7.30.30.C08.1.454.CMB.1.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (321)..(322): a, c, t, g, unknown or other
  misc_feature (321)..(322): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (409)..(410): a, c, t, g, unknown or other
  misc_feature (409)..(410): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
tcagcacgctacgtcacgaccggtgctcgattttagtctgacgtcaaagggaaagggggcgtggagtgggtggccaacataaaccaagatggaagtgaacagtactatgtggactctgtgaaggccgattcaccatctccagagtacacgccaagaactcactgtctcctcagcctccacagggccatcggtcttcccctggcgccctgctccaggagcacctccggagngcacagcgcctgggcngcctggcaggacctacttccagtactcgtgcctgacgcgggctggacaaggccncacgttaggctncggcagcgnngtagcagngttnacgcgtcggcagcctgaactcncgtatcggctgaactcctgactgcgcttcaactgcttanccgatnatcnctanncgtnagnacgcngatcgtatcgtacncgtacgcgtacgngtacgcgtacgtcgtacgtcgtcgtacgtacgtacgtccgtaccgtacgtacgtcgtcgtcg

SEQ ID NO: 9116 - DNA, 315 bp, Homo sapiens
  misc_feature: GYAE6OF02FTUYK.30.30.C08.1.454.CMB.1.raw
  modified_base (305)..(315): a, c, t, g, unknown or other
  misc_feature (305)..(315): n is a, c, g, or t
tcagcacgctacgtcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnnnnnn

SEQ ID NO: 9117 - DNA, 316 bp, Homo sapiens
  misc_feature: GYAE6OF02FZ7F8.30.30.C08.1.454.CMB.1.raw
  modified_base (307)..(316): a, c, t, g, unknown or other
  misc_feature (307)..(316): n is a, c, g, or t
tcagcacgctacgtcacgaccggtgctcgatttagtctgacgtcaaagggaaaggggctggagtgggtggccaacataaaccaagatggaagtgaacagtactaggtgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcagtagnnnnnnnnnn

SEQ ID NO: 9118 - DNA, 313 bp, Homo sapiens
  misc_feature: GYAE6OF02JDSF7.30.30.C08.1.454.CMB.1.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (306)..(313): a, c, t, g, unknown or other
  misc_feature (306)..(313): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcnccctgctccaggagcacctccgagngcacagccggccctgggctgcctggtcaaggctacttccacgtagcgtgctggagcgggctggcaaggcgcatagnnnnnnnn

SEQ ID NO: 9119 - DNA, 588 bp, Homo sapiens
  misc_feature: GYAE6OF02IR2V0.30.30.C08.1.454.CMB.1.raw
  modified_base (202)..(202): a, c, t, g, unknown or other
  misc_feature (202)..(202): n is a, c, g, or t
  modified_base (392)..(392): a, c, t, g, unknown or other
  misc_feature (392)..(392): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcatgtctcctcagcctaccaccaaggcccatcggtcttcccccgnggccgcctgctaccgaggtacgcctacctcgagagaccacgacggccgggtcccgtgggccgtagccgttaggtaacgaaacggtaccttaaccgtttaccgtaacggtaacggtccggtacggtacggtaggacggtaccgggtaccgtacgggtacgaaaccggggaccggactaaggtttaacgganacgagacgacgtagacgacgagagacgagacanagagacatanacagacgtanaganagacgtagacagacgtacgnagacgacganagagagagacgagtacgtacgacgtacactacacgacagagagagacgaganaaganaganacganagacgacgatacgagagacgagacacgtagtacacacagtacg

SEQ ID NO: 9120 - DNA, 314 bp, Homo sapiens
  misc_feature: GYAE6OF02F4NN1.30.30.C08.1.454.CMB.1.raw
  modified_base (305)..(314): a, c, t, g, unknown or other
  misc_feature (305)..(314): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggcctgggctgcctggtcaaggactacttccagtagcgtgctgagcgggctgggcaaggcgcatagnnnnnnnnnn

SEQ ID NO: 9121 - DNA, 313 bp, Homo sapiens; identical to SEQ ID NO: 8791
  misc_feature: GYAE6OF02GMM7I.30.30.C08.1.454.CMB.1.raw
  modified_base (305)..(313): a, c, t, g, unknown or other
  misc_feature (305)..(313): n is a, c, g, or t

SEQ ID NO: 9122 - DNA, 310 bp, Homo sapiens
  misc_feature: GYAE6OF02HAIWJ.30.30.C08.1.454.CMB.1.raw
  modified_base (289)..(289): a, c, t, g, unknown or other
  misc_feature (289)..(289): n is a, c, g, or t
  modified_base (305)..(310): a, c, t, g, unknown or other
  misc_feature (305)..(310): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggntggcaaggcgcatagnnnnnn

SEQ ID NO: 9123 - DNA, 329 bp, Homo sapiens
  misc_feature: GYAE6OF02HLAZY.30.30.C08.1.454.CMB.1.raw
  modified_base (312)..(312): a, c, t, g, unknown or other
  misc_feature (312)..(312): n is a, c, g, or t
  modified_base (317)..(329): a, c, t, g, unknown or other
  misc_feature (317)..(329): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccaagggcccatccggtccttccccctggccgccctgctccaggagcacctccgagacgcacagccggccctggggcctgccgtggtcaaggactacttccgagtagcgtgcctgagcgggctggcaaggccgnatagnnnnnnnnnnnnn

SEQ ID NO: 9124 - DNA, 311 bp, Homo sapiens
  misc_feature: GYAE6OF02HERLH.30.30.C08.1.454.CMB.1.raw
  modified_base (219)..(219): a, c, t, g, unknown or other
  misc_feature (219)..(219): n is a, c, g, or t
  modified_base (306)..(311): a, c, t, g, unknown or other
  misc_feature (306)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagccggccctgggctgcctggtcaaggactacttccacgtagcgtgctgagcgggctggcaaggcgcatagnnnnnn

SEQ ID NO: 9125 - DNA, 364 bp, Homo sapiens
  misc_feature: GYAE6OF02IAE7T.30.30.C08.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (332)..(332): a, c, t, g, unknown or other
  misc_feature (332)..(332): n is a, c, g, or t
  modified_base (336)..(364): a, c, t, g, unknown or other
  misc_feature (336)..(364): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcgagccctccaccaacgggcccatcggtccttccccctggcncccctgcctccaggacnccacctccgagacgcacacggcgcccgtgggcctcgcctaggtccaaggccttacttccacgtagccgttgcctaggaggcgggctggcaacgggcgactaagtgnagcnnnnnnnnnnnnnnnnnnnnnnnnnnnnn

SEQ ID NO: 9126 - DNA, 324 bp, Homo sapiens
  misc_feature: GYAE6OF02JEEUN.30.30.C08.1.454.CMB.1.raw
  modified_base (292)..(292): a, c, t, g, unknown or other
  misc_feature (292)..(292): n is a, c, g, or t
  modified_base (312)..(324): a, c, t, g, unknown or other
  misc_feature (312)..(324): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgcctccaggagcacctccgagagcacacgccggccctgggctgcctggtcaaggctacttccacgtagccgtgctgagcggntcggcaagggcgacagtagnnnnnnnnnnnnn

SEQ ID NO: 9127 - DNA, 313 bp, Homo sapiens
  misc_feature: GYAE6OF02HDF5Z.30.30.C08.1.454.CMB.1.raw
  modified_base (307)..(313): a, c, t, g, unknown or other
  misc_feature (307)..(313): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggacgcacctccgagagcacagccggccctgggctcgcctggtcaaggctacttccacgtagcgtgctgagcgggctggcaaggcgcatgnnnnnnn

SEQ ID NO: 9128 - DNA, 324 bp, Homo sapiens
  misc_feature: GYAE6OF02GWU82.30.30.C08.1.454.CMB.1.raw
  modified_base (224)..(224): a, c, t, g, unknown or other
  misc_feature (224)..(224): n is a, c, g, or t
  modified_base (313)..(324): a, c, t, g, unknown or other
  misc_feature (313)..(324): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtccttcccccgtggccgccctgctccagganccacctccgagacgcacagccggccctgggctgcctggtcaaggactacttccacgtagcgtgctgagcgggctggcaaggcgcatagnnnnnnnnnnnn

SEQ ID NO: 9129 - DNA, 345 bp, Homo sapiens
  misc_feature: GYAE6OF02H9QTK.30.30.C08.1.454.CMB.1.raw
  modified_base (333)..(345): a, c, t, g, unknown or other
  misc_feature (333)..(345): n is a, c, g, or t
tcagcacgctacgtcacgaccggtgctcgatttagtctgacgtcaaaagggaaaggggctggagtgggtggccaacataaaccaagatggaagtgaacagtactatgtggactctgtgaagggccgattcaccatctccagagacaacgccaagaactcactgtctcctcagccctccaaccaagggccccatccggtccttcccccgtggccgcccctgcctccaggagccacctccgagacgcacaggccggcccgtgggctcggccttggtacaaaggactacctttccacggtagcgtgctggagcgggctggacaaggccgacatagnnnnnnnnnnnnn

SEQ ID NO: 9130 - DNA, 320 bp, Homo sapiens
  misc_feature: GYAE6OF02I050T.30.30.C08.1.454.CMB.1.raw
  modified_base (278)..(278): a, c, t, g, unknown or other
  misc_feature (278)..(278): n is a, c, g, or t
  modified_base (306)..(320): a, c, t, g, unknown or other
  misc_feature (306)..(320): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggcaaggctacttccacgtagcgtncgtgagcgggctgggcaaggcgcatagnnnnnnnnnnnnnnn

SEQ ID NO: 9131 - DNA, 315 bp, Homo sapiens
  misc_feature: GYAE6OF02FSHO9.30.30.C08.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (308)..(315): a, c, t, g, unknown or other
  misc_feature (308)..(315): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagngcacagcggccctgggctgcctggtcaaggactacttccagtagcgtgctgagcgggctgggccaaggcgcagtagcnnnnnnnn

SEQ ID NO: 9132 - DNA, 309 bp, Homo sapiens
  misc_feature: GYAE6OF02JENY7.30.30.C08.1.454.CMB.1.raw
  modified_base (304)..(309): a, c, t, g, unknown or other
  misc_feature (304)..(309): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggactacttccacgtagcgtgctgagcgggctggcaaggcgcatagnnnnnn

SEQ ID NO: 9133 - DNA, 329 bp, Homo sapiens
  misc_feature: GYAE6OF02JQA8U.30.30.C08.1.454.CMB.1.raw
  modified_base (314)..(329): a, c, t, g, unknown or other
  misc_feature (314)..(329): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtcttccccctggcgccctgctccaggagcacctccgagagcacagccggccctgggctgcctggtcaaggactacttccaggtagcgttcgctggagcgggtctgggcaaggcgcataggnnnnnnnnnnnnnnnn

SEQ ID NO: 9134 - DNA, 338 bp, Homo sapiens
  misc_feature: GYAE6OF02GD3LV.30.30.C08.1.454.CMB.1.raw
  modified_base (231)..(231): a, c, t, g, unknown or other
  misc_feature (231)..(231): n is a, c, g, or t
  modified_base (274)..(274): a, c, t, g, unknown or other
  misc_feature (274)..(274): n is a, c, g, or t
  modified_base (308)..(338): a, c, t, g, unknown or other
  misc_feature (308)..(338): n is a, c, g, or t
tcagcacgctacgtcacgaccggtgctcgatttagtctgacgtcaaagggaaaggggctggagtgggtggccaacataaacccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagngcacagccggcctgggctgcctggtcaaggctacttccagtancgtgctgagcgggactgggcaagggcgcagtagnnnnnnnnnnnnnnnnnnnnnnnnnnnnnnn

SEQ ID NO: 9135 - DNA, 312 bp, Homo sapiens
  misc_feature: GYAE6OF02IJQRW.30.30.C08.1.454.CMB.1.raw
  modified_base (303)..(303): a, c, t, g, unknown or other
  misc_feature (303)..(303): n is a, c, g, or t
  modified_base (308)..(312): a, c, t, g, unknown or other
  misc_feature (308)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttccccctggcgccctgctccaggacgcacctccgagacgcacagcggccctgggctcgcctggtcaaggactacttccacgtagcgtgctgagcgggctggcaggcncatgnnnnn

SEQ ID NO: 9136 - DNA, 377 bp, Homo sapiens
  misc_feature: GYAE6OF02GR3NW.30.30.C08.1.454.CMB.1.raw
  modified_base (353)..(377): a, c, t, g, unknown or other
  misc_feature (353)..(377): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtccttcccccctggccgcccctgcctcccgaggacgccaccctccgagagccacagccggcccctggggcctggccctagggtaccaacggaccttaccgtttccccggtaagtccggtagcttggacggccggggctgggccgaagggccgcaagtagnnnnnnnnnnnnnnnnnnnnnnnnn

SEQ ID NO: 9137 - DNA, 311 bp, Homo sapiens
  misc_feature: GYAE6OF02FJX4U.30.30.C08.1.454.CMB.1.raw
  modified_base (299)..(299): a, c, t, g, unknown or other
  misc_feature (299)..(299): n is a, c, g, or t
  modified_base (304)..(311): a, c, t, g, unknown or other
  misc_feature (304)..(311): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgnatagnnnnnnnn

SEQ ID NO: 9138 - DNA, 405 bp, Homo sapiens
  misc_feature: GYAE6OF02JYOT9.30.30.C08.1.454.CMB.1.raw
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (324)..(326): a, c, t, g, unknown or other
  misc_feature (324)..(326): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (337)..(405): a, c, t, g, unknown or other
  misc_feature (337)..(405): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaaccaaggggtccccatccggtccttccccctggccgcccctaggcctccaggagccaacctccgagcnctacaggcgcccngggctgcctggcaaggctacgttccaggtagcgtcgntggagcgggctggctaaggcgctataggnnnantcgnatcgnnnnnnnnnnnnnnnnnnnnnnnnnnnnnnnnnnnnnnnnnnnnnnnnnnnnnnnnnnnnnnnnnnnnn

SEQ ID NO: 9139 - DNA, 351 bp, Homo sapiens
  misc_feature: GYAE6OF02GB8S8.30.30.C08.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (313)..(314): a, c, t, g, unknown or other
  misc_feature (313)..(314): n is a, c, g, or t
  modified_base (316)..(351): a, c, t, g, unknown or other
  misc_feature (316)..(351): n is a, c, g, or t
tcagcacgctacgtcacgaccggtgctcgatttagtctgacgtcaaagggaaggggctggagtgggtggccaacataaaccaagatggaagtgaacagtactatgtggactctgtgaaggccgattcaccatctccagagacaacgccaagaactcactgtctcctcacgcctccaccaagggcccaatcggcttccccnggccnccctgctcaggancacctcgangccanagcggcccngggctgcctggtcaaggcctacttcccagtagccgtgctggacgcgggtctgggacaaggtcgacatagacnncnnnnnnnnnnnnnnnnnnnnnnnnnnnnnnnnnnnn

SEQ ID NO: 9140 - DNA, 321 bp, Homo sapiens
  misc_feature: GYAE6OF02GPM83.30.30.C08.1.454.CMB.1.raw
  modified_base (306)..(306): a, c, t, g, unknown or other
  misc_feature (306)..(306): n is a, c, g, or t
  modified_base (311)..(321): a, c, t, g, unknown or other
  misc_feature (311)..(321): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggccccagtccggtcttccccctggccgccctgctcccaggacgcacctccgagacgcacagccggccctgggctgcctggtcaaggctacttccacgtagcgtgctgagcggctggcaaggcncatgnnnnnnnnnnn

SEQ ID NO: 9141 - DNA, 385 bp, Homo sapiens
  misc_feature: GYAE6OF02ILVGV.30.30.C08.1.454.CMB.1.raw
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (328)..(328): a, c, t, g, unknown or other
  misc_feature (328)..(328): n is a, c, g, or t
  modified_base (330)..(331): a, c, t, g, unknown or other
  misc_feature (330)..(331): n is a, c, g, or t
  modified_base (333)..(335): a, c, t, g, unknown or other
  misc_feature (333)..(335): n is a, c, g, or t
  modified_base (337)..(337): a, c, t, g, unknown or other
  misc_feature (337)..(337): n is a, c, g, or t
  modified_base (339)..(385): a, c, t, g, unknown or other
  misc_feature (339)..(385): n is a, c, g, or t
tcagcacgctacgtcacgaccggtgctcgatttagtctgacgtcaaaagggaaagggggctggagtgggtggccaacataaaccaagatggaagtgaacagtactatgtggactctgtgaagggccgattcaccatctccagagacaacgccaagaactcactgtctcctcagccctccaccaagggcccatcggtccttcccccgtggccgccctgctccaggngccaccncgagacgcacagcggccctgggcctgccgtggtcaacggctacgttccacgtagcgtgcgtgaggcgggctcgggactaagggccgcctaagtagngnngnnngncnnnnnnnnnnnnnnnnnnnnnnnnnnnnnnnnnnnnnnnnnnnnnnn

SEQ ID NO: 9142 - DNA, 399 bp, Homo sapiens
  misc_feature: GYAE6OF02IBTJX.30.30.C08.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (319)..(319): a, c, t, g, unknown or other
  misc_feature (319)..(319): n is a, c, g, or t
  modified_base (343)..(349): a, c, t, g, unknown or other
  misc_feature (343)..(349): n is a, c, g, or t
  modified_base (351)..(351): a, c, t, g, unknown or other
  misc_feature (351)..(351): n is a, c, g, or t
  modified_base (353)..(399): a, c, t, g, unknown or other
  misc_feature (353)..(399): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggcccgattcaccatctccagagacaacgccaaggaactcactgtctcctcagcctccaccaagggcccatcggtctcccctggccgccctgctccgagngcctccgcgagngcacaggcccggccgtcgggcctcgaccgtggtacgaaggtaccttactttcccgaagtaccggcgtgtcctgggaacggccggtcnggcaaacggcgactaatcggatcnnnnnnntncnnnnnnnnnnnnnnnnnnnnnnnnnnnnnnnnnnnnnnnnnnnnnnn

SEQ ID NO: 9143 - DNA, 657 bp, Homo sapiens
  misc_feature: GYAE6OF02FS2LJ.30.30.C08.1.454.CMB.1.raw
  modified_base (503)..(503): a, c, t, g, unknown or other
  misc_feature (503)..(503): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
  modified_base (556)..(557): a, c, t, g, unknown or other
  misc_feature (556)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (646)..(646): a, c, t, g, unknown or other
  misc_feature (646)..(646): n is a, c, g, or t
tcagcacgctacgtcacgaccggtgctcgattttagtctgacgtcaaagggaaaggggcgtggagtgggtggccaacataaaccaagatggaagtgaacagtactatgtggactctgtgaaggccgattcaccatctccagagacaacgccaagaactcgactgtcctcctacacgcctaccaccgaacgggtcccaagtcggtccctttacccccgtggcccgtccctagcctaccgaggtacgaccaccctaccggaagacggtacccaaaccgacggccccgggtcccgttacggggccttcgggccccgttagggttaacctaaaccgggtaacctttaacccgtttaccccgaagggttaacggtccggttcggttaccctacgggtaaccgggcccggggtaccgttacggggaaccgtaaaccggggtccgtaacgttaacggtacgggtcctaggaccggttgactacgtcaagccgtagtcagcgtcgctagcngattgactaggcctatcagcatcgatcgnacgngtacngctngtcgtcncgtnncncncnctcgactagtacgacgtactcgtcgtgtcgtacgcgcgcgacgcgacgcgtacggcgagtcgtcgtacgcgtcgtcgtcgtcnctacgtcgtcg

SEQ ID NO: 9144 - DNA, 318 bp, Homo sapiens
  misc_feature: GYAE6OF02FSRSM.30.30.C08.1.454.CMB.1.raw
  modified_base (307)..(309): a, c, t, g, unknown or other
  misc_feature (307)..(309): n is a, c, g, or t
  modified_base (311)..(318): a, c, t, g, unknown or other
  misc_feature (311)..(318): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaacgggcccatcggtcttcccctggcgccctgctccaggagcacctccgagagcacagcggccctgggctgcctggtcaaggactactccacgtagcgtgctgagcgggctgggcaaggcgcagtagnnngnnnnnnnn

SEQ ID NO: 9145 - DNA, 316 bp, Homo sapiens
  misc_feature: GYAE6OF02HB7MC.30.30.C08.1.454.CMB.1.raw
  modified_base (305)..(316): a, c, t, g, unknown or other
  misc_feature (305)..(316): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnnnn

SEQ ID NO: 9146 - DNA, 328 bp, Homo sapiens
  misc_feature: GYAE6OF02I8B7L.30.30.C08.1.454.CMB.1.raw
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (312)..(328): a, c, t, g, unknown or other
  misc_feature (312)..(328): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggccccatccggtcttccccctggccgccctgctccaggacgcacctccgagagcaacagccggccctgggctgcctggtcaaaggctactcagtagcgtgctgaggcggntagggcaaggcnctatagnnnnnnnnnnnnnnnnn

SEQ ID NO: 9147 - DNA, 326 bp, Homo sapiens
  misc_feature: GYAE6OF02IA1W8.30.30.C08.1.454.CMB.1.raw
  modified_base (261)..(261): a, c, t, g, unknown or other
  misc_feature (261)..(261): n is a, c, g, or t
  modified_base (309)..(326): a, c, t, g, unknown or other
  misc_feature (309)..(326): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttccccctggccgccctcctccaagagcacctcgtgggggcacgagcggccctgggctgcctggtnaggactacttccacgtgcgtgctgagcgggctggcgaaggcacatagnnnnnnnnnnnnnnnnnn

SEQ ID NO: 9148 - DNA, 347 bp, Homo sapiens
  misc_feature: GYAE6OF02GHHFQ.30.30.C08.1.454.CMB.1.raw
  modified_base (306)..(347): a, c, t, g, unknown or other
  misc_feature (306)..(347): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcgccctgggctgcctggcaggacctacttccacgtagcgtgctggagcgggctgggcaaggcgcatagnnnnnnnnnnnnnnnnnnnnnnnnnnnnnnnnnnnnnnnnnn

SEQ ID NO: 9149 - DNA, 319 bp, Homo sapiens
  misc_feature: GYAE6OF02GTDVH.30.30.C08.1.454.CMB.1.raw
  modified_base (305)..(305): a, c, t, g, unknown or other
  misc_feature (305)..(305): n is a, c, g, or t
  modified_base (310)..(319): a, c, t, g, unknown or other
  misc_feature (310)..(319): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccgaagggcccatccggtccttcccccgtggcgccctgctccaggacgcacctccgagacgcacagccggccctgggctgcctggtcaaggactactccagtagccgtgctgagcgggctggcaggcncatgnnnnnnnnnn

SEQ ID NO: 9150 - DNA, 386 bp, Homo sapiens
  misc_feature: GYAE6OF02GBOIQ.30.30.C08.1.454.CMB.1.raw
  modified_base (217)..(217): a, c, t, g, unknown or other
  misc_feature (217)..(217): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (348)..(386): a, c, t, g, unknown or other
  misc_feature (348)..(386): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcgtctccccctggcgccctgcctccaggngccacctccgagacgcacgagccggcctcggggctcgccgtggtaccaaggaccttaccttcccgaacgttaggccgttagccttggacggccgggcgtcggggctaaacgggccggactagtacgncnannnnnnnnnnnnnnnnnnnnnnnnnnnnnnnnnnnnnnn

SEQ ID NO: 9151 - DNA, 483 bp, Homo sapiens
  misc_feature: GYAE6OF02H30R4.30.30.C08.1.454.CMB.1.raw
  modified_base (222)..(222): a, c, t, g, unknown or other
  misc_feature (222)..(222): n is a, c, g, or t
  modified_base (400)..(400): a, c, t, g, unknown or other
  misc_feature (400)..(400): n is a, c, g, or t
  modified_base (402)..(403): a, c, t, g, unknown or other
  misc_feature (402)..(403): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (414)..(483): a, c, t, g, unknown or other
  misc_feature (414)..(483): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctcagagacacgccaagaactcactgtctcctcagcctccaccaagggcccatcggtccttccccctgggcgcccctgcctccagggngccaccctccggaagacgcaacgtacgccgggcccgtaggggcctcggaccgtcgggttacgaaacggggtacctttaaccgtttcccaacgggttaacggcggtttcggcctgggtaaggccgggggtcctttgggggaacccgtaaaggggcccgctaacttaacggggcagcagngnnacngtntccgnnnnnnnnnnnnnnnnnnnnnnnnnnnnnnnnnnnnnnnnnnnnnnnnnnnnnnnnnnnnnnnnnnnnnn

SEQ ID NO: 9152 - DNA, 316 bp, Homo sapiens
  misc_feature: GYAE6OF02GXA2E.30.30.C08.1.454.CMB.1.raw
  modified_base (308)..(310): a, c, t, g, unknown or other
  misc_feature (308)..(310): n is a, c, g, or t
  modified_base (312)..(316): a, c, t, g, unknown or other
  misc_feature (312)..(316): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccgaggacgcacctccgagacgcacagcggccctgggcctgcctggtcaaggctaccttccagtagcttgctgagcgggctggcaaggcgcaatgnnngnnnnn

SEQ ID NO: 9153 - DNA, 312 bp, Homo sapiens
  misc_feature: GYAE6OF02IH64E.30.30.C08.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (297)..(312): a, c, t, g, unknown or other
  misc_feature (297)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccacaagggccatcgtccttccccnggcnccctgctccaggagcacctcgagagcacaggcgccctggctgccgtgcaagctactcacgtagcgtgctgagcggctggcaagggcacagtagnnnnnnnnnnnnnnnn

SEQ ID NO: 9154 - DNA, 372 bp, Homo sapiens
  misc_feature: GYAE6OF02ISWJT.30.30.C08.1.454.CMB.1.raw
  modified_base (332)..(332): a, c, t, g, unknown or other
  misc_feature (332)..(332): n is a, c, g, or t
  modified_base (352)..(353): a, c, t, g, unknown or other
  misc_feature (352)..(353): n is a, c, g, or t
  modified_base (355)..(372): a, c, t, g, unknown or other
  misc_feature (355)..(372): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcacgcctaccaaacaacggggcccaacgttccggtccttcccccgttgggccgccccgttgcctcccaaggacgccaaccctccgaagacgcacgagcggccccgtggggcctggccgtggtacgaaacggtactactcctacggtagcgtcgcgtgagcgggntaggcgaaggcgacagtagnngnnnnnnnnnnnnnnnnnn

SEQ ID NO: 9155 - DNA, 511 bp, Homo sapiens
  misc_feature: GYAE6OF02HHM5J.30.30.C08.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagcacgctacgtcacgaccggtgctcgatttagtctgacgtcaaagggaaggggctggagtgggtggccaacataaaccaagatggaagtgaacagtactatgtggactctgtgaagggccattcaccatctccagagacaacgccaagactcactgtctcctcagcctccaccaaggcccagtcggtctcccctggcnccctgctccagancactccgangcacagcggcctggcngcctggtacaagactactccagtgcgtagctagagcgggctaggaccaaggcgacagtaggncgatcagtnacgancgtacngacgnttcagngagcttaactgggatcggacngatgangtacncgatacgntacgngctanacgactcgacngtacgacgacagttgaccngttnagagtnacctagacaggtancgtacaggcaaggtnacgtgaccgtacgtacacggtctaaggtcgtacgtacgtagtactacgtacgtactacgg

SEQ ID NO: 9156 - DNA, 629 bp, Homo sapiens
  misc_feature: GYAE6OF02JHR2D.30.30.C08.1.454.CMB.1.raw
  modified_base (346)..(346): a, c, t, g, unknown or other
  misc_feature (346)..(346): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
tcagcacgctacgtcacgaccggtgctcgatttagtctgacgtcaaagggaaaggggctggagtgggtgccaacataaaccaagatggaagtgaacagtactatgtggactctgtgaagggccgattcaccatctccagagacaacgccaagaactcactgtcctcctacagccctccaccaagggccccagtcggttccttcccctggccgccctgcctccgaggacgcacctccgagcgcacctagcccgcccgtgggcttcgaccggtgttacgaaacggtaccttaaccttcccaggttacgtccggtcgtccttgggaaggtcccggggagttccgggaanaaaccggggtcgccggaaattcgggctgntcgctagcaaggntcctgngctnagcgtcacgtngactcgacgctcgtcgtcgtgntcgtacgtactacgtcgtcgtacgtcgtctcgtacgtacgtcgtgttcggtacgtacgtgtcgtacgtacgtaccgacgtacgtacgtacgtcgtacgtacgttacgtacgtactacctcgtacgtaccgtacgttgtaccgtccgttacgtacgtccgtcgttcggtaccggtaccgtaccgtcgttgtacgtaccg

SEQ ID NO: 9157 - DNA, 332 bp, Homo sapiens
  misc_feature: GYAE6OF02GIFSF.30.30.C08.1.454.CMB.1.raw
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (300)..(332): a, c, t, g, unknown or other
  misc_feature (300)..(332): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggccnccctgctccgaggancacctcgagncacagcgcctgggctgcctgtcaagctactcacgtagcgtgctgagcgggctggacaaggcgacagtagnnnnnnnnnnnnnnnnnnnnnnnnnnnnnnnnn

SEQ ID NO: 9158 - DNA, 446 bp, Homo sapiens
  misc_feature: GYAE6OF02JNK4T.30.30.C08.1.454.CMB.1.raw
  modified_base (386)..(386): a, c, t, g, unknown or other
  misc_feature (386)..(386): n is a, c, g, or t
  modified_base (388)..(446): a, c, t, g, unknown or other
  misc_feature (388)..(446): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgatttcaccatctccagagacaacgccaagaactcactgtcctacctcagcctccaccaagggcccatccggtcttcccctggccgccctgctccaggacgcacctccgagacgcacagccggtccctggggccttggcccttagggaccgaacgggtaccttaccgtttacccaaaccggttgccggtttcgccgttggaacgggcccgggggtaccgttggggccccgtaaaaggggccgttaccgaagttaaggcgacngnnnnnnnnnnnnnnnnnnnnnnnnnnnnnnnnnnnnnnnnnnnnnnnnnnnnnnnnnnn

SEQ ID NO: 9159 - DNA, 429 bp, Homo sapiens
  misc_feature: GYAE6OF02IBLMD.30.30.C08.1.454.CMB.1.raw
  modified_base (365)..(365): a, c, t, g, unknown or other
  misc_feature (365)..(365): n is a, c, g, or t
  modified_base (368)..(369): a, c, t, g, unknown or other
  misc_feature (368)..(369): n is a, c, g, or t
  modified_base (372)..(429): a, c, t, g, unknown or other
  misc_feature (372)..(429): n is a, c, g, or t
tcagcacgctacgtcacgaccggtgctcgattttagtctgacgtcaaagggaaaggggctggagtgggtggccaacataaaccaaagatggaagtgaacagtactatgtggactctgtgaagggccgattcaccatctccagagacaacgccaaagaactcactgtctcctcacgcctccaccaagggcccatccggttccttccccctggccgccctgctccaggagccacctccgagacgccaccaggccggcccgtgggctcgccgttacggtcgtaaacggtccttaaccttttccgaacggttacgaccggttgtcctagggaacggccgggcgtaggggcaaaggcccgacaatacggncgnngannnnnnnnnnnnnnnnnnnnnnnnnnnnnnnnnnnnnnnnnnnnnnnnnnnnnnnnnn

SEQ ID NO: 9160 - DNA, 461 bp, Homo sapiens
  misc_feature: GYAE6OF02H6HB6.30.30.C08.1.454.CMB.1.raw
  modified_base (242)..(242): a, c, t, g, unknown or other
  misc_feature (242)..(242): n is a, c, g, or t
  modified_base (400)..(461): a, c, t, g, unknown or other
  misc_feature (400)..(461): n is a, c, g, or t
tcagcacgctacgtcacgaccggtgctcgatttagtctgacgtcaaaaggggaaagggggctggagtggggtggccaacaataaaaccaagatggaagtgaacagtactatgtggactctgtgaagggccgattcaccatctcagagacaacgccaagaactcactgtctccctcagccctcccaaccaagggcccactcggtccttccccccgtgggccgccccgtcggcctccagggacnccacccgtccgagacgccaacgacggccggccccgtggggccttcggaccgtcggttacgaaacgggtaccttaaccgtttcccgaacggttacggccggttcgcgttacgggaaggccggggcgtacggggacgaaagggccggtacaatacggcgnnnnnnnnnnnnnnnnnnnnnnnnnnnnnnnnnnnnnnnnnnnnnnnnnnnnnnnnnnnnnn

SEQ ID NO: 9161 - DNA, 327 bp, Homo sapiens
  misc_feature: GYAE6OF02G00VX.30.30.C08.1.454.CMB.1.raw
  modified_base (241)..(241): a, c, t, g, unknown or other
  misc_feature (241)..(241): n is a, c, g, or t
  modified_base (313)..(327): a, c, t, g, unknown or other
  misc_feature (313)..(327): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccgaacgggcccatccggtccttccccctggccgccctgctccaggagcacctccgagagcacngccggccgtggctgcctggtcaacggctacttccacgtacgcgtgctgagcggggctggcaaggcgcatagnnnnnnnnnnnnnnn

SEQ ID NO: 9162 - DNA, 406 bp, Homo sapiens
  misc_feature: GYAE6OF02JJBPA.30.30.C08.1.454.CMB.1.raw
  modified_base (225)..(225): a, c, t, g, unknown or other
  misc_feature (225)..(225): n is a, c, g, or t
  modified_base (338)..(338): a, c, t, g, unknown or other
  misc_feature (338)..(338): n is a, c, g, or t
  modified_base (342)..(406): a, c, t, g, unknown or other
  misc_feature (342)..(406): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtccttcccctggccgccctgcctccagggacnccacctccggagacgccacaggccggcccgtgggctcggcctgggtacaaggacctaccttccgagtcgacgtggctcgaggcgggtacctggacaagggccgtcaagttagncgannnnnnnnnnnnnnnnnnnnnnnnnnnnnnnnnnnnnnnnnnnnnnnnnnnnnnnnnnnnnnnnn

SEQ ID NO: 9163 - DNA, 312 bp, Homo sapiens
  misc_feature: GYAE6OF02G0INJ.30.30.C08.1.454.CMB.1.raw
  modified_base (206)..(206): a, c, t, g, unknown or other
  misc_feature (206)..(206): n is a, c, g, or t
  modified_base (301)..(301): a, c, t, g, unknown or other
  misc_feature (301)..(301): n is a, c, g, or t
  modified_base (307)..(312): a, c, t, g, unknown or other
  misc_feature (307)..(312): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccnccctgctccaggagccacctccgagagcacagcggccctgggctgcctggtcaaggactacttccacgtagcgtgctgagcgggctggcaaggcncatagnnnnnn

SEQ ID NO: 9164 - DNA, 325 bp, Homo sapiens
  misc_feature: GYAE6OF02JHXL0.30.30.C08.1.454.CMB.1.raw
  modified_base (274)..(274): a, c, t, g, unknown or other
  misc_feature (274)..(274): n is a, c, g, or t
  modified_base (307)..(325): a, c, t, g, unknown or other
  misc_feature (307)..(325): n is a, c, g, or t
tcagcacgctacgtcacgaccggtgctcgatttagtctgacgtcaaagggaaaggggctggagtgggtggccaacataaaccaagatggaagtgaacagtactatgtggactctgtgaagggccgattcaccatctccagagacaacgccaagactcactgtctcctcagcctccaccaagggcccatcggtcttccccctggcgccctgctccaggacgcacctccgagagcacagccggcctgggctgcctggtcaggactacttccagtancgtgctgagcgggctggcgaaggccgacatagnnnnnnnnnnnnnnnnnnn

SEQ ID NO: 9165 - DNA, 356 bp, Homo sapiens
  misc_feature: GYAE6OF02FKBTU.30.30.C08.1.454.CMB.1.raw
  modified_base (315)..(315): a, c, t, g, unknown or other
  misc_feature (315)..(315): n is a, c, g, or t
  modified_base (318)..(356): a, c, t, g, unknown or other
  misc_feature (318)..(356): n is a, c, g, or t
tcagcacgctacgtcacgaccggtgctcgatttagtctgacgtcaaagggaaaggggctggagtgggtggccaacataaaaccaagatggaagtgaacagtactatgtggactctgtgaagggccgattccaccatctccagagacaacgccaagaactcactgtctcctcagcctccaccaagggcccatcgtcttccccctggcgccctgctccaggagcacctccgagagcacacgcggccctggggactgccctgggtccaaggctacttccagtacgcgtgcctgagcggggctggcaaggcgcatagtngannnnnnnnnnnnnnnnnnnnnnnnnnnnnnnnnnnnnnn

SEQ ID NO: 9166 - DNA, 530 bp, Homo sapiens
  misc_feature: GYAE6OF02F1XAR.30.30.C08.1.454.CMB.1.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
  modified_base (490)..(491): a, c, t, g, unknown or other
  misc_feature (490)..(491): n is a, c, g, or t
  modified_base (493)..(493): a, c, t, g, unknown or other
  misc_feature (493)..(493): n is a, c, g, or t
  modified_base (495)..(497): a, c, t, g, unknown or other
  misc_feature (495)..(497): n is a, c, g, or t
  modified_base (499)..(500): a, c, t, g, unknown or other
  misc_feature (499)..(500): n is a, c, g, or t
  modified_base (503)..(504): a, c, t, g, unknown or other
  misc_feature (503)..(504): n is a, c, g, or t
  modified_base (507)..(507): a, c, t, g, unknown or other
  misc_feature (507)..(507): n is a, c, g, or t
  modified_base (509)..(512): a, c, t, g, unknown or other
  misc_feature (509)..(512): n is a, c, g, or t
  modified_base (514)..(515): a, c, t, g, unknown or other
  misc_feature (514)..(515): n is a, c, g, or t
  modified_base (519)..(523): a, c, t, g, unknown or other
  misc_feature (519)..(523): n is a, c, g, or t
  modified_base (525)..(526): a, c, t, g, unknown or other
  misc_feature (525)..(526): n is a, c, g, or t
  modified_base (528)..(529): a, c, t, g, unknown or other
  misc_feature (528)..(529): n is a, c, g, or t
tcagcacgctacgtcacgaccggtgctcgattttagtctgacgtcaaaaggggaaagggggctgggagtgggtggtccaacataaacctaagatggaaggtgacagtacctatgtaggactctgtagaacgggccgattcgaccattctaccagtacgacgaacgccaagaaactacactgtctcctcanactcacaggcccatcgtctccccgnggcncccgtgctccaggtancacgtccggaggagcacncggccgccctgggaccngccgtggtcgaacggacttacctccgacggtacgtcgttccactggaccgtccgggactacggggccaagggtcccggtaccgtaccgttaggccacctcacaancgtacncgngcggcncgncnctcgngcgcgctcgacgacgtactcgtccgtagtggactcgcggaggacggacggcgtacggacgacgacgtactacgtagngacgngngcngcnncncnnngnnagnncanannnngnnagcnnnnnannanng

SEQ ID NO: 9167 - DNA, 709 bp, Homo sapiens
  misc_feature: GYAE6OF01ASUMQ.43.11.A11.1.454.CMB.1.raw
tcagtgtgagtagtcacgaccggtgctcgatttagctacgactgcaagggtaaagggggctgggcctcaggaagcagcatcggaggtgcctccagccatggcatggatccctctcttcctcggcgtccttgcttactgcacaggatccgtggccgcctatgagttgactcacgcccaccctcagtgtccgtcgtccccgaaggacacgaccacgccagcaagtccacctgctctggagataaagtggggaataaatatgcctctggtatcagcagaacgccaggccgacgtcccctggtcgttggtcactctatcaagacgtagaaccaaacggcccctacgacgggactcctaggacgcgattctcgtcggctaccgaactcgtacgggaacactacgcctaacctctacgaaccctataccgacggcccgggaacccgacgggtccgttaagtacgggtatacgggacggtacgttacgtttaactttttacgtcggtttacgacgggtcggttacgggaacctaacccgtaaacgtaccgttgggtttaccgggtttaccggggaccgggtaaccggggaacccgtaaacgggtcccggttaacggtaaccccggttacggttaaaccgggtccgtaaccgggaccccggtaaaccgggtcccgtaccccgggtcccccccgttacggggttcccttaacccccgg

SEQ ID NO: 9168 - DNA, 656 bp, Homo sapiens
  misc_feature: GYAE6OF02GI07T.43.11.A11.1.454.CMB.1.raw
  modified_base (226)..(226): a, c, t, g, unknown or other
  misc_feature (226)..(226): n is a, c, g, or t
tcagtgtgagtagtcacgaccggtgctcgatttagctacgactgcaagtgaaaggggctgggcctcaggaagcagcatcggaggtgcctcagccatggcatggatccctctcttcctcggcgtcttcgcttactgcacaggatccgtggccgcctactgagttgactcagccaccctcagtgtccgtgtccccaggaccagacagccagcatcacctgctctgganataaagttggggaataaataatgacctctcggtattcagtacagtaagcctacggcggacgttcccctggtagttcggtctaatcctaagtacaagtactagaacgaaaccggccctaacgacgggtactcccgtagaacgtcggtacttaccgtacttcggactaccccgtaaactccgttacgggaaactaccgaacgcctaacgtcctagacccaataccgacgaccgggacccgaacggtactacggttacggacgtacgtacggtacgtcggtaaccttttacgtacggttacgaggtaccggttacgggacccaaccgtaacaccgtttggtacggtttcggaccgggtaggaccgaacgtcgtacgggtactcccggtagtccggacgaccgtaacggccgtccgtaccccgtcggttacccg

SEQ ID NO: 9169 - DNA, 782 bp, Homo sapiens
  misc_feature: GYAE6OF02HZ93F.43.11.A11.1.454.CMB.1.raw
tcagtgtgagtagtcacgaccggtgctcgatttagctacgactgcaagtgaaaggggctgggcctcaggaagcagcatcggaggtgcctcagccatggcatggatccctctcttccctcggcgtccttgtcttactgcacgaggatccggtggccgcctatgagttgactcagcccaccctcagtcgtccgtcgtccccaggacagacacgccagcatccacctgctccgtggagaagttaaaggtggggaattaaacgtattacgccgtaccttggtactcagcgaggaacgccacgggtcgtacgtcccccgtgtacggtttgggtacctagttacctttataccgtaagtaacgtaacggtaaccgaaacccgggtaccccgtacggaacgggtaccgttacccgttgggacgtaccgtaacgtttcgttcgtccgggtacctaccctaaccggtcgttaacgggaacctacgacgtaccgactccgtacgtaaccgacgttacggaccgggtaccgggaacccgagggtaccgttaacggtcggtaagttcggggacgtaaccgtttcgggttaaccttttaccggttacgtaacgggaccgggtacccgggtagggtaacccgaaacccgttaacgtcccggtttagggtttaaccgggtttcgggtaccggggttaacggaaccgtacgggtccgttaccgggtacccgtccggtaaccgggccgtaaccgggaccgtaacggtcccgtacccggtaccccggttcggtaaccccg

SEQ ID NO: 9170 - DNA, 515 bp, Homo sapiens
  misc_feature: GYAE6OF01B3RD4.45.5.A05.1.454.CMB.1.raw
  modified_base (475)..(475): a, c, t, g, unknown or other
  misc_feature (475)..(475): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctcctagtccagcaggcttccagccggttccctggagtgtcagacaggttcagtggacacggatcagacacattcttcactctagaaatcagccgtgtcggccgcgtgaggattggtttggttgttttattactgctatgactaagctagtacgaccggtactaccgtttcgggccggggtaccngggcgtgggaggtcaagtcgaacgtggtcggctgcactag

SEQ ID NO: 9171 - DNA, 509 bp, Homo sapiens
  misc_feature: GYAE6OF01BR88R.45.5.A05.1.454.CMB.1.raw
  modified_base (502)..(502): a, c, t, g, unknown or other
  misc_feature (502)..(502): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctcctagtccagcaggcttccagccggttccctggagtgtcagacaggttcagtggacacggatcagacacattctttcactctagaaatcagccgtgtggccgctgaggatggttggttgttttattactgcatgctaagctgtacgaccggtactaccgtttgggcccggggaccaggcgtgggaggtcaagtcgaacgtggtggctgcnccgtacg

SEQ ID NO: 9172 - DNA, 506 bp, Homo sapiens
  misc_feature: GYAE6OF01DLD07.45.5.A05.1.454.CMB.1.raw
  modified_base (245)..(245): a, c, t, g, unknown or other
  misc_feature (245)..(245): n is a, c, g, or t
  modified_base (495)..(495): a, c, t, g, unknown or other
  misc_feature (495)..(495): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaanacttatttgtactggtacctgcagaggccaggccagtcgccgcagctcctagtccagcaggcttccagcccggttcctggagtgtcagacaggttcagtggacacggatcagacacattcttcactctagaaatcagcgtgtggccgctgaggtatgttggttgtttattactgcatgcagctgtagaccggtactaccgtttcgggccggggacagggcgtgggacggtcaacgtcgaacgtggtaggntcgcacgtacg

SEQ ID NO: 9173 - DNA, 514 bp, Homo sapiens
  misc_feature: GYAE6OF01CFTTY.45.5.A05.1.454.CMB.1.raw
  modified_base (321)..(321): a, c, t, g, unknown or other
  misc_feature (321)..(321): n is a, c, g, or t
  modified_base (471)..(471): a, c, t, g, unknown or other
  misc_feature (471)..(471): n is a, c, g, or t
  modified_base (502)..(502): a, c, t, g, unknown or other
  misc_feature (502)..(502): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccctgggcagtcggccgccatctcctgcacgtctagtcggagcctcttacatacaaatggaaagacttatttgtactggtacctgcagaggccaggccagtcgcgcagctcctagtccagcaggcttccagccggttcccnggagtgtcagacaggttcagtggacacggatcagacacatctttcactctgaaaatcagcgtgtaggccgcgtgaggtatgttggtgtttattacgtgcattcgactaagcgttgtacgtaccggtactaccgtttcgggccggggaccngggtctggaggtcaagtcgaacgtgtacggntcgctacgtacg

SEQ ID NO: 9174 - DNA, 503 bp, Homo sapiens
  misc_feature: GYAE6OF01DPOZT.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctcctagtccagcaggcttccagccggttcctggagtgtcagacaggttcagtggacacggatcagacacatcttcactctagaaatcagccgtgtggccgctgaggtatgtttggttgtttattactgcatgcagctgtacgaccggtacgtaccgtttcggccggggacagggcgtgggaggtcgaagtcgaacgtgtaggctgcactacg

SEQ ID NO: 9175 - DNA, 579 bp, Homo sapiens
  misc_feature: GYAE6OF01DBSIN.45.5.A05.1.454.CMB.1.raw
  modified_base (223)..(223): a, c, t, g, unknown or other
  misc_feature (223)..(223): n is a, c, g, or t
  modified_base (321)..(321): a, c, t, g, unknown or other
  misc_feature (321)..(321): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccccgtgggcagtcggccgcatctcctgcacgtctagtcggancctcttacatacaaatggaaagcttattgactggtacctgcagagccaggccagtcgccgcagctcctagtccagcaggcttccacgtccggttcccnggatgtcagacaggttcagtcggacacggatcagacacattcttacactctagaaactcagtccgtgtcggccgcgtaggtacggtagttggtttaggttacgtttaattacgtgactagtcgacgtaagcgttacggtacggtaccggttaccgttaacccggtttcggggacccgggggtacacgggtcggttagggtacgggttaccgtaacgtaccgtaacgttcgggtacggccgttacggccgtaccgtacg

SEQ ID NO: 9176 - DNA, 601 bp, Homo sapiens
  misc_feature: GYAE6OF01EWJBT.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctcctagtccagcaggcttccagccggttccctggatgcagacaggttcaggtggacacggatcagacacatctttcactctagaaatcagtccgtgtggccgctggacggtagttggtttagggttagttttaattaccttgtctagttacgacgtaacgtcgttacggttaacggacccgggttaaccgtacccggttttccggggacccggggggtaaccgtacggggtccgttaggggtaacggttaccgaaagttcccgggaaacgttcgggttacgggaccttcgggtccctaacccgttaaccg

SEQ ID NO: 9177 - DNA, 568 bp, Homo sapiens
  misc_feature: GYAE6OF01C964H.45.5.A05.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (556)..(556): a, c, t, g, unknown or other
  misc_feature (556)..(556): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagacctccactctccctgtcccgtcaccccgtgggcagtccggccnccatctcctgcacgtctagtcggancctctacatacaaatggaaagtctttattgtactggtacctgcagagccaggtcagtcgccgcagctcctagtccagcagctccgagccgttccnggatgtcagacnggttcagtggactacggatcgaagtacactattcttcactctaagaaatcgacgtccgtaggtcggccgtacgtaggtacggtagttggtttaggtttagttttaagttacctggtactagtcggaactaagtcgttaggtaacggtaacccggtacgtaccggttcggggacccgggggtactagggtcgtagggacggtcaacgtcgtaacgtggcgacncgtcacgttacg

SEQ ID NO: 9178 - DNA, 651 bp, Homo sapiens
  misc_feature: GYAE6OF01DXKET.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctggcagtcggccgccatctcctgcacgtctagtcgagcctcttacatacaaataggaaatactttatttgtactggtacctgcagacggccaggccagtccgccgcacgcctcctacgtccagcacggccttccgacggtcccggttcccgtggacgtcgtacgagtacgtaggttcaggtcggacgacggactacacgactactacttctttacacttactaagaaacttcgaacggtccgtggtcggcccgtacgtaggtaggtagtttggttttaggtttacgttttaacgttacgtgtacgtagtcgacgtaagtccgttagggttaaccggtacccgggttaacgtacccgggtttacgggggaccccgggggtaaccgacgggtccggttaggggtaacggttaccgtaaacggtccggtaaacggttgggtaccggaccgttcggacccgtaccgttacg

SEQ ID NO: 9179 - DNA, 848 bp, Homo sapiens
  misc_feature: GYAE6OF01DLU6Z.45.5.A05.1.454.CMB.1.raw
tcagacgcgatcgacacgaccggtgctcgatttagatagatagacagggtgctgctgaggctgtaggtgctgtccttgctgtcctgctctgtgacactctccgtggggctgctaatgctctggactccctggtatttagtacggactattggcggtcgacccagacctccactcctccctcgtcccgtccaccccgtgggcacggtccggcccgcctacttcctccgtcgcctaccggttcgtacggtccgggactcccttacttaacaactaaacgtaaaagttagggtaaaaacgttacctttttaagttttcggtaaccgttacggggttaaccccttgggaccgaacgggaaccgggccccgaacggggaccccgtacgggtccccggacccggcgtaacggtcccttaccccgttaaggtcccgaacggcccggtaaccggtccctttacccgaccgggttcccccggggtttacccgtaggggttacggtacggttaccaaaggggttaccgtaggggtttaccgaacgggttaccggaaccgtaacggggtaacttaccgaaacggtaacctaacttactttccctttaccctaacttaccgtaaacgtaaaacgtcgtaaccggtccggttacgggtccggtccgtacggtagggtaggttacgttttcggggtttagttttacgtttagtaccgtggtactagtacgacgtaacgtcgttacggtaccggtacccggttacgttccgggttccgggggacccgggtacgacgggttccggtagggaacgttccgaacgttacggtacgttcgggtaccggactcggtacctacggttac

SEQ ID NO: 9180 - DNA, 549 bp, Homo sapiens
  misc_feature: GYAE6OF01DECR3.45.5.A05.1.454.CMB.1.raw
  modified_base (223)..(223): a, c, t, g, unknown or other
  misc_feature (223)..(223): n is a, c, g, or t
  modified_base (407)..(407): a, c, t, g, unknown or other
  misc_feature (407)..(407): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggancctcttacatacaaatggaaagtcttatttgtactggtacctgcagaggccaggccagtcgccgcagctcctagtccagcaggcttccagccggttccctggagtgtcagacaggttcagtggacacggatcagacactatcttcactctagaaatcagcgtgtgccgctgagtatgttggttntttatactgcattcgactagtcgtagtacggtaccggtactaccggtttcgggacccgggggtaccaggggtccgtaggggtaacggtccgtaaagttccggtaaacgttcggtacgggtccgtacggccgtacccgtaacg

SEQ ID NO: 9181 - DNA, 681 bp, Homo sapiens
  misc_feature: GYAE6OF01AZN80.45.5.A05.1.454.CMB.1.raw
  modified_base (250)..(250): a, c, t, g, unknown or other
  misc_feature (250)..(250): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaaaacttntttgtactggtacctgcagaggccaggccagtccgccgcacgctcctagtccagcaggcttccagtccggttcctggacgtgtacagacgtaggttcaggtcggaacacggactcgaacgacactattcctttacaccttactaacgaaaactcgaacggtcccggttggtccgggcccgtacgtacgggtacggtagtttcgggttttagggtttagtttttaacgttacgtcggtacgtaacgtacggaccgtaaacggtcgttaacgggttaaccgggtaacccggttaaccgttacccgggtttcgggggacccgggggttaacccgacggggtaccggtacggggtaacgggttaccgtaaacggttaccggtaaacgttcgggttacggtaccgttacggacccgttaaccgtacgtttacccgg

SEQ ID NO: 9182 - DNA, 511 bp, Homo sapiens
  misc_feature: GYAE6OF01DKYI5.45.5.A05.1.454.CMB.1.raw
  modified_base (334)..(334): a, c, t, g, unknown or other
  misc_feature (334)..(334): n is a, c, g, or t
  modified_base (475)..(475): a, c, t, g, unknown or other
  misc_feature (475)..(475): n is a, c, g, or t
  modified_base (502)..(502): a, c, t, g, unknown or other
  misc_feature (502)..(502): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagcttatttgactggtacctgcagaggccaggccagtcgccgcagctcctagtccagcaggcttccagcccggttcctggagtgtcagacnggttcagtggacacggatcagacactattcttcactctagaaactcagtccgtgtcggccgctggaggtattggtttggttgttttattactgctatggcagtctggtacgacccggtacgtcccgttgggcccggggacngggctggagtcaagtcgaagtgtacgntgctacgtc

SEQ ID NO: 9183 - DNA, 664 bp, Homo sapiens
  misc_feature: GYAE6OF01EY064.45.5.A05.1.454.CMB.1.raw
  modified_base (472)..(472): a, c, t, g, unknown or other
  misc_feature (472)..(472): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggttttcctgctattattataaaaggtgtcctgtgtcaggtacagatggcggagtcgtgggggaagaacgggtcaacccgtggccggtccctggaggctctcctgtttaggttctggtattcgtcttcagcgactactacctggagttgggtccgcgtggctccgagggaagagtcgtgggagtggtattggcgtacatcagttcattctgacttccgaccgttctaaccgtccgcaacgtactcgtggtgggaacggtccctaagttcccacttagtttcccgacgggaccgacggcccgacgtaacctcgtaacctttancgttcgactaagtacgtagtaaccgttagtcgtaaggtaaccggaaccccgtaacgaccgaccgtaccctaattaacgtaacttacgtgtacgacgtacggtaggtaacgtttaacggtcgggtcccgtccgggttaccggggacccccgggtacccgttcgggtaccctaccccggtcgtcccggtacccg

SEQ ID NO: 9184 - DNA, 561 bp, Homo sapiens
  misc_feature: GYAE6OF01A9MKQ.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcgccgccatctcctgcacgtctagtcggagcctcttacatacaaatggaaagtacttatttgtactggtacctgcagaggccaggccagtcgccgcagcctcctagtccagccaggtcttccagcccggttccctggagtgcagacaggttcagtggacacggatcaagacacgtactctttacgactactagaaaatcgacgtaccgtggtcggccgcgtaggtaggagttcggtttaggttcgttttaatatcgcgatgacgtaagtcgttagtacgtaccggttacgtaccggtttcgggacccggggacgtacgggcgtgggaggtaccaagtacgaacgttggtaggtcgtcgcgtccgtaacg

SEQ ID NO: 9185 - DNA, 602 bp, Homo sapiens
  misc_feature: GYAE6OF01BAOBC.45.5.A05.1.454.CMB.1.raw
  modified_base (222)..(222): a, c, t, g, unknown or other
  misc_feature (222)..(222): n is a, c, g, or t
  modified_base (336)..(336): a, c, t, g, unknown or other
  misc_feature (336)..(336): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccgtggcagtcggccgccatctcctgcacgtctagtcggancctcttacataacaaagtggaaagtactttatttgtaacctggtacctgacagaggccaggccagtcgccgcagcctcctagtccagcaggccttccgacggtccggtttcccngggagtgtccaagaactagggttcaggtaggaccgacggatcgaagaccactattctttacactactagaaactcagcgtagtcggccgcgtagaggtagtgtttaggttagtttattacgtgactaagtcgacgtaagtcgttaggtaaccggtaccggttaccgtacccggtttacggggcccgggggaacctacggggtcgtaggggtaacggtaccaaaggttaccgaaacgttcggtcggtactacggtcctaaccgtacg

SEQ ID NO: 9186 - DNA, 909 bp, Homo sapiens
  misc_feature: GYAE6OF01DYI73.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggactcctggtatttaggtacggactagttggcggtcgaccagacctccactcctccctcgtccgtcacccgtgggcacggtcggccgcctactcctccgtcgccgtacgttcgtacggtccggacgtcccttacttaaccaataaacgaaagttagggtaaaacttacttttagttttacggtaccttacgggtaccttcggacgacgggtacgggcccgtaacgggaccccgtaaccgggtccggcccggaccgtacgtaccccgtttacccgttaacggttcccgaacgggtccggtaaccgggtcccctttaccccggaaccggggtttccccgggtttacccggttggggtaacggttacggtaccgtaacgggtaaccgttaagggtttaccgacggggttacggaacgtacggtaactacgaacgtacctaacttacgtttaccttcgtaccttaacgtaacgtaaacgtccggtttttaccggaccggttacgggtccgggtacccggtacggtacgggtaaggttacggtttacggtttttacgggtttagtttttaacgttacgttcggtaacgttacgtacggtaacgtaacggttacggttaacgggttaaccggtaacccgggttaaccggttacccgggggtttaccgggggaccccgggggtaaccggaccggggttaccgggtaaccggggtaacggttaaccggttaaacgttacccgggtaacggtttccggggtcggtacccgttccggaacccgtaccggtttacccgg

SEQ ID NO: 9187 - DNA, 604 bp, Homo sapiens
  misc_feature: GYAE6OF01A56AI.45.5.A05.1.454.CMB.1.raw
  modified_base (463)..(463): a, c, t, g, unknown or other
  misc_feature (463)..(463): n is a, c, g, or t
  modified_base (487)..(487): a, c, t, g, unknown or other
  misc_feature (487)..(487): n is a, c, g, or t
  modified_base (519)..(519): a, c, t, g, unknown or other
  misc_feature (519)..(519): n is a, c, g, or t
  modified_base (585)..(585): a, c, t, g, unknown or other
  misc_feature (585)..(585): n is a, c, g, or t
tcagacgcgatcgacacgaccggtgctcgatttagatagatagacaggggagctctgggagaagagccccagccccagaattcccaggagtttccactcggtgatcagcactgaacacagaggactcaccatggagtttgggctgagctgggtttccttgctattattataaaaggtgtcctgtgtcaggtacagatggcggagtcgtgggggaagaacggtcaacccgtgggcgggtccctgaggctctcctgtttaggttctggtattcgtcttcagcgactactactgaggttggtccggctggctccgaggggaagcgtcgtggaggtggattggacgtacatcagtctagttcctgtacttcgacgtctactacgcaagactctggtcggaggtccagttcaacctacgtttacccgaagggaccgaccgaccggaccgtaaactccgtaactttacncctgacctagatcgacttagtcgngacgaaccgaagacacggacatatacttacgngtagcgacgaggtcgttaacgtcgggccgttccgggaccggggaccccggtaaccgtgggtacccnccggtcccgtcccggtacg

SEQ ID NO: 9188 - DNA, 889 bp, Homo sapiens
  misc_feature: GYAE6OF01AHIKH.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggactcccgtggtatttaggtacggacattgcggtgacccagactccactcctccctgtcccgtcaccccgtgggcacggtccggcccgccatcctcctgcctacgtctaggtccggactccttaccttaacacttaacaaaagttcgggaaaatactttagtttgtaaccgttggtaccctgaccgaaggtacggcccgaagggccccaggtccggaccggcacggtccttccgtacggtcccaaggcctagggtcccctttacccggacgggttccccccgggttttaccgagggacgtttacggtaccgaaagggtaacccgtaggggtttccaacggggttacgggaaccaaccggggtaactacccggaaagtacccctaacttacgttttacctttaccgtaaccgttacgttaaacgtaaaacgtccgttaaccgggtcccggtttagggtaccgggtacccggtaccggttaaggggtaaccgggttagtttacggggttttacggtttaacggtttttaaccttaccggttacgtaacgtacgttaagggtacccgtaacggttaccggttaacgggttaacccgggtaacccgggtttaacccggttaacccggggttccggggggtaaaccccggggggtaaacccacggggggttaccggttaacgggggtaacccggttaaccgtaaccgggttaacccggtaacgggttacgggttaccgggtaccgtaaccggttacccgtaccccgttaaggg

SEQ ID NO: 9189 - DNA, 672 bp, Homo sapiens
  misc_feature: GYAE6OF01EOUSI.45.5.A05.1.454.CMB.1.raw
  modified_base (224)..(224): a, c, t, g, unknown or other
  misc_feature (224)..(224): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagacctccactctccctgtccgtcaccctgggcagtccggccgccatctcctgcacgtctagcggacncctctacataacaaagtgaaatactttattgtactggtacctgacaggacggccaggccagtccgccgcacgcctacctacgtccagcacggtccttccgacggtcccgggttccctgggacgttcgtcaagacggtaggttcgaggtacggacacggtactacaacgacactaatttcctttacacttacgtaagtaaaactccgtaacggtccggttggttacggcccgtacgtagggtaacggtagtttcgggttttaggtttagttttaacttacgtcgtacgtacgtacggtactaacggttcgttacggttaaccggtaacccgttaacccggttaccgggtttaccggggacccgggggtaactacggggtcggtagggtaacggtaacgtaaacggttaccgtaacggttcggtacggccgtacgtacccgacgttaccg

SEQ ID NO: 9190 - DNA, 686 bp, Homo sapiens
  misc_feature: GYAE6OF01BCWA2.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggtatttagtacggacagttggcggtgacccagactccactctccctgtccgtcacccgtgggcaggtcgccgccatctcctgcacgtctagtcggactccttcttacataacaaaagttgggaaaactacttttatttagtaacgtggttacctgccagacggccgaggccctaggtccgccgcacggcctccgtagtccaggcacgggtcctttcccgacgggttccccgggtttacccgtagggacgttcgtacgacggtaacgtacgggttacaagggttcgggaaccgtaccggtataccggaacggaacctactacgtttcctttacctaccttacgtaacgtaaactcgacggtccggtggtcggtccgtacgtaggtaggttacgttggtttcgggtttagttttacttacgtcgtacgtatcgacgtagtcgttacggtaaccgtaccggttaccgtaccggtttacggggaccggggtaaccgagggtccgtagggtacggtacgtaacgtacggtaacgttcgggacggtcgtacgtcgtacgtacg

SEQ ID NO: 9191 - DNA, 545 bp, Homo sapiens
  misc_feature: GYAE6OF01A8OMK.45.5.A05.1.454.CMB.1.raw
  modified_base (479)..(479): a, c, t, g, unknown or other
  misc_feature (479)..(479): n is a, c, g, or t
  modified_base (534)..(534): a, c, t, g, unknown or other
  misc_feature (534)..(534): n is a, c, g, or t
tcagacgcgatcgacacgaccggtgctcgatttagatagatagacagggttgaccgttcttcccccagccccagaattcccaggagtttccactcggtgatcagcactgaacacagaggactcaccatggagtttgggctgagctgggttttccttgctattattataaaaaggtgtcctgtgtcaggtacagatggcggagtctgggggaagaacggtcaaccctggcgggtccctgaggctctcctgtttaggttctggattcgtcttcagcgactactacctgagttgggtccggctggctccaggggaagagtcgtggagtggatttggcgtacatcagtcattctgattcgaccgtctactacgcagactctgtggaggccattcaccatttccgagggacgacgccgcgaactcactttatctgcagatgactagtctgacgacccgaagacacgccatatattactgtgcgngaggagttacgtggtcgtccgtgggcctggggaccctggtcctaccgtctccgcncgccctacccg

SEQ ID NO: 9192 - DNA, 777 bp, Homo sapiens
  misc_feature: GYAE6OF01ALB5A.45.5.A05.1.454.CMB.1.raw
tcagacgcgatcgacacgaccggtgctcgatttagatagatagacagggtgctgctgaggctgtaggtgctgtccttgctgtcctgctctgtgacactctcctgggggctgctaatgctctggactccctggtatttagtacggacattggcggtcgacccagacctccactcctccctgtcccgtccacccgtgggcacggtccggccgccatcctcctgcctacgtcgtacgtcggacgtcctacttaacataacaaagtaggaaagtactttatttcgtacgtcggtacctgacgaggacggccgacgggaccacggtcccggccgcgacgtccttacccgtacgtccacggccgacggtcccttccgaccggtcccgggttcccgtagggtacgttcgtacgaacggtacgtacgggtttcgacggtcgggaaccgacgggtactacgaacgtacctaactactttacctttacctacgtacgtaacgtaaacgtcgtacggtccggttcgggtccgggtaccgtcggttagggtaacggttagtttgggttttacgggtttaacgttttaacgttacgtacggtacgttaacggtacggtacgtaacggtccggttaacgggttaacccgggttaacccggttaacccggttcccgggggtttaccgggggaccccgggggtaagtacccggggtcggtaccggggttacggttaccggaacggttaaccggtacggttccgggtcggtactccggtaacccgtcgttaccg

SEQ ID NO: 9193 - DNA, 670 bp, Homo sapiens
  misc_feature: GYAE6OF01EFXB2.45.5.A05.1.454.CMB.1.raw
  modified_base (561)..(561): a, c, t, g, unknown or other
  misc_feature (561)..(561): n is a, c, g, or t
  modified_base (655)..(655): a, c, t, g, unknown or other
  misc_feature (655)..(655): n is a, c, g, or t
tcagacgcgatcgacacgaccggtgctcgatttagatagatagacagggtgctgctgaggctgtaggtgctgtccttgctgtcctgctctgtgacactctccgtggggctgctaatgctctggacttcccgtggtatttagtacggatattggcggtcgacccagtacctccactcctcccgtgtccgtccaccccgtgggcaggtccggcccgcctactcctccgtgcctacgttcgtaggtcggacgtcccttacttaacataacaaagtaggaaaattactttatttcgtacgtcggtacctgacgaggacgccgacggccgagtccgccgcacgtcctccgtacgccgagcgtacggtccttcccgacggttccccgggtttccgtagggtacgttacggtaccaaggtacggtacgggtttacgacggttacgggaaccgacggtactaacgaacgtaccctaacgttactttccttaccgaacgttactaaagggtaaactccgaagggtcctgggtcggcctaggtaggtagtgtttgtttaggttatttactncggctagcgacgtacgttgtacgaccggtaccgttacgtcgggtaccggggaccgtagtaggtcggtaggtactactagtcgacggttggaccngtacgcccgtagtcg

SEQ ID NO: 9194 - DNA, 837 bp, Homo sapiens
  misc_feature: GYAE6OF01AI6NH.45.5.A05.1.454.CMB.1.raw
  modified_base (186)..(186): a, c, t, g, unknown or other
  misc_feature (186)..(186): n is a, c, g, or t
  modified_base (619)..(619): a, c, t, g, unknown or other
  misc_feature (619)..(619): n is a, c, g, or t
  modified_base (633)..(633): a, c, t, g, unknown or other
  misc_feature (633)..(633): n is a, c, g, or t
tcagacgcgatcgacacgaccggtgctcgatttagatagatagacaggggagctctgggagaagacgccccagccccagaacttcccaggagtttccactcggtgatcagcactgaacacagaggactcaccagtggtaggttgggctgagtcgttgggttttcctgtcttattatagtaaaggtntctgtgtacaggtacagagtggcggagtcggtagggggaacgtaccggtaccgaacccggtgggacccgggtcctggacggtcctcttccgttggtttacggttcgtggttactttccgtacgttcgacggtccgtacctaccgttccgtaggtacgggttccggggtccccggtcgttaccgggaccgttacccggaagggggtaacggtcggttacggtaggggttaaggtacgggttacgttacgggtacccgtttaacgacgttccggtaacgtacgttaccgttttccgtagttaacccggttacccgaccgtttacctaccgtaaccgcgtaacgtcgttcggtcgggtacgggaccggtcgtacctacgtaccgttacgtaccggacgggacctccggccgtaactactaccttactttagccgtnacccgtgtacgttnaacggttcaccgggtacgaacccgtaaccggaacgacctaaccggtacttaaacttacggttaaccgtaacgcggtccggtaaccgggtaagttaaccgggttagtttaccccggttgggtaccccggtcccggggttacccggggtaaccccgtaaccgggtcccggttccccgtaaccggtcccgggtcccgtaaaccccgg

SEQ ID NO: 9195 - DNA, 719 bp, Homo sapiens
  misc_feature: GYAE6OF01BM2CQ.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagacggacattgcggtgacccagactccactctccctgtcccgtcaccccgtgggcaggtcggccgccatctcctgcacgtctaggtcgacgccttactacataacaaagtggaaagtacttatttcgtactggtacctgacaggacggcctaggcctaggtccgaccgctacgtcctaccgtagtccaggaccgaggtccttacccgacggtccccggtttccgtgggacgttcgtaccgaaggtacccgtaagggtttcaacgggttgggaaccgacgggtactaccgaagacctaacttacttaccgtttacctaacttactaaggtaaaccttcgtaacggtccggtcggtccgggtccggtacggtaggtacgggttacgtttagggtttacgggtttagttttacgttaacgttacgtcgtagtcggtaacgtacggttacgttacgggttaaccgtacccgggttacccgtaaccgggtttccgggggacccggggtaacccggtacgggtacggtagggtacggtaccgaacggttaccgtaaacgttcgggtacgtacgtcgtcccgtcgttaccg

SEQ ID NO: 9196 - DNA, 543 bp, Homo sapiens
  misc_feature: GYAE6OF01BXF9G.45.5.A05.1.454.CMB.1.raw
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (412)..(412): a, c, t, g, unknown or other
  misc_feature (412)..(412): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagagccaggccagtcgccgcagctcctagtccagcaggcttccgagtccggttccnggagtgtcaggacnggttcaggtcggacacgggatacagacactattcctttcactctagaaactcagcgtgtcggccgcgtggaggtnttggttggttagtttattacgtgctatgacgtagcttgtacggtaccgtacgtaccgttcgggacccggggacgacgggtcgtgggacgtacgtaacgtccgaaacgttcggcggtacgtcgcgtcctacg

SEQ ID NO: 9197 - DNA, 663 bp, Homo sapiens
  misc_feature: GYAE6OF01A32HH.45.5.A05.1.454.CMB.1.raw
  modified_base (368)..(368): a, c, t, g, unknown or other
  misc_feature (368)..(368): n is a, c, g, or t
tcagacgcgatcgacacgaccggtgctcgatttagatagatagacagggtgctgctgaggctgtaggtgctgtccttgctgtcctgctctgtgacactctccgtggggctgctaatgctctggactcctggtatttaggtacggactattggcggtcgacccagactccacttcctccctgtcccgtccaccccgtgggccaggtccggccgcctactcctcctgcctacgtctacggtcggactcctacttacaataactaaagtaggaaagttactttagtttgtactggtacctgacgagcgccgacggccacgtccgccgcacgtcctcctagccagcacgcttccgacgtcccggttcctggntcgtcacgtacgtaggtcgaggtacggacacgggactcaacgacacttacttccttacacgttacgtaagtaaactacgtacggtcggttcggtaccgggcccgtacgttacgggtaaggttacgtttggggtttacgtttacgtttacgtacgtagtacgtagtcggacgtaagtcggttaacgtacggtaccgtacggtaccggttccggggaccggggtacgacggggtacgtaggggtacgtaacgtacggtacgtaacggttcgggacggtacgtccgaccgtccgtacg

SEQ ID NO: 9198 - DNA, 892 bp, Homo sapiens
  misc_feature: GYAE6OF01DR4UO.45.5.A05.1.454.CMB.1.raw
  modified_base (184)..(184): a, c, t, g, unknown or other
  misc_feature (184)..(184): n is a, c, g, or t
tcagacgcgatcgacacgaccggtgctcgatttagatagatagacaggggagctctgggagaagagccccagccccagaattcccaggtagtttccactcggtgatcagcactgaacacagagactcaccatggtagtttgggctgagtcgttgggttttccttgcttattattaataaaggtntctgtgtcgaggtacagagtggcggaggtcggtagggggaacgtaaccggtcctaacccgtgggccgggtcccgtaggacgggtcccttccgttcccgtttaggtttttacgggtttcgttacgggttacttttccggtttccttacgtacggtaccggtaactttacccgttaccgttacgggttacggggtttcgggggtcccggtcgttcggccgtaccggaagggggaaacggtacggtcggtagggtaggtgggtaacgtttgggtaaccgtactaagttccgtaggttccttaagtttcgtaggtactttacccgggtaccgtttacctaaccgttacgtaccgtaacgtaccgttcgtacgggttacggggaccgggttccgttactttacccgtaccgtttaaccgtttccgggaacgggtacccggtaaccggcccggtaacccgtaacttaccgttaaccttttacgtaccgttcggtaaccgtacgttacgtacggtttaaccgttaacgtcccggtaacggaaccggtaaacccggaacgtaaccggaccgtaacgttacttaacgttacttacgttcggcggtaaccgtagggaacgggtttaacggttacggttcgggttcccgggccgggttaccccgggaccccgggtaaccggttcgggtccccgttaacccggtcgtccccgtaacccgg

SEQ ID NO: 9199 - DNA, 713 bp, Homo sapiens
  misc_feature: GYAE6OF01AQK82.45.5.A05.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (699)..(699): a, c, t, g, unknown or other
  misc_feature (699)..(699): n is a, c, g, or t
tcagacgcgatcgacacgaccggtgctcgatttagatagatagacgagggtgctgctgaggctggtaggtgctgtccttgctgtcctgctctgtgacactctcctggggctgctaatgctctggactccctggattagtacggacattgcgtgacccagactccactcctccctgtaccgtcacccgtgggcagtcgccgcatctctncacgtnagtcggancctatacatacaaagtgaaagtactttattacgtaccgtggtacccttgacaaggtacggacccaggacctaagggtccgaaccggctaacgccttttacccgaagtaccctaggaccctaggggtcccttccggaacgttccccgggtttaccgagggtacggttacgacgaacggcgtaggtttaaccgcgggttacggaacgtaccgggtaacttcggaaaccgtactaacgttacttaccgtttacacgtattaaacgaaacgtttcgaacggttccggtcggtacggtccgtacggtagggtaacggttacgtttagggtttcgggtttaactttttacgaacgttcggaacgtacggttacgacgtacgttcgttaaccggtacgtaccgtaccgtacggggttccgggacccggggtacgaggtccggaggtacggaaccgtaatcccgggaagttccggaaggcccttnacccgtattaccgg

SEQ ID NO: 9200 - DNA, 751 bp, Homo sapiens
  misc_feature: GYAE6OF01B37BX.45.5.A05.1.454.CMB.1.raw
  modified_base (220)..(220): a, c, t, g, unknown or other
  misc_feature (220)..(220): n is a, c, g, or t
  modified_base (384)..(384): a, c, t, g, unknown or other
  misc_feature (384)..(384): n is a, c, g, or t
tcagacgcgatcgacacgaccggtgctcgatttagatagatagacagggtgctgctgaggctgtaggtgctgtccttgctgtcctgctctgtgacactctccgtggggctgactaatgctcgtggactccgtggtaatttacggtacggactagttggcggtacaccagacctccaccttcctcctcgtcccgtccacccggtgggcacggtccggcccncctacttcctccgtcgtctaccggttctacgggtccggacgtccttaactaactaactaaacgtaaaggttacggtaaaacgttctttagtttacgtaccgttacggttaacccaggaccgacggtaccggccgaacggtacccgtcggtcccggaccggtacncggttacccttaccgtacggccgtacggaccggtaccggttccgttaacccggccggttcccgggttccggaggttcggttactaccgaaggtaaccggttcggttacgacgggtaccgacgtaacgacgtacaacgactcttacttcttactacttacgtaacgtaacgtcgtaccgtacggtcggtacggtccgtagggttcggtaggttacgtttgggtttacggtttacgtttacgtacgtacgtctaggtccgacgtcgtacggtaacggtaccggttaccggtaccggttccgggtcgggaccggtacggtacggtcgtacgggactcgtaagtcgtaggtcggtcgagtacgcgtcgtcg

SEQ ID NO: 9201 - DNA, 499 bp, Homo sapiens
  misc_feature: GYAE6OF02F0D6K.45.5.A05.1.454.CMB.1.raw
  modified_base (394)..(394): a, c, t, g, unknown or other
  misc_feature (394)..(394): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctcctagtccagcaggcttccagcccggttccctggagtgtcagacaggttcagtggacacggatcagacacatctttcactctgaaatcagccgtgtggccgntgaggatgttggtgtttattactgcatgcaagctgtagaccggtacaccgtttgggccggggacagggctggacggtcaagtcgaacttggtggctcgcactacg

SEQ ID NO: 9202 - DNA, 515 bp, Homo sapiens
  misc_feature: GYAE6OF02JCS1T.45.5.A05.1.454.CMB.1.raw
  modified_base (226)..(226): a, c, t, g, unknown or other
  misc_feature (226)..(226): n is a, c, g, or t
  modified_base (335)..(335): a, c, t, g, unknown or other
  misc_feature (335)..(335): n is a, c, g, or t
  modified_base (473)..(473): a, c, t, g, unknown or other
  misc_feature (473)..(473): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctggcagtcggccgccatctcctgcacgtctagtcggagcctnttacatacaaatggaaagcttattgtactggtacctgcagaggccaggccagtcgccgcagctcctagtccagcaggcttccagtcccggttccctggagtgtcagacnggttcagtggacacgggatcagacacgatctttcactctagaaaatcagccgtagtcggccgctggagtagttgttggtgtttattacgtgcatgacaagtcttagtacgaccggtaacaccgtttcggccggggacnggcgtggacggtcaagtcgaacgtggcggtcgtcgcactacg

SEQ ID NO: 9203 - DNA, 567 bp, Homo sapiens
  misc_feature: GYAE6OF02JCFYN.45.5.A05.1.454.CMB.1.raw
  modified_base (220)..(220): a, c, t, g, unknown or other
  misc_feature (220)..(220): n is a, c, g, or t
  modified_base (320)..(320): a, c, t, g, unknown or other
  misc_feature (320)..(320): n is a, c, g, or t
  modified_base (363)..(363): a, c, t, g, unknown or other
  misc_feature (363)..(363): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccctgggcagtcgccgccatctctgcacgtctagtcggancctcttacatacaaatggaaagacttattgtactggtacctgcagaggccaggccagtcgccgcagcctcctagtccagcaggccttcagcccggttccnggatgcagacaggttcaggtgacacgatcagacacattcttanactcagaaaatcagtccgtgtcggccgctggagtattggttggtgttttaactactgtctagtgtacgaagtcgttaggtaacgtacccgggttaacctaccgttttcggggccgggttacgaacccggtagggtcccgttaggggtaacgggtaccaaacggttaccggaacgttcggtagggtccttacggacccgtaaccg

SEQ ID NO: 9204 - DNA, 632 bp, Homo sapiens
  misc_feature: GYAE6OF02I0GMX.45.5.A05.1.454.CMB.1.raw
  modified_base (210)..(210): a, c, t, g, unknown or other
  misc_feature (210)..(210): n is a, c, g, or t
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
  modified_base (453)..(453): a, c, t, g, unknown or other
  misc_feature (453)..(453): n is a, c, g, or t
tcagacgcgatcgacacgaccggtgctcgatttagatagatagacagggttgaccgttcttccccagccccagaattcccaggagtttccactcggtgatcagcactgaacacagaggactcaccatggagtttgggctgagctgggttttcctgctattattataaaaggtgtcctgtgtcaggtacagatggcggagtctgggggaanaacggtcaaccctggcgggtccctgaggctctcctgtttaggttctggattcgtcttcagcgactactaccngagttgggtccgcttggcctccgaggggaanagttctgggagtggattgcgtacatccagtcattctgattcgaccgtctactacggctagctgtgtagggacggtccctaatttccgacctattttcccgaaggggaccgacgcccggacgtaactcctaacgttttacncgttagcaagtatgaactagtactgaacgtacccgaaagccgacggacctaagtactagttacgtgtacgcgtacgagtacggtttaacttggggaccgttccggttcggggaccccgggtaaacccttgggtacccaacccggttcctcccgaccgtacggtcccctaccgaacccgg

SEQ ID NO: 9205 - DNA, 529 bp, Homo sapiens
  misc_feature: GYAE6OF02FU2ZQ.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctccagtccagcaggcttccgagccggttccctggagtgtcagaaaggttcagtggacacggatcagacacatctttcactctagaaatcagccgtgtggccgctgaggtatgttggtgtttattactgctatggctaagcttagtaagacccggttacaaccgtttgggacccgggggtacacgggcgtcgggaaggttcaaacgttcgaacgtggtcggtccgtgcctaccattccg

SEQ ID NO: 9206 - DNA, 574 bp, Homo sapiens
  misc_feature: GYAE6OF02GU3J5.45.5.A05.1.454.CMB.1.raw
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggactattgcggtgacccagactccactctccctgtccgtcaccctgggcagtcggccgccatctcctgcacgtctagtcggagcctctacatacaaatggaaatcttatttgactggtacctgcagagccaggccagtcgcgcagcctcctagccagcaggccttccacggcccggttcctgggacgtgtcgagacctaggttcaggtcggacacgggatcgaagactactacgttcctttacacttactaagtaaaactcgacggtccgtagtccggccgctggagtnttggttggttatttatcgcgntagtgactaacgtctaggtaacggtacccggttactaccgggtttcggaccgggttacgaccgtaggggtcgttaggggaacgttacgaagttacgtaacgtgggtcgtcttcggaccttaccg

SEQ ID NO: 9207 - DNA, 523 bp, Homo sapiens
  misc_feature: GYAE6OF02GL9V8.45.5.A05.1.454.CMB.1.raw
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggattttagtacggacattgcggtgacccagactccactctccctgtccgtcacccctgggcagtcggccgccatctcctgcacgtctagtcggagcctcttacatacaaaatggaaanacttatttgtactggtacctgcagaggccaggccagtcgccgnagctcctagtccagcaggcttccagccggttccctggagtgtcagacaggttcagtggacacggatcagacacattcctttcactctagaaatcagccgtgtggccgctgaggattgtttggtgtttattactgcatgctaagctagtacgaccggttacgtaccgtttcgggccggggaccgacggcgtaggacggtacgaagtacgaactggtcggcgtcgaccacctacg

SEQ ID NO: 9208 - DNA, 644 bp, Homo sapiens
  misc_feature: GYAE6OF02J2PAP.45.5.A05.1.454.CMB.1.raw
  modified_base (619)..(619): a, c, t, g, unknown or other
  misc_feature (619)..(619): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccccgtgggcagtccggccgccatctcctgcacgtctagtcggacgcctcttacatacaaagtggaaatacttattgtactggtacctgcagagccaggccagtcgccgcagcctctagtcccagcgaggccttccgacggtccccggtttcccgagggtcgtcgtcgaagacgtagggtttcaggtcggaacacgggtattccgaacgtacactactttcttacacgttcgtaagaaactcgaacggtccggttggtacgggcccgtagtacggtaacggtagtttagggtttggtttagtttttaagtaccgttgtaccgtagtcgtaactaacgtccgttaggaacccggttaccggtaccgtttaccggttcggggacccggggaccttagggccgttagggtacgttaccaacggttaccggtaacggttcggngggtacccttcggaccctacgttcg

SEQ ID NO: 9209 - DNA, 663 bp, Homo sapiens
  misc_feature: GYAE6OF02HS1GS.45.5.A05.1.454.CMB.1.raw
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
tcagacgcgatcgacacgaccggtgctcgatttagatagatagacagggtgctgctgaggctgtaggtgctgtccttgctgtcctgctctgtgacactctcctgggctgctaatgctctggatccctggtattagtacggtactagttgcggtcgacccagtacctccactccttccctgtccgtccacccgtgggcacgtccggccgccagtcctaccgtgccacgtctacggtcggacgtcctcttacagtaccaaaagtcggaaactacgtttatttacggtactcggttacctgacgagtacgccgagccacgtcgccncacgctccttanccagtccgaggccttccgacggtccccgttccggaggtcgtgtccacgggaacgtagtttcgaagttcgggaacgaccggtataccaaggacctactacgttcttactacctactaacgaaacttcgaacgtcgttacggtcggccgtagtcggaaggtagttcggttaggttcgtttaagtaccttcggtactagtcgtacgtaacggtcgttacggtaaacggtaccgttaaccgtacccggttccggggaccgggtaccgtacgggtcgtaggggacgtacgtaaacgttcgtaacggtggaccgtaggtcgtacgaaccgttcg

SEQ ID NO: 9210 - DNA, 576 bp, Homo sapiens
  misc_feature: GYAE6OF02JD1EQ.45.5.A05.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccnccatctcctgcacgtctagtcgganccttcttacatacaaatggaaagacttatttgtactggtacctgcagagccaggccagtccgccgcagcctcctagtccagcaggtccttccacggtcccggttccctggagtgtcagacaggttcagtggacacggatacgagacacatctttacacttctagtaaaactcacgcgtgtcggcccgtacgtggacggtagttcggtttggttcgttttatacgttagcgtagtcgacgtaagtcttagtacggtaccggttactaccggtttgggacccgggggaactacgggtcgtacgggtacggttacgaacgtcgtaacggttggtacggtcgtacgccgtaacctcg

SEQ ID NO: 9211 - DNA, 523 bp, Homo sapiens
  misc_feature: GYAE6OF02F32PQ.45.5.A05.1.454.CMB.1.raw
  modified_base (325)..(325): a, c, t, g, unknown or other
  misc_feature (325)..(325): n is a, c, g, or t
  modified_base (374)..(374): a, c, t, g, unknown or other
  misc_feature (374)..(374): n is a, c, g, or t
  modified_base (511)..(511): a, c, t, g, unknown or other
  misc_feature (511)..(511): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagcttatttgtactggtacctgcagaggccaggccagtcgccgcagctcctagtccagcaggcttccgagtcccggttcccnggagtgtcagacgaggttcagtggacacggatcagacacatcttcactntagaaatcagcgtgtggccgcgtgagattggttaggttgtttattacgtgctatgcaagtctagtacgaccggtactaccggtttcgggaccggggtacgagggcgtggacggtactaagtcgacgttcggtcggtntcgtccactacg

SEQ ID NO: 9212 - DNA, 611 bp, Homo sapiens
  misc_feature: GYAE6OF02I7AOR.45.5.A05.1.454.CMB.1.raw
  modified_base (297)..(297): a, c, t, g, unknown or other
  misc_feature (297)..(297): n is a, c, g, or t
tcagacgcgatcgacacgaccggtgctcgatttagatagatagacagggttgaccgttcttcccccagccccagaattcccaggagtttccactcggtgatcagcactgaacacagaggactcaccatggagtttgggctgagctgggttttccttgctattattataaaaggtgtcctgtgtcaggtacagatggcggagtctgggggaagaacggtcaaccctggcgggtccctgaggctctcctgtttaggttctggattcgtcttcagcgactactacctgagttgggtccgntggctcgagggagagtctgggagtggtattgcgtacatcagtcatttctagtattccgaccgttctactacgcagactcgtgtgggacgggcctattccacctatttccgaaggggaccgacggcccgacgtaacctcctactttagtcctgactagagtacgtactagttctaggaacgacccggaagacgacggccaatatacttacgtgtggacgacgaaggtagttacgttggtccggtccggtacggggacccgggtaaccctcgggtaccgtcccgtcgtcccggctaccggccctacccgaacccgg

SEQ ID NO: 9213 - DNA, 743 bp, Homo sapiens
  misc_feature: GYAE6OF02JRS3O.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccccgtggcagtcggccgccatctcctgcacgtctagtcggacgcctcttacataacaaatggaaagtacttatttgtactcggtacctgacaggacgccaggccagtccgccgcagcctcctacgtccagcctagggtccttaccgacggtccccggtttcccgtagggtacgtcgttaccgaacggtacgtacgggtttacgaagggttacgggaaccgtaacgggtacgtaccggaaacggtaacctaacccgttactttacccgttttaccaaccgtttataaaaccggtaaaacttccggaacggttcccgggttagggtccggacccggttacggttaggaaagggtttcgttgggttttacgggttacttttaacgtaccggtgtacctaggttcggaacttaggtaccgttaggttaaccggtaacccggttacgttaccgggggtttacccggggacccggggtaacttacggggtccgggttaagggtaccggtaaccgtaaacggttaccggtaacggttcgggtcggtaccgttcgaaccgtacccttagg

SEQ ID NO: 9214 - DNA, 631 bp, Homo sapiens
  misc_feature: GYAE6OF02HT5JP.45.5.A05.1.454.CMB.1.raw
  modified_base (422)..(422): a, c, t, g, unknown or other
  misc_feature (422)..(422): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggacgcctacttacatacaaatggaaagtacttatttgtactggtacctgcagaggccaggccagtcgccgcagctctagtccagcaggcttcagtccggtcctggagtgtcagacaggttcagtcggacacggatcgaagaaccacgtacttcctttacgactactacgaaaaattcgaaggtccgttacggtggtaccgtnttacgggaggttaacgttggtttagggttacgttttaagttacgtaggtcaagttgaccgtaggtaccgttagggtaaaccggtacccggttaacgttaacccgttttacggggcccgggggtaacctacggggaccgttcgggaacggttacgtaaacggttaccgtaacggttcggtacggtaccggtacgtaccgtaccttaacgg

SEQ ID NO: 9215 - DNA, 651 bp, Homo sapiens
  misc_feature: GYAE6OF02F832K.45.5.A05.1.454.CMB.1.raw
  modified_base (184)..(184): a, c, t, g, unknown or other
  misc_feature (184)..(184): n is a, c, g, or t
  modified_base (236)..(236): a, c, t, g, unknown or other
  misc_feature (236)..(236): n is a, c, g, or t
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
  modified_base (638)..(638): a, c, t, g, unknown or other
  misc_feature (638)..(638): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacagttgcggtcgacccagactccactcctccctgtccgtacnccccgtgggcagtccggccgcatctcctgcacgtctagtagacgcctcttanactaacgaaatggaaaatcttaattgtactaggtacctgactagacggtcacggcctagtccgccgtcagtcctaccgtaacgtccaggcctaacggtccttaccgacggtccccgggtttccgngggtacgtcgtcgaaacgcgttaggtacctgtacggacgtaacggtctacgagaccttacntttccttacactacagtaaactcgtagtccgtagtccggccgcgttacggagttcgttaggttcgtttagttacttcgtcgtagtaagttcgacgtaaacggtgtttaccggtagtaaacccgggttacgttacggttccggggggtacccggtacggtacggtcggtagggacggttaaacctaggtacgtacggttacggtccggcgtttaacnccggtaaccttcg

SEQ ID NO: 9216 - DNA, 786 bp, Homo sapiens
  misc_feature: GYAE6OF02IVSD1.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggtatttagtacggacattgcggtgacccagactccactctccctgtccgtccacccgtgggcagtcggccgccatctcctgcacgtctagtcggacgcctcttacataacaaagtaggaaagtactttagtttgtactggtaccctgcaggacggccaggccaggtcgccgcacgtcctccgtacgtccaggcacggtccttacccgacggtccccgggtttacccgtgggtacgttcggtaccgaaggtacccgttagggtttccgtaagggttacgggaaccggaacgggtaacttaccggaaacggtaacccgtaaccgtttaacgtttcccttttaaccgtaaccgtttaccgttaaagggtaaaaaccttccggaaaccggttcccgggtttacgggttaccgggtacccgtacggttaagggtaaacgggttacgttttggggttttacgggttttaacggttttttaacgtacccggttaggtaaccgttaacgttacgggtaacgtaaacggttccgttaacggttaaaccgggtaacccggttaccgttacccgggtttacgggggacccgggtaacgtacgggtcggttagggaacggtaacgtaacgtacggtacgtcggtacggtcctacggtacctaccgtacg

SEQ ID NO: 9217 - DNA, 603 bp, Homo sapiens
  misc_feature: GYAE6OF02IZ3CZ.45.5.A05.1.454.CMB.1.raw
  modified_base (322)..(322): a, c, t, g, unknown or other
  misc_feature (322)..(322): n is a, c, g, or t
  modified_base (345)..(345): a, c, t, g, unknown or other
  misc_feature (345)..(345): n is a, c, g, or t
  modified_base (471)..(471): a, c, t, g, unknown or other
  misc_feature (471)..(471): n is a, c, g, or t
tcagacgcgatcgacacgaccggtgctcgatttagatagatagacagggggagctctgggagaagagccccagccccagaattcccaggagtttccactcggtgatcagcactgaacacagaggactcaccatggagtttgggctgagctgggttttccttgctattattataaaaggtgtcctgtgtcaggtacagatggcggagtcgtgggggaagaacggtcaaccctggcgggtccctgaggctctcctgtttaggttctggtattcgtcttcagcgactactacctgaggttgggtccggctggcctcgagggaagngtcgtggagtggattggcgtacntcagtcattctgattccgacgtctactacgcagactcgtggtcggagggccgattccgactacgtttccaacgggtacgaccggccgccgtaactctaacttactctgacagatcgacgtagtcgngaccgaaccgacgaccgacggccaattatacgttactgtcgcgacggacggtaaggtttacgttgggtccgttccggtcgggggtaccccggaaccggttcgggtacccgtacccggtccgtcccgtacccg

SEQ ID NO: 9218 - DNA, 755 bp, Homo sapiens
  misc_feature: GYAE6OF02I7W11.45.5.A05.1.454.CMB.1.raw
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
tcagacgcgatcgacacgaccggtgctcgatttagatagatagacagggtgctgctgaggctgtaggtgctgtccttgctgtcctgcctctgtgacactctccgtggggctgctaatgctcgtggactccgtgtatttagacggactagttggcggtcgacccagtacctccacttcctcccgtgtaccgtccacccggtgggctacggtccggcccgacctattcctccgtgacctacggtctacgggacggactcccttacttaacaacgtaaacaaaggtacggtaaaacttacttttagtttcggtaaccgttacggtaaccctggaccgaacgggtaccgggaccaaccgggaccctacgggtccccggcccgtactacccggtccttacccggtacgtaccgaacggtccggtaaccggttcccctttacccggaccgggttcccccggggtttccgaggggtactcggtaccgacggtacgtcggttacgaggtacggaacgtacggtanccaanaccgtactntttctttaccgacttacgtaaacgtaaacgtccgtaacggttcgtacgggtaccggccgtaggtaggtaacggttagtttcggtttaggttaactttactacggtcgacgttagtcgaacgtacgtcgtaacggtacgtacccggttacgtccggggtacgggccggtaggtacggtggtaacgggtctaagtaccgtaggtcgtggtacgcacgtctacgtcg

SEQ ID NO: 9219 - DNA, 700 bp, Homo sapiens
  misc_feature: GYAE6OF02FYFWQ.45.5.A05.1.454.CMB.1.raw
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (344)..(344): a, c, t, g, unknown or other
  misc_feature (344)..(344): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctcctgtccgtccaccccgtgggcaggtccggccgccatcctcctgcacgtctagtcggancctcttacaatacaaagtggaaatactttatttgtactggtacctgcagnggccaggccngtccggccgcagtcctcctacgtccagcacggtccttccgacggtcccggttcccgnggagtcgtcgagacgtacggttcaggtacggacacggtatcgaagaccactacttactttactaaccgtactaacgaaaactccgtaacggtccggttacggtccgggtacccggtacggttacggtaacgggtacgttttagggttcgggttttaacgttttaacgtttaccgtacggtactacgttacgaacgtaagtaccggttacgggtaaccggttaacccggttaaccggttaccgggtttaccgggggtacccgggggtaaccgtacgggtacggttacggggtaacggtaccgtaaacggtcggtaaccggttcgggtacgtaccggtacggtaccgtaccgttaacg

SEQ ID NO: 9220 - DNA, 763 bp, Homo sapiens
  misc_feature: GYAE6OF02F3YXH.45.5.A05.1.454.CMB.1.raw
  modified_base (201)..(201): a, c, t, g, unknown or other
  misc_feature (201)..(201): n is a, c, g, or t
  modified_base (358)..(358): a, c, t, g, unknown or other
  misc_feature (358)..(358): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggactccctggtatttagtacggacagttggcggtgacccagacctccactctcctgtccgtcacccgtggcagtcggccnccatctcctgcctacggtctacggtccggacgtcctacttacaattacaaagtggaaactcttagtttgacgttggtaacctgacaggtacgccgtaggcctagtccgcgcacggcctacgtagccaggctacggtctaccgacggtcccggttccngggtacgtcgtaccaggtaccgtaggttcaagggttccggacgaacgggtacttccgaacgacctaaccgttacgtttaccctttacgtaccgttaacgtaacgtaaaacttcggaaaccggttccggttaacgggtcgggtacccgtacggtacggttaggtacgttttacggttacgggtttacgtttacgtttacgtacggttacgtaacgttacggtacgtaaccggtaccggtttaaccgggttaacccggttaaccgggttaacccgttacccgggggtttaccggggacccggggtaccggtaacgggtcggttacgggtaaccggttacgtaaccggttaaccgggttaacggttacgggtaccgttaccggtaccggttaccgtaacgttacccgg

SEQ ID NO: 9221 - DNA, 817 bp, Homo sapiens
  misc_feature: GYAE6OF02JXGYR.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcaccccgtgggcaggtcggccgccatctctgcacgtctagtcggagcctacttacatacaaagtggaaacgtctttatttgtactggtaacctgacacggcggccgtacggacctacggtcccggccgacacggtacctacccgttaacgcccgaaggccgtcgggttaccctacccggtaccggttccccggggtttcccgtagggtacgttcggtaacctaacggtaacggttacgggtttaccgaagggtacccgggtaacaaccggggtactaccgaacggtaccgtaacttaacgtttccctttaccgtaccgttaaccgttaaaggtaaaccttaccgggtaacgtccggtttacgggtaccgggacccgtaccgtagggttaagggttactttacggggtttacgggtttaccgtttttaagtaaccggttcgttaacggttaaccgttacggtaacccgttaggtaacccggttttagtaaacccgggtttaaacccgttaaccggttacccggggtttacccggggggacccggggtaacgggttaaccgggtcgggttaacgggtaacgttaccgtaaggttaccggtaacggttcggtaccggtagtaacccggtcgtaccgttacgg

SEQ ID NO: 9222 - DNA, 803 bp, Homo sapiens
  misc_feature: GYAE6OF02GOPR4.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagacctccactcctccctgtccgtcaccccgtgggcaggtccggccgccatcctccgtgctacgtctagtcggacgtcctcttacataacaaagtggaaagtactttagtttgtaacgtggtaacccttgacgaggacggaccacgggaccaggtcccgaccgacgtacgccttaccgtacgtccaaggccgacgggtacccttaccgaccggttccccggtttacccgtagggtacgttcggtacccgaggtaacgtacgggtttacacgggttacggaaccgttaacggggacttacgaaaccggtaacctaccttaacgtttacccgttttacgaaccgtttacttaaaacgggtaaaaacctccggtaaccggttacccgggtacgggttccgggtaacccgtcggttaccggggaaaggtttacgggtttacgggttttagggttttaacgttttaacctttaccggtagttaccgttaagcgtaaccggtacgtacgtttaacggtaacgttacccgggttaaccgtacccgggttccggggacccggggtaccgtacggggtccgtaaggggtaccggtacttaaccggtaccggtaacgttcggggttacccgtcggtaccgtaccgtacccgttaacg

SEQ ID NO: 9223 - DNA, 840 bp, Homo sapiens
  misc_feature: GYAE6OF02ISLFF.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctactggactcccgtggtatttacgacggactagttggcggtcgacccagacctccactccgtcctcgtccgtccacccgtggctacggtccggccgtacctacgtccttcccgagtaccgtacggtaccgttaacgtccgggtaacgtcccgtttaccgttaacgaactaaccgtaaaagtaggtaaaaccggtactttacgttttacggtaacctcggttaccgttcaacggtaaggtcccggacccgtaagggtaccctacggtacccggaccgtccgtaacggtcccttaccgtacgttccgaagttccgacggttccttacccgaacggttcccgggttaacccgtagggtccggtttacgacggtaaacggttaacccttacggggtttcccgtaagggttacggaacccggtaacgtaacgttaccgaaacggtacccggaactttaacggttcctttacccgtaagttaaccccggtaaagggttaaacctaccggtaaacgggtccgtttcggaacccggggtttccggaccgttaagggacttaaacgggttttcggttaaggttctttaacgtctaacggtccgaatacggtacgacggttacctagggtaacccgggttctaaccgggttactcgggacggtaccggtaacgtcgacggtacgttaacaacggtacggtacttgggaccgtaggtaccaccggtacttacgg

SEQ ID NO: 9224 - DNA, 643 bp, Homo sapiens
  misc_feature: GYAE6OF02IESJP.45.5.A05.1.454.CMB.1.raw
  modified_base (153)..(153): a, c, t, g, unknown or other
  misc_feature (153)..(153): n is a, c, g, or t
  modified_base (207)..(207): a, c, t, g, unknown or other
  misc_feature (207)..(207): n is a, c, g, or t
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggactattgcggtnacccagactccactctccctgtcccgtcacccgtggcagtcggccgccatctcngcacgtctagtcggactcctcttacatacaagtggaaatctttattgtactggtacctgcagcgccaggccagtccgccnctacgcctccagtccagcagtcctccncggtcccgttccgtggagtcgtacagtactaggttcaggtcggaacacgggtactacaggacctaatactttccgtttaactaccgtactaacgtaaaactcgacggtccggtggtacggccggtcgtacgggacggttagttacggtttggtttacgtttacttacgttcgacgtagtacggtacaacggtcgttaacggttaacggtacccggttaaccggttacccgggttcggggtacccggggtaaccgtcgggtacggtacgggtacggtacctaacgtaccgggtacgttcgggtacggtacgtcggtacctaccgttacgg

SEQ ID NO: 9225 - DNA, 681 bp, Homo sapiens
  misc_feature: GYAE6OF02F6LKO.45.5.A05.1.454.CMB.1.raw
tcagacgcgatcgacacgaccggtgctcgatttagatagatagacagggtgctgctgaggctgtaggtgctgtccttgctgtcctgctctgtgacactctcctggggctgctaatgctctggactccctggtatttagtacggacattggcggtcgacccagacctccactcctccctgtccgtccaccccgtgggcaggtccggccgccactctcctgctacgtctagtcggagtccttcttacataacaaagtggaaagtactttatttgtacgttcggtacctgcaggacgccgacggccacggtccgccgcgacgtccttccgtagtccgaggtccgacgggtccttcccgacggtccccgggttcccgtgggcgttgtaccgagtacgtaggttcacggtcggtaacgacggtactaccgaagtacctactatttcctttcaccgtactaagtaaactcgacgtccggtacggcggccgtcgtaggtagtgttggttaggttattttacgtacgtcgtactacgtgtaccgtaggtcgttacgtaacgtacccggttaccgttaccggtttccgggggacccggggtacgtacgggtacggtacgggtacggttaaccgtacggttaccggaacggttcggggtacggtccgtaccggtaccgtaccgttaaccgg

SEQ ID NO: 9226 - DNA, 644 bp, Homo sapiens
  misc_feature: GYAE6OF02GX1T0.45.5.A05.1.454.CMB.1.raw
  modified_base (358)..(358): a, c, t, g, unknown or other
  misc_feature (358)..(358): n is a, c, g, or t
  modified_base (395)..(395): a, c, t, g, unknown or other
  misc_feature (395)..(395): n is a, c, g, or t
  modified_base (438)..(438): a, c, t, g, unknown or other
  misc_feature (438)..(438): n is a, c, g, or t
  modified_base (472)..(472): a, c, t, g, unknown or other
  misc_feature (472)..(472): n is a, c, g, or t
tcagacgcgatcgacacgaccggtgctcgatttagatagatagacagggtgctgctgaggctgtaggtgctgtccttgctgtcctgctctgtgacactctcgtgggctgctatgctcgtgactcctggtatttacggacgactagttcgcggtcaccacgacctcctacctcctcccttcgtcccgtcctacccggtcggcgtacggtcccggccgacctactcctcgtacgccgtaccgtacgtacggtcggctccttactacaagtaacgaagtacggaaactactttagtttcgtaccgtacggtacctggacgagacggccgacgccgtcgtacgccgcacgtcgtaccgtacnccgagtctaccggccttccgtacggtcccggttacgnggtacgtccgagtacgacgttcgtcgaggtacgcgtagtaacnccgagtactacttcgttacctcgtacttacgaanagtacgtcggtacgtcggtcggtcgcgtagtacggttgttggtttgttgttacttacggctagcgtagtacgtgtacgtacggacgtaccgttacggtccggtccggggtaccggccgaggtcgtacgggtacgttacgaccgttacgacgtcggcgttagctacgtagtcg

SEQ ID NO: 9227 - DNA, 906 bp, Homo sapiens
  misc_feature: GYAE6OF02HF6QD.45.5.A05.1.454.CMB.1.raw
tcagacgcgatcgacacgaccggtgctcgatttagatagatagacagggtgctgctgaggctgtaggtgctgtccttgctgtcctgctctgtgacactctccgtggggctgctaatgctcgtggactccctggatttagtacggactagttgcggtacgacccagacctccactcctccctgtcccgtcctaccccgtgggccaggtccggcccgcctacttcctccgtcgcctaccggttcgtacggtcgggtactcccttacttacgaactaaactaaaggtacggtaaaacgtacttttagtttacggtacttcggttaccctaggacggaaggtaccggccgtaacggtcccgaaggtcccggcccgtaccgtacggttccgtacccgtacggtacccgaggtaccgtacgggtccctacccggaccgggttaccccggggtttcccgtagggtacggtacgtaccgtacgggaccgttacgggttaccgaacgggttacggaaccgtaacgggtactaccgaaacggtaaccacctttctttacctttaccaaccgttacgttaaacgaaaccgtttcccgtacggggttacccgttagggtaccgggtacccgtacggttagggaaccgggtttagtttacgggttttagggttaactttttaccgtacgtcgtaccgttacgttaccggtaacgttaacggttaccttaacgggttaacccggggttaacccggttaaacccgggtttacccgggggtttacccgggggaaccccgggggtttacgaccgggggtttaaccccgggttacgggggtaaccggttaaccgtaacgggtttaccggaaccggttttgggttaaccccggtaggttacccggtacccgttaccggttaaccg

SEQ ID NO: 9228 - DNA, 836 bp, Homo sapiens
  misc_feature: GYAE6OF02HL1XE.45.5.A05.1.454.CMB.1.raw
tcagacgcgatcgacacgaccggtgctcgatttagatagatagacagggtgctgctgaggctgtaggtgctgtccttgctgtcctgctctgtgacactctccgtggggctgctaatgctcgtcggactccctggtatttagacggactattggcggtacgaccagacctcctactcctccctcgtccgtccgaccccgtggctacggtccggcccacctatcctccctgcctaacgtcgtacggtcggacgtcctacttacaataactaagtagggaacttacttttagtttcgtacgttcggtaccagtacgtagggacggtccgaacggaccctacggtcccgaccgtcaccggtaccttccgtacgtccgaacgtccgtaccggtccttaccggtccgggtacccccggtttaccgagggtgttcgtaacgtacggtaccggtacggttacggtaacgggtcgggtaaccgtaaccgggtactaccggaacggactacgttacctttccgtttaccgaacctttacggtaaacgtaaaccgttccggtaaccgggttccggtccggggttacccgggtccgggttacgttaacgggtaggggttttagtttgggttttacgggtttaaacccttttggttaccggtacgtacggttagttacgggtacctagttaccggttacgggtaacccggttaccggttaccggttacccggggtccggggtaccccggggaacggtttcggtaaccggggttaaggacggttaacccgttaggggtacccttacggggttgaacccgggttcgtacccggtacgttacccttaccggg

SEQ ID NO: 9229 - DNA, 738 bp, Homo sapiens
  misc_feature: GYAE6OF02HNNM3.45.5.A05.1.454.CMB.1.raw
  modified_base (311)..(311): a, c, t, g, unknown or other
  misc_feature (311)..(311): n is a, c, g, or t
  modified_base (394)..(394): a, c, t, g, unknown or other
  misc_feature (394)..(394): n is a, c, g, or t
tcagacgcgatcgacacgaccggtgctcgatttagatagatagacagggtgctgctgaggctgtaggtgctgtccttgctgtcctgctctgtgacactctcctggggctgctaatgctctggatccctggatttagtacggacattgcggtgacccagactccactctccctgtccgtcacccctgggcaggtccggccgccatctcctgacctacgtctaggtcggacgtccttacttacataacaaaagttggaaaacgtactttagtttcgaactggtaacctgcagacggccaggccagtccgccgnacgctaccagtccagcacggtcttaccgagtcccggttcctggcgtgtccaagtacgtaggttaccaggttcggacaacggtntacgaagaccaacgtacttccgtttacaccttacgtaacgtaaactccgaacgttccggtcgttaccggcccggtacgtagggtaacgggttactttcggggtttttacggtttacgtttttaacgtttaccgtacggtacttaacggtacggtaaccgtaacgggttcgtttaagggttaaccccgggttaaacccggtttaacccggtttacccgtttacccgggggggacccgggggtaacccggtaacggggttccggtaacggggttaacggtaccgtaaaggttaacccgtaacggttttacggtaccgggtacctttcggtacccggtaaccttcgg

SEQ ID NO: 9230 - DNA, 920 bp, Homo sapiens
  misc_feature: GYAE6OF02HQDA0.45.5.A05.1.454.CMB.1.raw
tcagacgcgatcgacacgaccggtgctcgatttagatagatagacagggtgctgctgaggctgtaggtgctgtccttgctgtcctgctctagtgacactctccgtgggctgctaatgctcgtggacttccgtggtatttacggacggactagttcgtcggtcgaccctgactccactcctccctgtccgtcctaccccggtggctaccgggtccgcccggtcctacttccctacgtacgtccgtaacgttcgttaccggcggtaccgttcctactttaacgaacttaaaccgaaaaggttacggaactttaacttttacgtttacgttcgttacggttacctacggacgtaacgggaccgggcccaacgggtcccgtaacggtccgaccggtactaccggtccttaaccgttcgaacccgacggcggtaaccggttccgtaccggtacccggtcccggtttaacccggtaggtaacggttcgacgggaacgtttccggtaacgggtttacgtaacgggtacggtaacccggtaaacggtacggttaacccgaacccggtttagtaaacccgttttacgtttaccccgtttaacgtaacccgtttaaacgtaaacggtttaaaacccgtccggtaaaccggggtttcgggtaccgggttccccgggtaaccgttcggggtaaaggttcgggttagttttccgggtttttaagggttacgtttttaacgtccgttactaacggttacgtacgggtactacgggttaaccgtttaacggtacccgggttaaccggttaccggttcccggggttaaccggggggacccgggtacgggttaacgggtcgggttaaccggggtacgaacggttaccgtaacgggtacgttcggggaaccttccggacggttaccgttagttaccgg

SEQ ID NO: 9231 - DNA, 156 bp, Homo sapiens
  misc_feature: GYAE6OF01A6UB5.34.25.C03.1.454.CMB.1.raw
  modified_base (155)..(156): a, c, t, g, unknown or other
  misc_feature (155)..(156): n is a, c, g, or t
tcagtacacgtgatcacgaccggtgctcgatttagtagtgtagatttgggtttgggggaagaggaagactgacggtcctgccacagcggccctgggctgcctggtcaaggactacttccatcacgtgtactgagcgggctggcaaggcgcatagnn

SEQ ID NO: 9232 - DNA, 155 bp, Homo sapiens
  misc_feature: GYAE6OF01CZTH7.34.25.C03.1.454.CMB.1.raw
  modified_base (155)..(155): a, c, t, g, unknown or other
  misc_feature (155)..(155): n is a, c, g, or t
tcagtacacgtgatcacgaccggtgctcgatttagtagtgtagatttgggtttgggggaagaggaagactgacggtcctgccacagcggccctgggctgcctggtcaaggactacttccatcacgtgtactgagcgggctggcaaggcgcatagn

SEQ ID NO: 9233 - DNA, 552 bp, Homo sapiens
  misc_feature: GYAE6OF01AM78E.43.77.G11.1.454.CMB.1.raw
  modified_base (413)..(413): a, c, t, g, unknown or other
  misc_feature (413)..(413): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcacgcccccaaactcctcatctatcgtaccaccaatcggccctcgaggacgtccctgaccgattctctggctccaagtctggcatctcacgtccttcgtgccatcactggactcgagtcgagntgagtctgtattactacgtcgccgtagggtccgtagggactacgtcgacgtccgtagtacggtcggacctagttacgttcgttaccgttaccggaacccgcgtaacccgtacgggtaccctacccgtcgtaggtacccg

SEQ ID NO: 9234 - DNA, 681 bp, Homo sapiens
  misc_feature: GYAE6OF01AQTSJ.43.77.G11.1.454.CMB.1.raw
tcagtgtgagtagtcacgaccggtgctcgatttagctagtcactcaagggaaaggggtctgcttcagctgtggcacaagaggcagcactcaggaccagtctccagcatggcctggtcttctctcctcctcactctcctcgctcactgcacagggtcctgggcccagtctgtgctgacgcagccgccctcagtgtcgtcggggccccagggcaggagggtccaccgatcccctgtactggggagctagtttcaacagtcggggcaggtttggatgttaactggtaccagcaacttcgaggatcgacgaccccaactcctcatctatcggtaccaccaatccggcctcgacggtacgtccctacgaccgtatttccgtcgtacggcctaccgtaacgtctaggcctaacttcgtcctacgtcccctttacccgtcggtacccctaacgttcctaaccgttcggaacccttcccggtaacgggttccggaaacgggtacttacgggacgggtacccgttaggttaacttttaacgtttaacccgtcgggtaccccgtagggttacccgttacggggacctacgttaccgacggtccttaggacgttcggacccttaagtttctcggttccgttaaccgggaacccgtccggaaacccgaacggttcccgtaaccggttacccgg

SEQ ID NO: 9235 - DNA, 565 bp, Homo sapiens
  misc_feature: GYAE6OF01EGZKY.43.77.G11.1.454.CMB.1.raw
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcgggcaggtttggatgttaactggtaccagcacttccaggatcacgcccccaaactcctcatctatgtaccacaatcgcctcaggacgtcctgaccgattctctggctcagtctggcatctcagccttccngccatccactcgactcgagtcgagntgaggtctgattatacgtgccgagggtcctgggacctagtcgacgtccctggacggttcgggaccctagtttagtcgggtttcccgttacccggggaaaccccgtaccggtaaccccgtaacgggttaccccgtaaccccggtttccgtaacggggtaccccg

SEQ ID NO: 9236 - DNA, 730 bp, Homo sapiens
  misc_feature: GYAE6OF01BLCCK.43.77.G11.1.454.CMB.1.raw
  modified_base (242)..(242): a, c, t, g, unknown or other
  misc_feature (242)..(242): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagccgccctcagtcgtcgtcggggccccaggggcaggaggtcaccatcccctgtactgggacnctagtttcaacagtcggggactaggtttggattgttaactggtaccagactaacttccgaggactacaccgacccccaaactcctacactctactcggtaaccacctaacgtccggtaccctacgaacggtacgtcccgtacgacccgttacttccgtcgtacgggtacccttacccgaaagttcccgtcgggtacctacttccgtaccgtaacgttccccttttacccggccggtacccctaacgttaccgacccgttacggtaccccgttaccggaacgggttacggacggtagtcgggacggtctacggttaatttacgttaccgtcggtacccgaacggtcccgtagggtaacctacgtaccgacgtcccgtagggtaccgttccgggtaacttaacgttacggttccggttacccgtttacccggggaaaccctacccgggtaaccggtaaccgggttaccccgtaacccgggtttaacccgg

SEQ ID NO: 9237 - DNA, 619 bp, Homo sapiens
  misc_feature: GYAE6OF01E3FEH.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagcccgccctcagtgtcgtcggggccccagggcaggagggtcaccatcccctgtacgtgggagcagtttcaacagtcggggcaggtttggatgttaactggtaccagcaacttccaggatcacgcccccaaactcctcactctatcggtaccacaactcggccctcgacggacgtccctagacccgtattcgtcgtggtcctccgaagttctggctactcctcgtacgtcccttcctcggacccactccacgttcggacctcccgtaggtccgagggtacgtggacggtcgtagtaatttactaccgtcgtacccgtagggcccttaggggacctacgtccgtacgccgttaggtacggtcggtaccctagtttacgttcgttaccgttacccgggaacccgtaccggaaacccgtaacgggtcccgacccggttaccgg

SEQ ID NO: 9238 - DNA, 629 bp, Homo sapiens
  misc_feature: GYAE6OF01B5L0O.43.77.G11.1.454.CMB.1.raw
  modified_base (240)..(240): a, c, t, g, unknown or other
  misc_feature (240)..(240): n is a, c, g, or t
tcagtgtgagtagtcacgaccggtgctcgatttagctagtcactcaagggaaagggggtctgcttcagctgtgggcacaagaggcagcactcaggacagtctccagcatggcctggtcttctctcctcctcactctcctcgctcactgcacagggtcctgggcccagtctgtgctgacgcagccgcctcagtgtcgtggggccccagggcagagggtcaccactcccctgtactggggancagtttcaacagtcggggctagggtttcggattgttaactggtaccagcaacttccaggatcacgacccccaaactcctacactctatcggtacccaaccaacgtccggccctacgacggacgttccccgtacgacccgtatttcctcgtcggccttacccaagttccgtgggcctagttcctcacgtccttccgtcggtcccatccacgtcggacctccgagggtccgaggtacgtggacggtctagtacttacttacgacggtacctacggtccgttcggggactacgtaccgaccggtcgtaggacggtcggtccgtaagtttcgtaccggttacgtttacccgggacccgtaccggaaccgaacggtcccgtaccggttacccgg

SEQ ID NO: 9239 - DNA, 530 bp, Homo sapiens
  misc_feature: GYAE6OF01BIU8H.43.77.G11.1.454.CMB.1.raw
  modified_base (287)..(287): a, c, t, g, unknown or other
  misc_feature (287)..(287): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (474)..(474): a, c, t, g, unknown or other
  misc_feature (474)..(474): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtctgggccccagggcagagggtcaccatcccctgtactgggagcagtttcaacatcggggcaggtttggatgttaactggtaccagcaacttcaggntcacgcccccaactcctcatctatgtaccaccaatccgccctcgaggacgtccctagaccgtattctctggctaccagtctgcatctcactcccttctcggcctactcactggacctcgagtcgagntggagctnacttatctcgaccgacgtcgtgggacagtcacgctgacgtgcccgtattagngttcccgttacggaacccgtacgacccgaacggtccgacccgtccgtaggtacccg

SEQ ID NO: 9240 - DNA, 634 bp, Homo sapiens
  misc_feature: GYAE6OF01DV9BL.43.77.G11.1.454.CMB.1.raw
  modified_base (381)..(381): a, c, t, g, unknown or other
  misc_feature (381)..(381): n is a, c, g, or t
  modified_base (470)..(470): a, c, t, g, unknown or other
  misc_feature (470)..(470): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagcccgccctcagtgtccgtcggggcccccagggcaggagggtccaccactcccctgtacctgggacgcagtttcaacagtcggggctagggtttgattgttaacgtggtaccagcaacttccgaggtatccacgccccaaactcctcatctatcgtaaccaccaagtccggccctcgaggtaccgtccctagacccgtattccnctcggccttaccgaaagtccgtggcctacttccgtctacgtcccttaccgtccggcctactcacgtcggacctccgagggtcgagtagnggacggctgtaagttacttacgtcgcccgagggtcccttcgggaactatcgacggtacctggtacgtgggtaccctagtttaaccgtcggttccctttaacggggaaaccccgtccggtaaccccgtaaagggttcccaaccccgggttcctaacgggtacccg

SEQ ID NO: 9241 - DNA, 753 bp, Homo sapiens
  misc_feature: GYAE6OF01DY1PO.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctctactgcacgtacggtcctcggccctagtctgtgctgacgcacgcccgccgtgagtcgtcgtcggggccccgagggccaggacggtccaccacttcccgtgtacgtgggactcgtagtttacaacgtaggttccggggtacttagggttttacggagttacggtttaaccgtcggtaaccacggtacctaaaccgttccgaggtaacttaccggaacccgtacccccgtaaacttccctactaacttactacgtaccgtaacccaacgtaacgtccggccctagtacggtacttaccccgtagtaacccgttcgttccgtcgtacggtccgtaaccgtagtctggacctcgttacctaccgtacgtccgttccgacgtaccctaagtccgtacgtaccggtacctaccggtaggtaccgtaaggtaccgttaggacggttaccttaaggttacttttaacgtaccgtccggtaacccggtacggtccggtacggtactacgtaccgtacgtaccggtaggtaccggtccgttacttacgtttacggttcccgttacggtaacccggggaccgtaccggaaacccggttacggttcccgtaccggttaccgg

SEQ ID NO: 9242 - DNA, 912 bp, Homo sapiens
  misc_feature: GYAE6OF01DDJ3R.43.77.G11.1.454.CMB.1.raw
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtcgtcggggccccagggcaggagggtccaaccactcccctgtacgtgggagctaggtttccaacagtcggggctaggttggattagttaactgtaccagacaactccagactcgacgaccccaaactcctacactactagtacggtaccaacctaacgtccggccctagacggtacgtaccccgtaggaacccgtactttcgtactcgggtacctaccgaacggttccgtaggtaccctaattccgttaccaacggtccctttacccgtcggtacccctaagttacccgtaccgttacgggtaaccctttcccgggaacgggttaccggtaaagggttacgtacggggtaacgggttaccgttaacggtttaaacgttttaacgttaaccggtaccgggtaaccccggttaacgggggtacccggttaaccgggggtaaccttaacccggttacccgggtaaaccgggttaccccggttacgggggtaaaccggggtttacccgggtaacccgtttttaaaacgggtttaacccgggtttttaccggggttttaaaccccccgggggtttttaaacccccggggaaaaaacccccccggggtttaacccggggttaaaaaaaccccccgggttaaaacccgggggttttaccccccccgggttaaaaaccccgggggttttacccccggggtttaaacccggggggttaaaacccccccggg

SEQ ID NO: 9243 - DNA, 727 bp, Homo sapiens
  misc_feature: GYAE6OF01CXSNT.43.77.G11.1.454.CMB.1.raw
  modified_base (244)..(244): a, c, t, g, unknown or other
  misc_feature (244)..(244): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctcgggcccagtctgtgctgacgcacgcccgccctcagtgtcgtccggggcccgagggcaggcggtccaccactccccgtgtacgtgggancgtacgtttacaacgtacggtccgggggacttagggtttaggtagttacggtttaaaccgtcgggtaaccacggtacctaaccgttccgaaggtactaccgacccgtaccccctaaacgtccctactacttacctacgtaccggtaaccccaaaccgtaacgtcccggtacccctagacggtaccgttccccgtacgaaccctacgtttccgtcgtcggcctaccgtagtccgtggtcctactcctaccgtaccgtcccttaccgtacggtaccctactccctacgtacgtaccgtaccgtacgggtacggaggtactggacgtcttagtatttaacgtcgtaccgaccgtacggtaccgtacgggactacgtcgtacggtccgtggtacggtcggtacctagtttacgttccggttccggttaaccggaacccggttaccgaaaccgtacggttccccgaacccggttcgtaccggtacccg

SEQ ID NO: 9244 - DNA, 879 bp, Homo sapiens
  misc_feature: GYAE6OF01BA0OM.43.77.G11.1.454.CMB.1.raw
  modified_base (246)..(246): a, c, t, g, unknown or other
  misc_feature (246)..(246): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcacgccgccctcagtcgtcgtcggggccccagggcaggacgggtccaccactcccctgtacgtggganctagtttcaacagtcggggctagggtttgattgttaacgtggtaccagactaacttccgaggtactccgaccgaccccctaaactcctacacttcctaagtcggtaacccacctaacgtcccggaccctacgacgggtaccgttccccgtacggaacccgtactttccgtccgttcggtacccttaccgtaacggttcccgtacggtaccctacgtttcccgtaccgttaacccggttcccccgttttaccccggtaccgggttaccccctaaaccgttaccccgtaaacccggtttaccgggtaaccccgttaacccgggttaacggggtttacccggaaacggggttacgttacggggaaccgggttaccgtttaacggttaacgtttttaaccgtttaacccggttaccgggtacccccggttaaccggggttaccccgggttaacgggggtaacccttaacggttaacccggaaaccggttcccggttaacgggttacggggttaccggtacccgtttaaaggtttcccgttaccgggtttaccccgggttaacccggggtaaacccccggtacccgggtaaaaccccggttaacccgggtaccccgttaaccccgggttaaccccggg

SEQ ID NO: 9245 - DNA, 640 bp, Homo sapiens
  misc_feature: GYAE6OF01BO8SO.43.77.G11.1.454.CMB.1.raw
  modified_base (422)..(422): a, c, t, g, unknown or other
  misc_feature (422)..(422): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctctcactctcctcgctcactgcacagggtcctgggcccagtctgtgctgacgcagccgccctcagtgtcgtcggggccccagggcaggacgggtccaccactcccctgtacgtgggacgctagtttcaacgagttcggggctagggtttggatagttaactggtaccagctaacttcgaggactccgacgaccccctaaactccctacactcgtaatcggtaacccaaccaatcccggaccctacgacggtacgtccctgacccgtatctcgtggcctaccgaagtctaggctagttccnctaccgtcctttccgcgtaccctatccacgtcggacctccggtaggtacgaaggtcgtaggacggtcctaggtacttttacgtcgtacgaccggacggtccgtacgggactactacgctaccgtagtcggtcggtacctagtttataccggttccgttaaccgggaaccgtaccgtaacggtaaccgtaccgtaacccggttacgtcggtaaccccgg

SEQ ID NO: 9246 - DNA, 626 bp, Homo sapiens
  misc_feature: GYAE6OF01CNOFE.43.77.G11.1.454.CMB.1.raw
  modified_base (236)..(236): a, c, t, g, unknown or other
  misc_feature (236)..(236): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtcgtggggccccagggcagagggtcaccatcccctgtactgggacncagtttcaacagtcggggcaggtttggattgttaactggtaccagcaacttccaggactcacgcccccaaatcctcatctatggtaaccaccaatccggccctacaggactccctgacccgattctctggcctcaagttcnggctatctcacgtccttccgnggcctataccacgtcggacctccgtacgggtccgaggtactaggacggtcttgaactttattaaccgtagtcccgaagggtccgtaggggacctagtccaacggtccgtaggtacggtcggtacctaagtttagtacggtttacccggttaccggggaaaccccgtaccgggtaaacccgaaccgggttaccctaaccccgggtttaccggttaacgggtaaccccgg

SEQ ID NO: 9247 - DNA, 652 bp, Homo sapiens
  misc_feature: GYAE6OF01EPJ88.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagcccgcctcagtgtccgtcggggccccagggcaggacgggtccaccactcccctgtaccgtgggacgctagtttcaacagtcggggctaggtttcggattagttaacgtggtaccagactaacttccaggtactcgaccgacccccaaactcctactactactagtacggtaacccaacctaacgtcccggcctacgaggtacgtccctagaccgtacttccgtctacggcctaccaagtccgtcggactactccgtaccgtacgtcccttcgtcggacctacgtcacgtcggaccttcgacggttacgaaggtactacggacggtctagtaactttaacttaccgtacggtacccgtacgggccgtacggactactaccgagtccgtagtacggtaccggcttaagttcgtacggttacccgtacgggaacccgtacggtaacccgtacggtcccgtaacccggttaccgg

SEQ ID NO: 9248 - DNA, 670 bp, Homo sapiens
  misc_feature: GYAE6OF01ASQP2.43.77.G11.1.454.CMB.1.raw
  modified_base (262)..(262): a, c, t, g, unknown or other
  misc_feature (262)..(262): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcacgcccgcctcagtcgtcgtcggggccccagggcaggacgggtccaccacttccccgtgtaccgtgggacgctagttcaacgngtcggggactagggttgattacgttaacgtcggtaccagtacctaacttccgaggtactaccgacccgtacccctaactcctacgtacttacgtacgtcggtaacccaccgtaacgtcccggacctacgtaacggtaccgtacccgtacgaaccgttactttccgtcgtcgtacccgtactaacggttccgtcggtacctacgttccctccgtacccgtcccgtttccggcgtacccctacgttaccgtacgttccggaacccgttcgtaacgggtacgaggtcgtacggacggtcttacggtaatttacgttcgcgtacgtcgtcgtaggacctgtcctagtccgtgaggtcgacttacgttcgtcggttacctacggacccgacgaaccgtcggtctcccggtacg

SEQ ID NO: 9249 - DNA, 810 bp, Homo sapiens
  misc_feature: GYAE6OF01BG6YN.43.77.G11.1.454.CMB.1.raw
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagcccgcctcagtgtcgtcggggccccagggcaggagggtccaccactccccgtgtaccgtgggagtctacggtttcaacgagtccggggtcgtagggtttaggattagttaacgtcggtaaccagtacctaaccttccgaaggtactaccgaccgacccccctaaaacttccctactacgttacctaacgttaccggtaacccaacccgtaaacgttcccgggacccctaccgacgggtaccgttaccccgtacgaacccggttactttccgtaccggttcggtacccttacccgtaaacggttccgtcggtacctaacgttcccgtaccgtaaccggttccccttttacccggaccgggttacccctaacgttccccgaaccggttaccgggtaaccccttacccggtaacggggtaccgggtaaaggttacggttacgggacgggttaccgtttaggttaacttttaacgttaccggtacggtacccggtacggtaccggttacggggactacgtacgtaccggtaccgtcggtacggttcggtaaccgtacggtttagttaccggttcccgttaaccgggaaccgtacggtaaccgtacggtacccgtacccgttacgtaacggtacccg

SEQ ID NO: 9250 - DNA, 796 bp, Homo sapiens
  misc_feature: GYAE6OF01AOI92.43.77.G11.1.454.CMB.1.raw
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacgagggtcctgggcccagtctgtgctacgacgcacgcccgccctcagtgtcgtcgggccccagggcaggacgggtcaccactcccctgtacgtgggagcgtacgttacaacgtggtcggggacgtagggtttggagttacgttaaccgtcggtaacctagaccgttaaccttaccggaagggtactacccgtaacccggaacccccctaaaccgttacccgttacctaacttaccgttaactaccgggtaaaccctaaccgtaaaccgtccccgggtaccttaccggaacgggtaccgtaccccgtaggtacccgttaactttccgtaccgtccggtaccttacccggtaacgttccgtacggacctaacttccgtacgtacccgtccgtttcccgtacgtaccctacgttaaccgtaccgttacggacccttaccgggtaccgggttacgaacgggttacgtacgacggtttacttacgttaaacgttttcgttaccgaccggtaccccggtacggttcccggaagggtactaccgtacgaccgtcgtaggtccggtacgtaccttagttacggttacggttaccgtacccgggaacccgtacgtaaacccggtacgtacccggtacccgttacggttacccggaaccg

SEQ ID NO: 9251 - DNA, 757 bp, Homo sapiens
  misc_feature: GYAE6OF01CGODI.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcacgccgccctcagtgtcgtcggggccccagggcagagggtcaccgactcccctgtacgtgggagctagtttcaacagtccgggactagggtttggagtgttaaacgcggtaccaggccaaccgtttccgagggtactaccgaccgaccccccgtaaaactccgttacaactacctaacgtaccgggtaaccccaccgtaaaaccgtcccggcccctacgacgggtaccttaccccgtaggtaccctaactttccgtacggtcggccttaccgtaacggtccgtcggacctacgtcctcctaacggtccccttccgtcggacctacgtcgtaaccgtcgtaccgtccgtaaggtcgtacggacgtgggtacggtaccgttagttaactttacgttaccgtcgggtacccgtacggggtacccgttagggtaaccctagtaccggtaaccggtccggttaacggacgggttaccggtacccttaaggtttaccgttcggttaacccggtttaacccgggaaaccccgggtaccgtaaacccggtaaccgggttcccccgtaaccccgggtttaccccggg

SEQ ID NO: 9252 - DNA, 702 bp, Homo sapiens
  misc_feature: GYAE6OF01AXF50.43.77.G11.1.454.CMB.1.raw
  modified_base (631)..(631): a, c, t, g, unknown or other
  misc_feature (631)..(631): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctcgggcccagtctgtgctgacgcacgccgccctcagtgtccgtcggggccccagggcacggagggtccaccactcccctgtacgtggagctagttcaacaggtcgggactaggttgatgttactcggtacagctactcgagtactcaccgacccctaactcctactatctacgtacgtaccaacctaacgtcccggtaccctagaacggtaccgtccccgtaagtacccggtactttcctccggttagccccttaaccgtaaacggttccgtcggtactaccgttacctccgttaaccgttccccgttccgtaccgggtcctaacgttcccgtaacggttccggtacccttacccgggaaggttaccgggaaggtagtacgggtacgagtttcgtaacgtttactcgttaccggaccggttacgggtccgttagggtactacgtacggccgtacggtgtacggtacgtacctagttntaaccggtccgtaaccggaccggtaccgtaaaccgtaccgttaccgtacccgttccggtaacgggtccccg

SEQ ID NO: 9253 - DNA, 794 bp, Homo sapiens
  misc_feature: GYAE6OF01CX2S9.43.77.G11.1.454.CMB.1.raw
  modified_base (162)..(162): a, c, t, g, unknown or other
  misc_feature (162)..(162): n is a, c, g, or t
  modified_base (190)..(190): a, c, t, g, unknown or other
  misc_feature (190)..(190): n is a, c, g, or t
tcagtgtgagtagtcacgaccggtgctcgatttagctagtcactcaaggggaaagggggcttcagctggtgggcacaagaggcagcactcaggacagtctccagcatcggcctggtcttctctcctctcactctcctcgctcacgtgccaacgcgggttccncgggccctagtccgtgtcgctacggacnccgacggtcccgtaccctcgtaggttccggtccgggtaccgggggacccccgaaggggctaacgggacgggtacccaaccgtacgttccccgtaggtacggcgggacgtacgttacgttaccgaacgtcggtaccgggtgtaggggtttgaacgttacggttaacgtcggtaaccacggtacctacgttacggaacggtacctaccgtaccccgaaccctaactccttacgaacttaccgtaacgtaccgtaacccaccggtaacgtccccggacctacggtaaccgtccgtccgacgttaccgatttccgcggtcgtacctttacgattcgcgacttacgtcctcgtaccgttcccttcggcctacgtacctacgtacggaaccgtcgtaccggagggttcgaaaggttaccaggtacgtgttacgttatttaaccgttcggaaccggttccggaaccgggttcgaccgggacttaccgacgggtccgagtttacggacccgtttcggaaccttacggttacgtcccggttaacccggaacccggtaaccaacccggtaaaccctaccgggttacccttacccgggtaacgtacccggaccgg

SEQ ID NO: 9254 - DNA, 864 bp, Homo sapiens
  misc_feature: GYAE6OF01EUA7Y.43.77.G11.1.454.CMB.1.raw
  modified_base (424)..(424): a, c, t, g, unknown or other
  misc_feature (424)..(424): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctctcactctcctcgctcactgcacgacgggtcctcgggcccagtctgtcgctgacgcacgcccgcctcagtcgtcggtcgggcccgagggcgaggacggtccacctaccttcccgtaggtaccgtgggacgtacttacgttacaacgaggtacgggcgttagggtttacgatttacggttaacgtcggtaaccgagtacctaacgttcgaaggactaccacccgtacccctaactcctactactacgtagtaccgtacccacgtacgtccggcctacggacgtaccgttcctacgaccgttnttccgtcgtcgtacctacgtaacggtccgtagtctcgttaccgcgtaccgttcccgtttaccgacggtacctacgttacccgtaccgggtccggtaacccgttacgggtaacggggttcgaacggttacggtacgggtaacggttaccgttttaagggtttaaccgtttaccgtttaacccgtaccgggttaccccggtaccggggtttaacccggacggttaaaccgttccggttaacccgggacccggttacgggttacggggtttaaccccggtaaggttttaccccgtttaaaagggtttttacccgggtttacccggtttaaacccgggggtaaccccccggtaaaccggtaaccccgggttaaaccccgggtttaaccccgggttccccgtttaaaaccccggggttacccgggttaacccgggaaacccccgg

SEQ ID NO: 9255 - DNA, 976 bp, Homo sapiens
  misc_feature: GYAE6OF01BT8X8.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacgacgggtcctgggcccagttctgtgctgacgcgtacgcccgtccctcaggttcgtccgtaccggggccccgagggaccgaggtacgggtaccaccctaccgtacccccgttaggtaccgttggggacgtaccgtaacggttttaccaaacggtacgttccgggggtacttaggggtttacggtacttaggtttaaccgtacggtaccgacgtacctaaccgttccggaggacttaccgacccgtaccccgtaaacgttccctacgtaacttccgttaagtaccggttaacccaaacccgtaacggttccccgtacccgttacggaaccgggttaccttaccccggaacggttaccccgtaacgtttcccgttacccggttacggtaccccgtttaccctaaagggttacccttcggggttaccaacctttttcccggtaacccgtaacccggttttcccccggttttaccgtaaccccgggttaccccttaaacccggtttccccggtaaaactttccccgggggtaaacccccgtttacccgggttaaaggggttaaccccgggtaagggttaaccgggtttaccgggtaacggggttctttaaccggttaacccgttttttaaccggtacccggttaccggtaacccggttacccggggtaacccggttttaacggggacccttaaacgttacccgggtacgttaccccgtagggttaccgggttccggtaaccgttagtttaccgggttaccgtacccgggttaaccgggtacccctaacggggttaaaccgcccgggtttaccgtaccccggttaaccgggg

SEQ ID NO: 9256 - DNA, 588 bp, Homo sapiens
  misc_feature: GYAE6OF01DHMBD.43.77.G11.1.454.CMB.1.raw
  modified_base (236)..(236): a, c, t, g, unknown or other
  misc_feature (236)..(236): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacacgggtcctgggcccagtctgtgctgacgcagcccgccctcagtgtctcggggccccagggcagagggtcaccatcccctgtacgngggagctagtttacaacagtcggggctagggtttggattgttaacgtcggtaccagacctaacttccgaaggtactccacgacccccaaactcctacatctacgtacgtacccaacctacgtccgcctcgaggtactcccgtgtaccgtattcctcgtacgcctacaacgtctggctctctacgactccttcgcgacctatctacgcgtacctccgtacggtcgaggtacgtggacggtctagaatttataccgtcggcctacgggccgtagggaccagtccacgtccgtagcgtcgactattcgtcgtaccgtaccggaaccgtcgaaccgtacggtccctaccggtaccg

SEQ ID NO: 9257 - DNA, 843 bp, Homo sapiens
  misc_feature: GYAE6OF01DWVVS.43.77.G11.1.454.CMB.1.raw
  modified_base (191)..(191): a, c, t, g, unknown or other
  misc_feature (191)..(191): n is a, c, g, or t
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacgacgggtcctcgggcccagtctgtgctgacgcacgcccgccctnaggtcgtcgtccggggcccagggcaggacggtaccaccactccccgtgtacgtgggactcgtagttacaacgtggtcggggtactagggttgacttagttaacncggtaccagtacctaacgttccgaggactccaaccgaccccctaaactccnctatacgtagtaccgtaacccaacgtacgtccgggacctacggacggtaccgtcccgtacgtaaccgtctttcccgtcgttacgggacccttaaccgtaacggtttccgtacggtaccttacgttaccctaccgtacgttccccgtttccgtaccgggtaccctacgttaacccgtaccggttaccggtaaccgtacccggtacgggttacggtaacgggtacggtacggttaacgggttcctttaaaggttaaccgtttttaaccggttaaccgtacgggtaacccggttaaccggggttccggttaaacgggacccttaggtacccgaaccgggttaccggtacggtaccgggttaaccggttaccgtttaaacggttttacccggttacggtttaacccggggtaaaccccgggaccccgggtaacccgtaaacccgggttacccggttaccccgggttaacccttaaccggggtacccggttaaacccccggg

SEQ ID NO: 9258 - DNA, 793 bp, Homo sapiens
  misc_feature: GYAE6OF01BDSRS.43.77.G11.1.454.CMB.1.raw
  modified_base (190)..(190): a, c, t, g, unknown or other
  misc_feature (190)..(190): n is a, c, g, or t
tcagtgtgagtagtcacgaccggtgctcgatttagctagtcactcaagggaaagggggcttcagctgtggcacaagaggcagcactcaggacagtctccagcatgctggtcttctctcctctcactctcctcgctcactcgcacgacgggtccgtcgggccctagtctgtcgctgacgcacgccgcctcngtgtcgtacgggcccaggcagacggcacctctccctgtacgtggagctagttacgaagtcggtacggagtacggttgtagttagttaacgtcggtaccagtaccgtaactccgagtactccaccgacccctaacgtcctactacgtactacgtcgaacctacgtaccgccgaccgtacgacgtccgtaccgtacgtaccgtacttcgtcccgtagcccgttaacgtacgttcgtacggaccgttactccgttaaccgttccgttccgttccggtacccggtcttaccgttcccgtacgttaccggaccggtaccggtacggtaacccggtaggtaccgttacggggtaactcggtttacttaaacgggtttacctaacggtacccggttacccggaacgggttttccccgggaaaagttccccggttaaagtacccggttaacccggtcgggttaaccggttaaccgggttaccgtttaacccgttaggtttttaccccgggtaaccggtttaccccgggttaacccgggaaccgtaccccgggttaaaccgtaccgggttaacccggttacccggtaaccggttaccccgggttaaacccgg

SEQ ID NO: 9259 - DNA, 804 bp, Homo sapiens
  misc_feature: GYAE6OF01A2B34.43.77.G11.1.454.CMB.1.raw
  modified_base (663)..(663): a, c, t, g, unknown or other
  misc_feature (663)..(663): n is a, c, g, or t
tcagtgtgagtagtcacgaccggtgctcgatttagctagtcactcaaagggaaaggggtctgcttcagctgtgggcacaagaggcagcactcaggacagtctccagcatcggcctggtcttctctcctcctcactctcctcgctcactgcacgacgggtccgtcgggccctagtcgtgtgcgtagaccgcacgcccgtccctgagtcggtccggtccggggaccccgaggggaccgagggtacgggtacccaaccccgtaccgttcccccggtaggttaaccggtggggaactccgttaacgtttaccgaaaccgtacgggttccggggtacgttaaggggtttacggtaacgtttacggtttaaccggtaccgggtaaccgtacgtaccgttaaccgttaccgaacggtacctacccgacccgaacccctaactccgtactacttacgtacgtaccgaacctaccgtacgtccgtaccgtagcgtaccgtcccgacgtacctacttcgtcgtacgtacctacgtacgtctgacctactctctaccgtcctaccgtcgccgtaactccgtaacgtcggacccgtacgtacggtacgacggtagtcggacttacgttgttaacttcgttaacccgtcgtaaccgtcgggtaaccgtacggtacnccgtaccggttacggtccggtaggttaaccggttacgtacctttacggttaccggttaacccggttacccgggtaacccggtaaacccggtcccggtaaacccgggtttacccggttccccggtaacccggttaaccccgg

SEQ ID NO: 9260 - DNA, 856 bp, Homo sapiens
  misc_feature: GYAE6OF01D47Y1.43.77.G11.1.454.CMB.1.raw
  modified_base (248)..(248): a, c, t, g, unknown or other
  misc_feature (248)..(248): n is a, c, g, or t
  modified_base (472)..(472): a, c, t, g, unknown or other
  misc_feature (472)..(472): n is a, c, g, or t
  modified_base (514)..(514): a, c, t, g, unknown or other
  misc_feature (514)..(514): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacgtagggtccctaggcccagttcgtgtgtctggacgcacgcccgccctacgagtgtccggacgggcccgagggcaaggacggtcaccacgtccctgtaccgngggactacgtagttaccgaacgacggtacgggggctaaggggtttaggaacgtttacgtttaaaccgtcggtaaccgaactaccgtaaccgttaccgaacggtaactaccgaacccgtaacccccgttaaaacctccgtactaacgttcttaaacggtccggttaaacccaaccgtaacgttcccgggccctaacggaacggtcctcccggtacgtaacccgtntttcgacgtacgtaccgtaccgaaggtttcgacgtaaccctnttccgtaacgtaccgttccccgtttaccgaccggtaccttaaccgttacgtaaccttacgggtaacccgttacccggtacggggtaaccgggtaagggtaacgtaacgggtaaccggttacgttaacgtttaaacgtttaacgttaaccgtcccggtaacggtacccgggtaccggttaacggggaaccttaccggttacggtaccgggttacccgtagggtacccgttacggtaccgtttaaacgtttacggtaccggtttacgtaaacccgggaacccggttaaccggtaaccccgtaacggttacccggtaacccggttaccggaaccgggtaaccccg

SEQ ID NO: 9261 - DNA, 549 bp, Homo sapiens
  misc_feature: GYAE6OF02GH9H0.43.77.G11.1.454.CMB.1.raw
  modified_base (237)..(237): a, c, t, g, unknown or other
  misc_feature (237)..(237): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggancagtttcaacatcggggcaggtttggatgttaactggtaccagcaacttccaggatcagcccccaaactcctcatctatggtaccaccaatccggccctcaggacgtccctgacccgattctctggctccaagtctggcatcctcagtccttctggccagtcactcggacctccgaggtcgaggatggaggtctgattattacgtgcctaggtccgtgggactagtcacgtccgtagacggtcggacctagttacgtcgttccgttaccgggaaccgtccgtaacccgtaacggttcccaccggttacccgg

SEQ ID NO: 9262 - DNA, 530 bp, Homo sapiens
  misc_feature: GYAE6OF02HJRGA.43.77.G11.1.454.CMB.1.raw
  modified_base (389)..(389): a, c, t, g, unknown or other
  misc_feature (389)..(389): n is a, c, g, or t
  modified_base (506)..(506): a, c, t, g, unknown or other
  misc_feature (506)..(506): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcacgcccccaaactcctcatctatggtaccacaatccggcctcaggactccctgaccgattctctggctccaagtctggcatctcagtcccttccnggcccatccacgtcggacctccgaggtcgaggatggacggctgattacttacgtcgccgtaggccctgggacagtcagccgtgacggtggacctattactcgtcctaccgggaaccncggaaccaaggttccaccgtccgg

SEQ ID NO: 9263 - DNA, 548 bp, Homo sapiens
  misc_feature: GYAE6OF02G7WRB.43.77.G11.1.454.CMB.1.raw
  modified_base (359)..(359): a, c, t, g, unknown or other
  misc_feature (359)..(359): n is a, c, g, or t
  modified_base (447)..(447): a, c, t, g, unknown or other
  misc_feature (447)..(447): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagcccgccctcagtgtcgtcggggccccagggcaggagggtcaccactcccctgtacgtgggagctagtttcaacatcggggcaggtttggatgttaactggtaccagcaacttccaggatcacgcccccaaactcctcatctatgtaccaccaatcggcctcaggacgtcctgaccgtnttctctaggctacaagtctggcatcctcacgtccttcctggaccatcacgtcgacctccgaggtcgaggtatggagctagatttatcngaccgaggcctgggactagtcgacgtcctggtacgtggacctagttctcggttaccgtaccggaaccgtaccgaaccgtaacggtccgacccggttaccgg

SEQ ID NO: 9264 - DNA, 544 bp, Homo sapiens
  misc_feature: GYAE6OF02GCW5Z.43.77.G11.1.454.CMB.1.raw
  modified_base (387)..(387): a, c, t, g, unknown or other
  misc_feature (387)..(387): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcacgcccccaaactcctcatctatggtacccacaatcggccctcaggactccctgaccgattcctctcggctccaagtctggcatctcagccttccnggccatcactcgactccagtcgagntgagctgattattacngccaggcctgggactatcagccgtggagtcggacctagtttacgtcggttaccgttaccgggaacccgtccggtaacccgtaaacgggtcccaacccggttccgtaacggtacccg

SEQ ID NO: 9265 - DNA, 829 bp, Homo sapiens
  misc_feature: GYAE6OF02F5R5S.43.77.G11.1.454.CMB.1.raw
tcagtgtgagtagtcacgaccggtgctcgatttagctagtcactcgaaggggaaaggggcttacgagctcgtgggcacaacgaggcagcactcaggacaggtctccgacgcgatggcctggtcttctctcctcctcactctcctcgctcactgcacgacggtcctggcccagtctgtgctgtacgcagccggcctcgagtcgtcctcggggcccccgaggggccgaggacgggtcgaccgtacgtccccgtgttaaccgttgggagtcgtaagtttccgaaaccgtaacgttccgggggactaaggggttttcggagttacggtttaaaccgtacgggttaacccgacggtacctaaaccgtttacccgaagggtaactttacccggaaccggtaccccccctaaaaaccgttccccgttaaccgtaaacttccgtttaacgttaccgggttaacccaaaacccgtaacgttacccgggacccctttacgaacgggtaccgttaccccgtacggaaccccggtacgtttaccgtcgttacggtaccttaccgtaaagtttccgtacgggtacctaacgtacgttaccgaaccggttcccgttttccgtcggtaacccctagttacccgaaccgtttacgggtaacccgtacggtacgggttccggacgggtacggttacgggaacggtccgtagttaactttacgtttaaccgccgtacccgtaacgggtccgtaccgggactaaccgtacgaccgtcgtggtacgtcggacctgttaacgtcgttccgtacgaaccgtcgaccgaacggtcaccgttccgagtacccg

SEQ ID NO: 9266 - DNA, 621 bp, Homo sapiens
  misc_feature: GYAE6OF02IOII7.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagccgccctcagtgtctcggggcccagggcaggagggtcaccactcccctgtaccgtgggagcagtttcaacatcggggcagggtttgatgtaactggtaccagcaacttccaggatcacgccccaaactcctcatctactggtaccaccaactccggcctcgaaggtactccctgaccgtattctctcggctaccaagtcctggactactctcacgcctttccgtcggcctagtcactcggactccaagggttccgaggtacgtggaacggtcgtagtactttaattaccgtgtacccgagggttaccccttaggggacctaacgttaccgacggttcccgtaggacgggttcggacccttagttttaacgttccggttaccgttttaccggggaacccgtccggtaaacccgtaaacgggttcccaacccggttacccgg

SEQ ID NO: 9267 - DNA, 626 bp, Homo sapiens
  misc_feature: GYAE6OF02F4TY4.43.77.G11.1.454.CMB.1.raw
  modified_base (464)..(464): a, c, t, g, unknown or other
  misc_feature (464)..(464): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtcgtggggcccccagggcaggagggtccaccatcccctgtacgtgggagcgtagtttcaacagtcgggggctagggtttggatgttaactggtaccagcaacttccgaggatcgacgacccccaaactcctcatactatcggtaacccaaccaacgtccggaccctcacggtacgtccctagaccgacttctcgtcggctaccaagtctggctatctcacgtcccttcgcgcctatcacgtcggacctccacgggttcgaggtcgtggacggtnttacgtatttacgttactccggaccgtacggggtcctaggggactacgttacgacgtccgtagtacggtacgtcccgttaattacgttcggttaccgtttaccgggaacccgtcggtaacccggtaacggtcccgtaaccccggttccgtacgggtaacccg

SEQ ID NO: 9268 - DNA, 693 bp, Homo sapiens
  misc_feature: GYAE6OF02GPVVM.43.77.G11.1.454.CMB.1.raw
  modified_base (509)..(509): a, c, t, g, unknown or other
  misc_feature (509)..(509): n is a, c, g, or t
  modified_base (526)..(526): a, c, t, g, unknown or other
  misc_feature (526)..(526): n is a, c, g, or t
  modified_base (569)..(569): a, c, t, g, unknown or other
  misc_feature (569)..(569): n is a, c, g, or t
  modified_base (592)..(592): a, c, t, g, unknown or other
  misc_feature (592)..(592): n is a, c, g, or t
  modified_base (661)..(661): a, c, t, g, unknown or other
  misc_feature (661)..(661): n is a, c, g, or t
tcagtgtgagtagtcacgaccggtgctcgatttagctagtcactcaagggaaaggggtctgcttcagatgtgggcacaagaggcagcactcaggacagtctccagcatggcctggtcttctctcctcctcactctcctcgctcactgcacagggtcctgggcccagtctgtgctgacgcacgccgcctcagtgtctcggggccccagggcagagggtcaccgactcccctgtacgtgggagcgtacgtttccaacgacgttcgggggccgtaagggtttggaattcggttaaacgtgggttaacccaggaccctaaccgttccgaaggtacgtaccaaccgaccccccctaaaactcccgttacactttacctaagttccggtaacccctaacccgaagttcccggcccttagaccgggtacgtcccctcgaaaccggtctttcgtaccgtcggtaccttacccgaacgtcgttcggactacgtctacgaccgtccttccgtcgacctntccacgttcgcttacgnggtaccggaagtctacggatcgttacgttacgttattacccgngtcccgtaagggccgtaggaacngttaccgacgtcctagggacgttccggaccctttattccggtacggttttaccgaccggggtaaccccnggaaccttacgggacctcccggttaacccggg

SEQ ID NO: 9269 - DNA, 751 bp, Homo sapiens
  misc_feature: GYAE6OF02J3X4B.43.77.G11.1.454.CMB.1.raw
  modified_base (118)..(118): a, c, t, g, unknown or other
  misc_feature (118)..(118): n is a, c, g, or t
  modified_base (161)..(161): a, c, t, g, unknown or other
  misc_feature (161)..(161): n is a, c, g, or t
  modified_base (264)..(264): a, c, t, g, unknown or other
  misc_feature (264)..(264): n is a, c, g, or t
  modified_base (491)..(491): a, c, t, g, unknown or other
  misc_feature (491)..(491): n is a, c, g, or t
  modified_base (560)..(560): a, c, t, g, unknown or other
  misc_feature (560)..(560): n is a, c, g, or t
  modified_base (635)..(635): a, c, t, g, unknown or other
  misc_feature (635)..(635): n is a, c, g, or t
  modified_base (656)..(656): a, c, t, g, unknown or other
  misc_feature (656)..(656): n is a, c, g, or t
  modified_base (718)..(718): a, c, t, g, unknown or other
  misc_feature (718)..(718): n is a, c, g, or t
tcagtgtgagtagtcacgaccggtgctcgatttagctagtcactcaagggaaaggggcttcagctgtgggcacaagaggcagcactcaggacagtctccagcagtcggccgttcttcnctcctacctcaccttctcctcgactcactgccacgtcggtccncggccctgtctgtcactcgaccgcaccggtccctacctgtacggtccgtccggaccggggcccaagggtccaaggtccgtcccaacctccgtccgtagtacgngggtactacgttacgtacgacgtcgggtccggtagttaggttacggtacttaccggttaactacccggtaactacgtaacccgttaaccgtaccggaacgtcccctaaccgacccccgtaaccctaaacttcccgtaattaccgtaccgtaaaccggtacccgaacccgtaactcccgggtcccgtaaccgtacggaacggtttcccccaacgttaccgtaccgttntttaccgcggtacccgtaccgttaactcggttcgcccttaccgtactccgtaccgtccgttaccgtacnccgtaacctcgacccggttaggtccgacgttaccggagttacggagacttcggtaacgttctaagttccgttacncggccgtacggacgtccgatnaccggctcggacttgacgtctacggttaccgtccggtcacccggttacaccgtaccggtacnccgcccgttacaccggtaccgacctaaccccgg

SEQ ID NO: 9270 - DNA, 579 bp, Homo sapiens
  misc_feature: GYAE6OF02HGB6P.43.77.G11.1.454.CMB.1.raw
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtctcggggcccccagggcagacgggtcaccactcccctgtactgggagcagtttcaacatcggggcaggtttggatgttaactggtaccagcaacttccaggatcacgacccccaactcctcatctatcggtaccacaatccgccctcgaggactcctcgaccgtattcctctggcctaccagtcgtgcactctcacgtcccttccgtcgcctatccacgtcggacctaccgagggtacgaggtacgttcggagtctaggtactttcgtacgtcgtaccgcgggtaccgtaggacctagtcgacgtccgtaggacgtcggtaccctagtttacgtcgtaccgttccggaacccgtcgaccgtaacggtcccaccggttctacggtaccg

SEQ ID NO: 9271 - DNA, 741 bp, Homo sapiens
  misc_feature: GYAE6OF02GBO47.43.77.G11.1.454.CMB.1.raw
tcagtgtgagtagtcacgaccggtgctcgatttagctagtcactcaagggaaagggggcttcagctgtgggcacaagaggcagcactcaggacagtcctccagcatggcctggtcttctctcctcctcactctcctcgctcactgcacgaggtccgtcgggcccagtctgtgctgacgcacgcccgccctcagtcgtcgtccggggccccgagggcaggacggtccaccactcccctgtacgtgggacgcgtagtttaccaacgtacggtcggggctagggtttgattacgttaacgtcggtaaccagactaaccgttccgaggtactcgaccgaccccctaaactcctacactctacgtacgtaacccaacctaacgtcccggaccctacgacggtaccgtccctacggtaccgtactttccgtcgtacggtcctaccgtaacgttcgtacggactacgttcctacgtaccgttccctttccgtacggaccctacttaccgtacgtaccggtaccctaccggtacgggtaccggtaaggtacggtacggacggtactttaagttaacttttaacgttaccgtaccggacccggtacgggtcccggttaagggaaccttacgtaccggacgtccgttaggtacggtaccggtaccttaagtttacgttccggttacccgttaaccggaacccgtacgtaaccggtaaccggttcccgacccggttaccgtacggtaacccg

SEQ ID NO: 9272 - DNA, 668 bp, Homo sapiens
  misc_feature: GYAE6OF02GF134.43.77.G11.1.454.CMB.1.raw
  modified_base (239)..(239): a, c, t, g, unknown or other
  misc_feature (239)..(239): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagccgcctcagtgtcgtggggccccagggcaggagggtcaccatcccctgtacgtgggancagtttcaacagtcggggcaggtttggagtgttaactggtaccagcaacttcaggatcacgaccccaaactcctacactctactcgtaccaccaatccggaccctacgacggtacgtcccctacgtaaccgtacttccgtctacggtcccttacccaacggttccgtacggacctacgtcctacctacggtcccctttccgtcggtaccctactaccctacggtaccggtaccttccggaacgggttaccggaagggtactacgggacggtcgttagttaactttaacttccgttcgacccgtacgggtccggtaggtacctaacgttcgaacgtccgttaggacggtccgggaccttacggtttacttcggttaccgttaccgggaacccggtcgaacccgtaaccgggttacccacccggttaccgg

SEQ ID NO: 9273 - DNA, 933 bp, Homo sapiens
  misc_feature: GYAE6OF02HSQCM.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagccgccctcagtgtcgtcggggccccagggcaggaggtcaccactccccgtgtaccgtgggacgctacgtttaccaaacgtacggttccgggggtactaggggtttttacgggaacgtttacggtttaaaacgttcgggttaacccgaaggtacctaaaaccgttttcccgaacgggtaacttacccgaaccggtaacccccccctaaaacgttccccttacctaacgtttaccttaacggttaccggtaaacccctaacccgtaaacgttccccggacccccgttacgaaccggggtaccgtttacccccgtacggtaacccgttaacgtttccgttaccggttaccggtacccttacccgtaaaggtttcccgtacgggtacctacgttaccctaccgtaccgttaccccgttttcccgtacgggtacccttaacgttacccgtaaccggttccgggtaacccgttaccccggtaacggggtttacccgggtaaacggggttaacggtacggggtacgggtttaccggttacggttaaacgtttttaacgttttaaccggtcggtaacccgggtacggggttacccgttaacgggggtacccttaacggtaccgtacgggtacccgtttgggaaccggttccgggtacccgttaagtttaccgtttacggtttacccggtttaacccgggtaaccccggtaccggtaaaccccggtaaacgggttccccgtaaccccggtttaaccccggg

SEQ ID NO: 9274 - DNA, 653 bp, Homo sapiens
  misc_feature: GYAE6OF02H68QL.43.77.G11.1.454.CMB.1.raw
  modified_base (187)..(187): a, c, t, g, unknown or other
  misc_feature (187)..(187): n is a, c, g, or t
  modified_base (240)..(240): a, c, t, g, unknown or other
  misc_feature (240)..(240): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctctcactctcctcgctcactgcacgagggtcctcgggcccagtctgtgctgacgcagccgccctnagtgtcgtcgggcccagggcaggagggtcaccactccccgtgtaccgtggganctagtttacaacagtcggggactaggttggattagttaactggtacagcaacttccgagactcacgaccccctaaactcctacactctacgtacggtacccaactaagtccggccctagacggacgtccctagaaccgtattctcgtacggcctactaaagtctcggactactcgtcacgtccctttcgacggcctaagtcctacgtcggtacctccgtaagggtacgacgggtaattgggacggtctaggttaactttaacgttactcggtaccgacgggtccggtacgggaactacgttccgaaacgtccgtaggtacggtacgaccgttatttaacgttcgtcccgtttaaccgggaacccgtcgaacccggtaacgggttcccaacccggtttaccgtaggtaacccgg

SEQ ID NO: 9275 - DNA, 740 bp, Homo sapiens
  misc_feature: GYAE6OF02HRKWR.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagccgccctcagtgtcgtcggggccccagggcaggacgggtcaccactcccctgtaccgtgggacgctagtttcaacagtcggggctaggtttggatgttaactggtaccagcaacttcaggatcacgacccccaaactcctcatcctatcggtaccaccaatccggccctgacggtacgtccctacggacccgtattcgtcgttcgggcctaccgtaaagttccgtagggtacctacgttcctccgtaaccggtcccctttcccgtacgggtaccctaacgttccctaaccgttaccgggtaaccccgttacccggtaccggggtttaccgggaacgggtaccgttaacgggaacgggttaccgttaaggttaacgttttaaccgtttaaccgttaccggtacccggtaacgggtcccgttaacggggaacctaccggttaccgacggtacccgttggaaccggtcgggtacccttaagtttaccgtacggtttacccggttaaccgggaacccggtaccggtaacccggtaacggttacccgtacccggttaaccccgg

SEQ ID NO: 9276 - DNA, 669 bp, Homo sapiens
  misc_feature: GYAE6OF02F87TT.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcacgccgccctcagtgtcgtcggggcccccagggccaggacgggtccaccgacgtcccctgtaccgtggggacgcctagtttacaacacgtcggggctagggtttgattacgttaacgtggtaccagcctaaccttaccgaggtactccaaccggacccccctaaacgtccctacctaacttaccgtacgttaccggtacccaaccgtaacgtccggtcccctacgacgggtaccgtccctacggaccgtactttccgtcgtgtcccttacgtaacggtccgtcggactacgtcctaccgtacgttccccttaccgtcggtccctacgtaccgtaccgtcggtacccttaccggacggtacggagtagtcggtaacggtcttagtatttacgtcgtacgaccgtacggtcgtaggactagtcgacgcgtagacgtcggacttagttacgtcgttacgtacgacccgtacgaccgacgtacgtaccgtacgg

SEQ ID NO: 9277 - DNA, 671 bp, Homo sapiens
  misc_feature: GYAE6OF02H8Q6Z.43.77.G11.1.454.CMB.1.raw
  modified_base (152)..(152): a, c, t, g, unknown or other
  misc_feature (152)..(152): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacgngggtcctgggaccctgtctgtgctgacgcacgccgccctgaggtcgtcgcggggcccagggcaggcggtcacacgtccctgtacgngggacnctagtttcgaactcggtcggggctaagggtttggacttaggttaacgtcggtaccagtacctaacgttcgaacgctacgaacccaacccctaactcctatactactagtaccgtaacccaacgtacgcccgtacncgaagtccgttccngtaccgtacttcgtacgcgtctaccgtagcgtgctacgttcacgtcgtacccttcgcgcccttagacctacgtcgtaccgtcgtacggtccgaagtacgtcggaggtacctagttaacctttgaccgtacgacggtaccgttcgaacgggtacctaccgttcgaacggtccgttaggtacccgtgggttaaaccctcgttttacgtaccggttacccggttacggggaacccgttacccgtaaaccgggttacggttcccccggttaaagttcccggg

SEQ ID NO: 9278 - DNA, 666 bp, Homo sapiens
  misc_feature: GYAE6OF02FP2FI.43.77.G11.1.454.CMB.1.raw
  modified_base (241)..(241): a, c, t, g, unknown or other
  misc_feature (241)..(241): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacaggtcctgggcccagtctgtgctgacgcagccgccctcagtgtcgtcggggccccagggcaggacgggtcaccactcccctgtactgggancagtttcaacagtcggggctaggtttgatgttaactggtaccagcaactcaggatcacgccccaaatcctcactctatcgtaccactaactcggccctacgaggtaccgtcccgtagaccgtattcctctcgggtctacccgtaagtccgtcgggacctactccctacgtacgtacccctttccgtcggtaccctacttcctaacgttcggacccttaccgacgggtaccgaacgggtactcgggtaacggtccttaggtaactttacgttaccgttacggaccgtacgggtaccgtacggggtactaacgtccgaacgtcccgtaggtacggtacggtcccgttaagtttacgttcgttaccggttacccgggtaacccggttaccgaaacccggtaacgggttcccaacccgggtttacccgg

SEQ ID NO: 9279 - DNA, 821 bp, Homo sapiens
  misc_feature: GYAE6OF02GS3IJ.43.77.G11.1.454.CMB.1.raw
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcacgcccgccctcaggtcgtcggtcgggggccccgagggcaggacgggtccacctactccccgtggtacgtggggacgtcgtacgtttaccaaacgtacggtccgggggtacgttacggggtttaggtaacgtttacggtttaaaccgttacgggttaacccaacggtaacctaaaccgtttaccggaaaggtactacccgaacccgtaaccccccctaaaaccttcccgtacctaacttacctacgtaccggtaaccccaaccgtaacgtcccggtaccctacggacggtaccgtcccgtacggtaaccgttacgttcctcgtcggtacctaccgtaacgttcgtacggacctacgtccgtacgtacccgttcccgtttcccgtacggtaccctacgtacccgtacgttaccggacctaccggtacgggtacggaaggtacggtacgggtacgtacgtacgtttaacttaacgttccgtacggtaccgtacgggtaccggtacgggaaccttcggtaccgacgtcccgtagggtacgtacggtacgttaacgtttaccggttcggttacccggtaaccgggtacccgaaccggtaaccggtaaccgggttaccccgtaacccggttaccggtaaccggtacccgg

SEQ ID NO: 9280 - DNA, 740 bp, Homo sapiens
  misc_feature: GYAE6OF02HMF4L.43.77.G11.1.454.CMB.1.raw
  modified_base (186)..(186): a, c, t, g, unknown or other
  misc_feature (186)..(186): n is a, c, g, or t
  modified_base (241)..(241): a, c, t, g, unknown or other
  misc_feature (241)..(241): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctnagtgtcgtcggggccccagggcaggagggtccaccactcccgtgtaccgtggganctagtttcaacacgttcggggctaggttttggagttgttaacgtcggtaaccgagacctaaccgttccgaaggtactaccgaccgtacccccctaaacgtcccttactactactacttacggtaacccaccctaacgtccggaccctacgacggtacgtcccgtacgtaaccgtacttctcgtcgtcgtaccaacgttccgtggtcctactacctccgtacgtccccgtttccgtacgggtaccctacgtaccgtaccgtaccgtacccgttacccgtacgggtcggaacgggtaggtacgacgggttacgttacgtaccgttttaagttacccgtccgggtaccgtaccgggacccggttgggttaaccctacgttacggaccgttccgtaggtacggtaccggttacctaaggtttaccgttcgggtttaaccttaccgggaacccgtaccgtaccggttaaaccggtcccgtaccccggttacgaacgttacccgg

SEQ ID NO: 9281 - DNA, 657 bp, Homo sapiens
  misc_feature: GYAE6OF02HBCF6.43.77.G11.1.454.CMB.1.raw
  modified_base (186)..(186): a, c, t, g, unknown or other
  misc_feature (186)..(186): n is a, c, g, or t
  modified_base (251)..(251): a, c, t, g, unknown or other
  misc_feature (251)..(251): n is a, c, g, or t
  modified_base (597)..(597): a, c, t, g, unknown or other
  misc_feature (597)..(597): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctnagtgtcgtcggggccccagggcaggacgggtcaccatccccgtgtacgtgggagctagttcaacngtcggggctaggtttggattagtaacgtggtaccagcctaacttccgaggtatccacgacccccaaactcctacattctaacgtcggtaacccacaacgtccggccctgacggtactcccgtagaccgtattcctcgtcgccttaccaacgttccgtggacctacttcgtcacggttccctttacgtcgaccctacgtcctacgttacgggaccctaccgtagggtccggaaaggtcttacgggaacgttccgttagtaacttttaagttacccggtacgacccgtacgggtacctcggggaaacctggtaccaacggtcctgggaccgttcggaccgttaagttnacgggttccttaccgggaaccgtcgtaaccgtaacggtcctaacccggttcgtacgtccg

SEQ ID NO: 9282 - DNA, 606 bp, Homo sapiens
  misc_feature: GYAE6OF02FTWKF.43.77.G11.1.454.CMB.1.raw
  modified_base (243)..(243): a, c, t, g, unknown or other
  misc_feature (243)..(243): n is a, c, g, or t
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacagggtcctgggcccagtctgtgctgacgcagcccgcctcagtgtcgtcgggccccagggcagacgggtccaccactcccctgtacgtgggganctagtttcaacagtcggggctaggtttggattgttaacgtggtaccagctaacttcgagatcacgacccccaaactcctnactctagtcgtaccacaacgtccgccctgacgcgtccngacctnttcgtcgcgtctacaacgtcgtacgctactctcgcgtcccttccgcgcctactcctacgtacggcctaccggtacgtacggacgggtacttagggacgtcttagtactttacgttacgtcgtaccgtacgggtccgtacggacattccgacggtaccgtggacggtcgaaccttagttacgtccgtttaccggttacggaaccgtaccggaaccgtacggtacccgtacccgttaccgg

SEQ ID NO: 9283 - DNA, 787 bp, Homo sapiens
  misc_feature: GYAE6OF02G18KW.43.77.G11.1.454.CMB.1.raw
  modified_base (251)..(251): a, c, t, g, unknown or other
  misc_feature (251)..(251): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacaggtcctggcccagtctgtgctgacgcagcccgccctcagtcgtcgtcggggccccagggccaggacggtccaaccgacttcccccgtgtaccgtgggacncgtacgtttcaaacgtggtaccgggggtactaagggttttcggaacgtttacggttaaaccgttcgggttaaaccaacggtacctaaaacccgtttaccccggaaggggtaccttacccgaaccccggtaaccccccctaaaaccttcccctaccgaacgtttaccttaacgtaaccggtaacccctaaaccgtaacccgtcccggacccctacgacgggtaccccgttacccgtacgtaaccgttactttccgtccgtacggtaccctaccgtaacggttccgtcggacctaccgtcctacgtacccgttccctccgtacggacccttacgaccttacgtaccggtacccgttacggtacggtacggaagtacggtaggtaccggtacgtaagttaactttaccgtcgaccggttaccgacgggttacccgtaaggtacctcgtaacgccgtcgaggtaccgtcggtacttacgtcgttcgttacccggtaccgaccggtacgaacccggtaccggttaccgcccggttaaccgg

SEQ ID NO: 9284 - DNA, 768 bp, Homo sapiens
  misc_feature: GYAE6OF02I9AMF.43.77.G11.1.454.CMB.1.raw
  modified_base (252)..(252): a, c, t, g, unknown or other
  misc_feature (252)..(252): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacgaggtcctgggcccagtctgtgctgacgcagcccgccctcagtcgtccgtcggggccccagggccgaggacgggtccaccgacttccccgtgtacgtggganctacgttacaacaggtcggggcgtaggtttaggacttagttaacgtggtaccagtacctaaccgttcgacggtactccgaccggacccctaaactcctactacttactacgtacggtaacccaaccgtacgtccggtacctacgaacggtccgttacccgtacgtaaccgtacctttaccgtcgttccgggtacccttaccggttaaacgtccggtttacggaccttacgttacccgtacccgtaccgttacccccggtttccgtacccgggtacccttaccgtaaccgtaccgtaccggtacccttaccggaacgggttcggtaaacggtcgtacgggtacggtacgtttacgttaacgtttaccgttacgtcggtaccgtacggggtccgtacgggaactagtaccggaccgtccgtaggtaccggtacgtaccgttagttaccgttcggttaacccggttaccggtaaccggtacccgttaacccggtaccggtaccgtaccccggttaccgg

SEQ ID NO: 9285 - DNA, 795 bp, Homo sapiens
  misc_feature: GYAE6OF02JP0JZ.43.77.G11.1.454.CMB.1.raw
  modified_base (141)..(141): a, c, t, g, unknown or other
  misc_feature (141)..(141): n is a, c, g, or t
  modified_base (190)..(190): a, c, t, g, unknown or other
  misc_feature (190)..(190): n is a, c, g, or t
  modified_base (417)..(417): a, c, t, g, unknown or other
  misc_feature (417)..(417): n is a, c, g, or t
  modified_base (517)..(517): a, c, t, g, unknown or other
  misc_feature (517)..(517): n is a, c, g, or t
  modified_base (640)..(640): a, c, t, g, unknown or other
  misc_feature (640)..(640): n is a, c, g, or t
tcagtgtgagtagtcacgaccggtgctcgatttagctagtcactcaagggaaaggggtactgcttcagctgtgggcacaagaggcagcactcaggacagtctccagcatggcctggtctctctcctctcactctcctcgcncacgtgcacagggtcctgggcccagtctgtgctgacgcagccgtccctnaggtgtcctaccgggggccccaaggcgacggtaggtcccaaccacgtcccccttaggtacgcggggtacacacggtttaccaacgtacgtccggggcgtaacggtttcggtattagggttaaccgttcgggttaccaaggtacccgtaacgttacccgacggtaacctcggttaccgaccccccgtaaacgtccccttactaacgtcctaaagtccggttaaacccncctaaaaccgtcccggtacccctaccggtacgggtaccgttacccgtaaccgaccgttaactttccctaagttccccgggaccttcccgtaaacggttcncgggtactacgttaccgtcccgtaacgtcccctttccgaccgggtccctacggtaacccttaaccgggttcgtacccgttaccgggttaccgtaacgggtaacgaccgggttagtaccgggtntaccggttactttaacgttaccgtccgtttacgaacccgggtccgtcgggtaaccgttacacgtacgggtaccttcggaacggtctacccggttaagtaaccgttccgttcgtaacgggtacccacggtaccgtacggtaccgtacccgtaccgg

SEQ ID NO: 9286 - DNA, 865 bp, Homo sapiens
  misc_feature: GYAE6OF02GJL42.43.77.G11.1.454.CMB.1.raw
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcacgcccgccctcagtgtcgtcggggcccccagggcaggagggtccaccatcccctgtactgggagctagtttcaacagtcggggctaggtttggattgttaacgtggtaccancaacttcgaggatcacncccccaaactcctcattctactaggtaaccaccaactccggccctacgacggtactcccgtacgtacccgtacttcgttccgtcggtcctacccgtaacgtttccgtacgggacctaacgtttcccgttccgtaaccggttcccccttttcccgtacggggaccccttaacgttaccgtaacccggtacggggttaaccccttccccggtaaacggggggtttccgaaaacgggggttacttacggggttaaaccgggggtacccttttaggggtaaccttttttaaaccgttttaaccgccgggttaaccccgtaacggggggtccccggtttaaccggggggtaacccttaacgttaacccgggaccgtaccccggttttaggggtaccggttccggggtttaaccccttaaagggttttttaaccgtttaccccgggggtttacccgttaacccccggggggtaaaccccggttaccccggaaaccccggttaaaccgggggtttaaccccccgtaacccccgggttttacccggttaaccggggttaacccccgg

SEQ ID NO: 9287 - DNA, 730 bp, Homo sapiens
  misc_feature: GYAE6OF02I3VIM.43.77.G11.1.454.CMB.1.raw
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctggcccagtctgtgctgacgcagcccgccctcagtcgtcgtcggggccccgagggcaggagggtccaccactccccctgtacgtgggagctagtttcaacgacgtcgggggcgtagggtttggtagttacgttaacgtggtacccgagtacctaaccgttaccgagggacttacccgaccgacccccccgtaaacctcctaacctacttacctacgtaccggtaacccaacctaacgtccccggtaccctaccgaacggtaccgtccccgtacggaccgttacttccgtccgtacgtacctaccgtacgttccgtcggtcctaacgttccgtaccgaccgttccctttcgtaccggcctactccgtaactcgggtacctaccgtaggggtaccggtaaggtcgtcggacggtcgttaacgtaactttactacgtccggaccggtacggtccggtacgggacctacgtccgtacgtcccgtagggtcggtaacggttcctaagtttacgtcggttacccttacggggaacccgttccggaacggtaccggtccgtacccgttccggtacgtacccgg

SEQ ID NO: 9288 - DNA, 863 bp, Homo sapiens
  misc_feature: GYAE6OF02IH9SD.43.77.G11.1.454.CMB.1.raw
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagcccgccctcagtgtctcggggccccagggcagacgggtccaccaactccccgtgtaccgtggggaactctagtttacaaacagttccgggggctagggttttggagttgttaaacgtcgggtaaccacggactaaacttcccgaaggtactacgaacgacccccctaaaactccctacgaacttctaacttagggtaacccaccgtaaacgttccgggacccttacgaagggacgttacccctggaacccgtacttcctccgttacggtccttacccgtaaaacgttccgttacgggccctaaacgtttccgtacccgtaacggtttcccccgttttacccggtacgggtaccccctaaacgtttcccgaaaccgttcggggtaaccccttttacccgggaaacggggtttccgggaaacgggttacgtaacgggggtaacccggtccgttttaacggtaaatttttaacccggttaaaccggtttaccgggaccccggtaaaccgggggttcccgtttaaggggggaaaccctttagtaacccgtaaccgggtaccgttacgggtacggttaccgggtaccttaaagtttacgttacccgggttaacgtttaaccccgggaacccgtacccggaaacggttaaacccgggtacccgtaacccgttcccggttaaggtaacccgg

SEQ ID NO: 9289 - DNA, 744 bp, Homo sapiens
  misc_feature: GYAE6OF02GRRS5.43.77.G11.1.454.CMB.1.raw
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctcgggcccagtctgtgctgacgcacgccgccctcagtcgtcgtcggggccccagggcgaggacggtccaccgactcccctggtaccgtggggacgtctacggtttcaacgtacggtcggggactagggtttggattacggttaacgtcggtaaccagacctaaccgttacccgaggtactaccgaccggaccccctaaactcctacacttcgtaacgtcggtaaccaccgtaacgtcccggaccctacggtaacggtaccgttcccgtacgtaacccgttactttccgtcgttacgggtacccttaccggaacggttccgtacgggaccttacgtcccttaccgacccgtttccctttcccggtacggtaccctacgtacccgtacggtaccggtaaccgttcccggtaagggtaccggaacggtagtacggaccggttacgtagttacgttaacttccgtacggacccgtacgggttccgtacgtactcttacgaacgtcgtacggtacgtcgacgttattacgttcgtacccggtaaccggaccgaccggtaacgtaaccggtccctaaccggttacgacggtacccg

SEQ ID NO: 9290 - DNA, 710 bp, Homo sapiens
  misc_feature: GYAE6OF02GVTAU.43.77.G11.1.454.CMB.1.raw
  modified_base (222)..(222): a, c, t, g, unknown or other
  misc_feature (222)..(222): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctcctctcactctcctcgctcactgcacgacgggtcctgggcccagtctgtgctgacgcacgcccgccctcagtcgtccgtcggggccccgagggcgaggngggtaccaaccgtacctccccgtgtacgtgggacgtacgtagtttaccaacgtaggtaccggggtcgtaggtttggagtttacgttaacgtcggtaaccacggacctaaccgttcgacggactaccgaacccaaccccgaaacctccctacctactccgtaagtaccgtacccaaccgtaacgtcccggaccctcgaacggtaccgtccccgtagtacccttacgttccgtacggtcggcccttaacgtacggttccggtcgtactacgtcttccgtaccgttcccctcggtaccggtcctaacgtcctacggtaccggtaccgtccggtaaggtccgtaaggcgttacggacggtcctagtaactttacgttacgtacgcggttacggccgtaggtacacgtccgagcttggacgttccggattacttcgtaccgttacggtacccgtaaccggccgtaaccggtaacggtccggtacccgttacgg

SEQ ID NO: 9291 - DNA, 759 bp, Homo sapiens
  misc_feature: GYAE6OF02I6HNM.43.77.G11.1.454.CMB.1.raw
tcagtgtgagtagtcacgaccggtgctcgatttagctagtcactcaagggaaaggggtctgcttcagctgtgggcacaagaggcagcactcaggacagtctccagcatggcctggtcttctctcctcctcactctcctcgctcactgcacgagggtcctgggcccagtctgtgctgacgcacgcccgccctcgagtcgtcggtcggggccccgagggcaggacgggtccaacccgtaccttcccccgttaggtacggtcggggacgtccgtacgttttaccaaacgtacggtcggggacttaggggtttggaattacggttaacgtcggtaaccagtacctaaaccttccgaaggactccgaacccgtaccccctaaacgtcctactaacttactaagtaccggtaaccaaccgtaacgtcccgtaccctagacggtaccgtcccgtacgaccttacttccgtcgtcggtacctaccgtacgttcgtacggctactccgtacaccgttcccttccgtcgacctacgtaccgtacgtaccggtacccgtaccggtacgggttaccgacggtacgtcgggtaacggtccgttagttaacgttttacgtaccggtccgacggtacggtaccggttaggaacctgtaccgtcggtcccgtaggtaccggttacgtaccgttagtttacgttcggttacccggttaaaccggacccggtaccggtaaacccggtacccggttacccggtacccggttaacccgg

SEQ ID NO: 9292 - DNA, 775 bp, Homo sapiens
  misc_feature: GYAE6OF02HBPTH.43.77.G11.1.454.CMB.1.raw
tcagtgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctcgggcccagtctgtgctgacgcacgcccgccctcagtcgtcgtcggggccccagggcaggacgggtccacctactccccgtagtacgtgggacgtctagtttacaacaggtccggggctagggtttaggattacgttaacgtcggtaaccaggtacctaacgttaccgagtactccgaccgaccccctaaacgtcctacacgttctacgtacgtaacccaacgtacgtcccggtaccctcgaacggtaccgtaccctacggtaaccgttaccttccgtccgtcggtacccttaccgtaacgttccggtacggtacctactccgtaccgtaccgttcccgttaccgtacggtccctacgtaccgtaccgtacggtccgtaccggtacgggtacggtaacggtacgtacggtacggttacgtagttaacgtttacgttaccgtacggaccgtacggtccggttacgggtacctaacgttacgaccggttaccgtagggtacggttacggtaaccgttcggtttaacggtaccggtttaacccgggtacccgggtaacccggtaccggtaaccggtacccgggttaaccccgtaaccgggtttacccggttaccgtaacccgg

SEQ ID NO: 9293 - DNA, 802 bp, Homo sapiens
  misc_feature: GYAE6OF02IOFNQ.43.77.G11.1.454.CMB.1.raw
  modified_base (132)..(132): a, c, t, g, unknown or other
  misc_feature (132)..(132): n is a, c, g, or t
  modified_base (484)..(484): a, c, t, g, unknown or other
  misc_feature (484)..(484): n is a, c, g, or t
tcagtgtgagtagtcacgaccggtgctcgatttagctagtcactcaagggaaaggggtctgcttcagctgtgggcacaagaggcagcactcaggacagtctccagcatggcctggtcttctctccctcctcnctctcctcgctcactgcacgagggtcctgggccctagtctgtgcgtcgacgcgacgcccgccctcagtcggtcgtccggggccccaaggggcacggacgggtccaaccgtacctacccctgtacgtgggacgctacgttacaacgtaggtccgggcgtagggtttcgagtttacgttaacgtggtaacccacgtacctaaccgttcccgaaggtaccgtacacccgaaccccctaaaacttcccctacacgttacctacgtaccgtaacccaactaacgtcccgccgtcgacgaccgtcccgtacgtaccgtacttcgtcgtcgaccttacgacgtctcggtacctctaccnccgttaccgtcccgttccgtacggacccgtacgttaccgaggtacccggtaaccttacccgggtacgggttaccgaacggggtagtaccgggtagttacgttaagtttacgttaaacgtttacccgggtcggttaccggaccggggtaccgttaccggggaaacttaacccgtacgtacggtacccgttaggggaaccggttacggtacccggtttaacgttttaccgggccggttttaacccggttaacccccggggtaacccgtcccggttaaaaccccgggtaacgttaccccggttaaccccgggttccccggg

SEQ ID NO: 9294 - DNA, 700 bp, Homo sapiens
  misc_feature: GYAE6OF02GI4OJ.43.77.G11.1.454.CMB.1.raw
  modified_base (135)..(135): a, c, t, g, unknown or other
  misc_feature (135)..(135): n is a, c, g, or t
  modified_base (158)..(158): a, c, t, g, unknown or other
  misc_feature (158)..(158): n is a, c, g, or t
  modified_base (185)..(185): a, c, t, g, unknown or other
  misc_feature (185)..(185): n is a, c, g, or t
  modified_base (271)..(271): a, c, t, g, unknown or other
  misc_feature (271)..(271): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (600)..(600): a, c, t, g, unknown or other
  misc_feature (600)..(600): n is a, c, g, or t
tcagtgtgagtagtcacgaccggtgctcgatttagctagtcactcaagggaaagggggcttcagctgtgggcacaagaggcagcactcagacagtctccagcatggcctggtcttctctcctcctcactcctccncgacttcactgcacgacggtccncgggaccctagtcctggcgctcggacncgacggccccgtcctcgacggttcgtccggtaccgggggccccaggggctaggtacgggtccaaccgtacttccccgtgttaccgngggtactacgtaacgttaccaagtacggtccggggacttagggtttcgagttacgttaacgcggtaacagtacctaccttaggacgtactaccgaacccgtacccctaagtccttacgagttacctacgtaccggtacccaacgtacgtccggacctgaacggcctaccgtaggacttcgtctcgacgtctacgacgttcngactctcncgtacgttccgtcgcgacctctctacgacgtctacgacgggtacgagacgtacgagtcttacgtacttgttacgacgtaccggaccggtacgaacggtactaccgtacgccggttaacgngtacggtacgaccgtttaggttacgttaccggttaaccggtacccggaacgttccgggaaacccggttaggtaacccgtaccggttcccgtaagacccgg

SEQ ID NO: 9295 - DNA, 858 bp, Homo sapiens
  misc_feature: GYAE6OF02JRPR0.43.77.G11.1.454.CMB.1.raw
  modified_base (244)..(244): a, c, t, g, unknown or other
  misc_feature (244)..(244): n is a, c, g, or t
tcagtgtgagtagtcacgaccggtgctcgatttagctagtcactcaagggaaagggggcttcagctgtgggcacaagaggcagcactcaggacagtctccagcatggcctggtcttctctcctctcactctcctcgctcactgcacagggtcctgggcccagtctgtgctgacgcacgccgcctcgagtcgtcgtcggggaccccagggcaggtacgggtccaccgtctaccccgtcgttacgngggaacgtcgtagtttacaaccgaggttcggggtacctaggtttacggatttagttaacgtcgggtaaccacgtacgtaaccgtttaccgaacgggtaccgtaacccgtaaccgtaccccccctaaaagtttccccgtaactaaccgttaccgttaacgtaccggttaacccaaccgtaaccgtccccggtaccctaccggtaacggtacccgttacccgttacggtaaccgttaccgttacgtacgttccggtacctaacccggtaatttccggtaccggtaccttacttaacccgtccgtaaccgttcccgtttcccgtacgggtaccttaaaccgtcgtaccggtacgtaaccgttacggacggtacggtaacgtacgtacggttacggtacttaacggttaaccgtttaactccggttaaccgacccggtttaaccgggccgttaacggggtaaccctacggttaaccgaccgggttaccgtacggtaaccggttaccggtaccttttaacggtacggtttaccggttacccgttaaaccggtacccggtaacccggtaaccgggtacccgtttacccggaaacccggtttcgttaaccccgggtcccgg

SEQ ID NO: 9296 - DNA, 163 bp, Homo sapiens
  misc_feature: GYAE6OF01C9XRR.47.39.D06.1.454.CMB.1.raw
  modified_base (162)..(163): a, c, t, g, unknown or other
  misc_feature (162)..(163): n is a, c, g, or t
tcagagctcacgtacacgaccggtgctcgatttagtgacatctcgcagttctttgggtttgggggaagaggaagactgacggtcctgccacagcggccctgggctgcctggtcaaggactacttcctacgtgagctctgagcgggctggcaaggcgcatagnn

SEQ ID NO: 9297 - DNA, 161 bp, Homo sapiens
  misc_feature: GYAE6OF02GIF35.47.39.D06.1.454.CMB.1.raw
  modified_base (161)..(161): a, c, t, g, unknown or other
  misc_feature (161)..(161): n is a, c, g, or t
tcagagctcacgtacacgaccggtgctcgatttagtgacatctcgcagttctttgggtttggggaagaggaagactgacggtcctgccacagcggccctgggctgcctggtcaaggactacttcctacgtgagctctgagcgggctggcaaggcgcatagn

SEQ ID NO: 9298 - DNA, 164 bp, Homo sapiens
  misc_feature: GYAE6OF02ISC0Y.47.39.D06.1.454.CMB.1.raw
  modified_base (162)..(164): a, c, t, g, unknown or other
  misc_feature (162)..(164): n is a, c, g, or t
tcagagctcacgtacacgaccggtgctcgatttagtgacatctcgcagttctttgggttttgggggaagaggaagactgacggtcctgccacagcggccctgggctgcctggtcaaggactacttcctacgtgagcctgagcgggctggcaaggcgcatagnnn

SEQ ID NO: 9299 - DNA, 478 bp, Homo sapiens
  misc_feature: GYAE6OF01EIZX2.44.2.A02.1.454.CMB.1.raw
tcagacagtatatacacgaccggtgctcgatttagactcatctacaggggagtcagtctcagtcaggacacagcatgcacatgagggtcccgctcagctcctggggctcctgctactctggctccgaggtgccagatgtgacatccagatgacccagtctccatcctccctgtctgcatctgtcggagacagagtcaccatcacttgccgggcaagtcagagcattaggaactctttaaattggtatcagcagaggcagggaaagcccctcaactcctgatctatgctgcgtccattttgcaaagtggggtcccatcaaggttcagtggcagtggatctgggacagatttcactctcaccatcagcagtctgcaacctgaagatttcgctagcttattattagtcaacagatgacaatatcccgctcactttcggcggtagggacctattgtggagtatacaaacgaactgtggtacg

SEQ ID NO: 9300 - DNA, 523 bp, Homo sapiens
  misc_feature: GYAE6OF01DHOJJ.44.2.A02.1.454.CMB.1.raw
tcagacagtatatacacgaccggtgctcgatttagactcatctacaggggggtctcaggaggcagcgctctcgggacgtctccaccatggcctgggctctgctattcctcaccctcctcacccaggacacagggtcctgggcccagtctgccctgactcagcctgcctccgtgtctgggtcgcctggacagtcgatcaccatctcctgcattggaaccagcagtgacattggtggttataactatgtctcctggtaccaacaacacccaggcaaagcccccaaactcatactttttgagtccagtgagcggccgtcaggtgtttctaatcgcttctctggctccaagtctggccacacggcctcctgtcgatctctgggctccggctgaggacgaggctgactatactgcggctcatttacaactcttgagtacttgggtgttcgggcggtagggctcaccgtgaccgtctaggtcacgcccaaggctcgccccctggtccactctcgttcccaccctcctac

SEQ ID NO: 9301 - DNA, 552 bp, Homo sapiens
  misc_feature: GYAE6OF01EYZ29.44.2.A02.1.454.CMB.1.raw
tcagacagtatatacacgaccggtgctcgatttagactcatctacagggggagtcagtctcagtcaggacacagcatgcacatgagggtcccgctcagctcctggggctcctgctactctggctccgaggtgccagatgtgacatccagatgacccagtctccatcctccctgtctgcatctgtcggagacagagtcaccatcacttgccgggcaagtcagagcattaggaactctttaaattggtatcagcagaggccagggaaacgcccctcaactcctgatctatgctgcgtcctattttgctaaagtggggtcccatcaaggttcagtggcagtggatcgtggacagatttcactctcaccatcagcagtctgcaacctgaagtatttcgctagtcttaattattagtacaactagtagttacgaactaattacgtcccgtccttaccgtaaccgttttccgggaccggggtaagggtaacccgtagtttcgggtagggtaacggtaacgttaccgaaaaacggtaaccgttagggtcgggtaacccg

SEQ ID NO: 9302 - DNA, 580 bp, Homo sapiens
  misc_feature: GYAE6OF01CU9WC.44.2.A02.1.454.CMB.1.raw
  modified_base (241)..(241): a, c, t, g, unknown or other
  misc_feature (241)..(241): n is a, c, g, or t
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatccctccctgtctgcatctggtcggagacagacgtcaccatcacttggccgggcaagtcagagcattaggaacttntttaaattggtatcagcagacggccgaagggaaaccgcccctacaacctcctagactctatgctgccgtcctattttgactaaaggtccggggtaccatcgtaagttcgagtggctaggtggatcgtaggataggtactttcacttcacaccatacagctagtcctagacctaaccgtagaacgtagtttccgatcggtactttattattcgtacaacgtaggtagtacgaactacttaccgtacccgtacctacgttaccgtttccggggacgggtaacggaccctaggtttcgggaaggaacgtaactaacggaaaacgtacggtgggtcggtaccg

SEQ ID NO: 9303 - DNA, 534 bp, Homo sapiens
  misc_feature: GYAE6OF01BIXD1.44.2.A02.1.454.CMB.1.raw
  modified_base (213)..(213): a, c, t, g, unknown or other
  misc_feature (213)..(213): n is a, c, g, or t
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctccctgtctgcatctgtcgagacagagtcaccatcacttgccggnaagtcagagcattaggaactctttaaattggtatcagcagaggccagggaaacgcccctcgaactcctgatctatgctgcgtcctattttgacgtaaacgtggggtcccctagtacctaagggttcaggtggcgagtggatcgtggacagtatttcactctcaccatcacgcacgtctacgcctaacctgaagtactttcgctagtctttattattagtacaatagagtcgaactaatactcccgacttcctacgtttcgggcggtacgggacctgttacggtagggaacgtacgtaacgaaacggtacttgggtgtaccg

SEQ ID NO: 9304 - DNA, 728 bp, Homo sapiens
  misc_feature: GYAE6OF01CKNLC.44.2.A02.1.454.CMB.1.raw
  modified_base (542)..(542): a, c, t, g, unknown or other
  misc_feature (542)..(542): n is a, c, g, or t
tcagacagtatatacacgaccggtgctcgatttagactcatctacagggggagtcagtctcagtcaggacacagcatgcacatgacgggtccccgctcagctccgtggggctcctgctactctggctccgaggtgccagatgtgacatccagatcgacccagtctccatccctccctgtcctgacatctggtcggagacagagtcaccatccacgttggaccgggacaagtcaaggacgactaagttaacggtaaacctttagttttaaaagttggtaactaccgaaggtaccaagggacggggaccgaaagggggaaaacccgtcccccctaaactaaccgttccctaaggtacttaacgttacgtcgtcgtacgtcccgttacttagttacgaacgtaacgggtccgtactagtaacgtaggtcaggttcggacgtaggtcggtactcggtaggactaacgtcttacactctacactatacgacgctagtactacgaacctaacgtagacgttacgtacgacttattaccgtttaagttnttaccggaacctaaacgtaacgggtacgtaacttaaaccggtaccttacccggtccccgttaccgttacccggttaaccgggtttacccggggaaacggggttaaccggttaacctttagggtaccgggttaagaaaccgtaaccggttaaaccggaaacggttaacggttcggtaacgggtaccc

SEQ ID NO: 9305 - DNA, 575 bp, Homo sapiens
  misc_feature: GYAE6OF01CFI44.44.2.A02.1.454.CMB.1.raw
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
tcagacagtatatacacgaccggtgctcgatttagactcatctacagggggagtcagtctcagtcaggacacagcatgcacatgagggtcccgctcagctcctggggctcctgctgctctggctcccaggttcgagatgtggacatcgagatgacccagtctccttccttcctgtcttcttctgttggaggcagcgtcaccatcacttgccgggcgagtcaggtcgtttcggtgctgttgcctggtttcaacgaaaaagggggnaggccctaaggtcctcgtctctcgtgaaaccngactggaaggtagagtcccgtcaggttcagtgccagtccaggtggtgggccggagtccacgtctcaccattacgcgacctgcggcctgaagattctgctaacttatttctgtcagcagtatcatacgtcgtccccgttctacgttttcgggacccgtagggggaccctaagggtccgttaagggaaactaccgaaaaacggtaacgttaggtacgggtacttcggacctaaccattccttacgttcctttactacttcccttaccccgcctattctacg

SEQ ID NO: 9306 - DNA, 554 bp, Homo sapiens
  misc_feature: GYAE6OF01CODOI.44.2.A02.1.454.CMB.1.raw
  modified_base (322)..(322): a, c, t, g, unknown or other
  misc_feature (322)..(322): n is a, c, g, or t
tcagacagtatatacacgaccggtgctcgatttagactcatctacagggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcagtcaccatctcctgcactggaaccaacagtgacgtcggtcgttttgaccgtgtctcctggtaccagcagaccccagaaacacgcccccaaatcattattatgcggtcaattgtcgcccttcggtntccctgagcgcttctcgtgggtccaagtctggcaacgacggccctccctgacccatctctgggctccaggctgaggacgaggctagattattacgtgcagctacatactacaagtagggaactacgtttactattccgggcgcgacgggaccagcgtcgacccgtcctaggtccacgcccgaacggtctaccgccccctcggtaccactccttccgttcccctcccgttccc

SEQ ID NO: 9307 - DNA, 591 bp, Homo sapiens
  misc_feature: GYAE6OF01A3A9Z.44.2.A02.1.454.CMB.1.raw
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccgtcctcactgtctgcgtctagttggggacagagtcaccatcacttgccgggcgagtgccgacattaggtactttttggccttggtttcagcaggagcctggacaaacgcccctaagtccctgacttcttttctggactcctactttgaagagtggacgtcccagccaggttcagcggcagttggttctgggacactatttcactctcaccatcagcagcctgcagtccgtaggagtactttccgacgttactttattactgaacctaactaattactttctttttaactaccgttacgttaggttttacggacccgtaaggggacctaaggtccgttaagggacgtaacgtaacgtaaaacgggtaccttgggttacggacgttaggaccctaaccgttacttaccgttcgttccgttaccgtaccg

SEQ ID NO: 9308 - DNA, 573 bp, Homo sapiens
  misc_feature: GYAE6OF01EALB8.44.2.A02.1.454.CMB.1.raw
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
tcagacagtatatacacgaccggtgctcgatttagactcatctacagggggagtcagtctcagtcaggacacagcatgcacatcgaggtcccgctcagctcctgggctcctgctactcgtggctccgaggttgccagatgtgacatccagatcgacccagtctccatcctcctgtctgcatctgtcggagacagagtcacatcacttgccggnaagtcagagcatagactcttaatgtatnagcagagcgaaggaacgcccctacactccgtagactctatgctcgtcgtctattttgacgtaaacggtcgggtccagtacgtaaggttcaggtggactaggtggtactcgtggacagtactttcgactctaccacatcagcagtctcgaccaaccgtagaacgtacgtttccgacgtacgtactttagttacttacgtacaacgtagtagtacgtaactaacgttacgtcccgtacgttaccgttaccgtttcgggacgggtaacgggtaccgtacgttacgggtaggaacggtaacgtaacccgaaaacggtaccgttcggtcggtaccgg

SEQ ID NO: 9309 - DNA, 553 bp, Homo sapiens
  misc_feature: GYAE6OF01C6CAI.44.2.A02.1.454.CMB.1.raw
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (281)..(281): a, c, t, g, unknown or other
  misc_feature (281)..(281): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtctgggtcgcctggacagtcggtcaccatctcctgcactgganccagcggtaatnttcttagtctttaacttgtctcctggtatcaacatcatccagtaaacnccccaaatcatcatctatgagcctaataagagtccctgagggttctaatcgcttcactgcctccaagtccgacaacacgcctcctgacaatctcgtgggcctcgagtctagacggtacgaggtctaggtactttaattagttgttacgtcttacgagtacttcgttcgtcgactactctactttatcgttacttacggtaagtcgggacctaaggtcgtaccgtcgtaggtccacgtacccaacggtcccaaccctatcgtccacgttcccg

SEQ ID NO: 9310 - DNA, 549 bp, Homo sapiens
  misc_feature: GYAE6OF01BMX8U.44.2.A02.1.454.CMB.1.raw
  modified_base (215)..(215): a, c, t, g, unknown or other
  misc_feature (215)..(215): n is a, c, g, or t
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctccctgtctgcatctgtcggagacagagtcaccatcacttgccgggnaagtcagagcattaggaacttctttaaatggtatcagcagaggccaagggaacgcccctacaactcctgatctatgctgctcctattttgacgtaaaggtcggggtacccatacgtaaggttcagtggctaggtggatcgtggacagtatttcactctcactatcagcagtctagacctaactagaacgtatttcgactagtactttattacttgtacaacgtagtagtagaactaatcgtacccgtactcctaacggtttccgggacggtacgggaccttaggttcggtaaggtaacgtacgtaaccgtaaacggaacttgggtcggtaaccg

SEQ ID NO: 9311 - DNA, 614 bp, Homo sapiens
  misc_feature: GYAE6OF01ASOC6.44.2.A02.1.454.CMB.1.raw
  modified_base (461)..(461): a, c, t, g, unknown or other
  misc_feature (461)..(461): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacagttggtgttataactatgtctcctggtaccaacaacacccaggcaaacgcccccaaactcatgattcatgatgtacagtaactccggccctcgtacggggttttctcgggttcgcctttctcgtcggtcctaccaagttccgtcgggaccaaaccgacggccctcccgtcgacctatccgtacgtcgggctccgaggtctacggaggacgaggctagacctattacgngtacagtctacgaataagtaaaagtaacgacaaactacgttacgttaagtacgttaccggacgggtaacgggaaccgtaaggccttacggaacccgttccgtaacgggtacctaccggacccgtaaaggcccgttaccgtcccccgttaccgg

SEQ ID NO: 9312 - DNA, 525 bp, Homo sapiens
  misc_feature: GYAE6OF01AGEMN.44.2.A02.1.454.CMB.1.raw
  modified_base (278)..(278): a, c, t, g, unknown or other
  misc_feature (278)..(278): n is a, c, g, or t
  modified_base (355)..(355): a, c, t, g, unknown or other
  misc_feature (355)..(355): n is a, c, g, or t
  modified_base (436)..(436): a, c, t, g, unknown or other
  misc_feature (436)..(436): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
tcagacagtatatacacgaccggtgctcgatttagactcatctacagggggggtctcaggaggcagcgctctcgggacgtctccaccatggcctgggctctgctattcctcaccctcctcactcagggcacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacncccccaaactcatcatctatgagcctataagaggccctcaggggtttctaatcgcttcactgcctcaagtccgcacncggcctcctgacatctctggctcaggctgaggacgaggctgatttattattgttgctcagattgttcgtcgcatcactttntgttcttcggaagtcgggacctaggtccaccgtccgtaggtcacgcccgaacggcccaacccncgtgtaccncttccgtcgttcccccg

SEQ ID NO: 9313 - DNA, 746 bp, Homo sapiens
  misc_feature: GYAE6OF01CLIW6.44.2.A02.1.454.CMB.1.raw
  modified_base (224)..(224): a, c, t, g, unknown or other
  misc_feature (224)..(224): n is a, c, g, or t
tcagacagtatatacacgaccggtgctcgatttagactcatctacagggggagtcagtctcagtcaggacacagcatgcacatggacgggtccccgctcagctccgtggggctcctgctactctggctccgaggtgccagatgtgacatccagatcgacccagtctccactcctccctgtctgcatcgtggcggagacagacgtcacatcacttggaccggganaagcaagacgctaagttaaggtaacttactttaaattggtactacgagcgaaggacggaccggaagggaaaccgccctacaacctcgtagactctatgctgtcgtacctagtttcgacgtaagggttcggtacctagtacgtaacggttcgaaggtcggacgtaggtggtacgtcggtagggtaactaggttacctttcaccttcctaccaacctaagttccgaacgtcgtacgttccgtacgaaccgttaaccgtaggtaaccgtaacttttaccggacgttaacgtttaccgtttaacgttttaacgttacgggttaaacccgtaaaggttaacgggtaacgtttaacgaaacttaaccgttaaccccgttacccgttacccgtttaaccggttaacccgggtttacccgggggaaccgggttaacggggttaaccctttagggtttaagggttaaccgggtaacgttaaaccgtaaaaccgggtaaaaccggtaaccggttgggttaacggtaccccgg

SEQ ID NO: 9314 - DNA, 602 bp, Homo sapiens
  misc_feature: GYAE6OF01BTUDK.44.2.A02.1.454.CMB.1.raw
  modified_base (229)..(229): a, c, t, g, unknown or other
  misc_feature (229)..(229): n is a, c, g, or t
  modified_base (433)..(433): a, c, t, g, unknown or other
  misc_feature (433)..(433): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcagtcaccatctcctgcactggaaccacagtnacattggtgttataactatgtctcctgtaccaacaacaccaggacaaacgcccccaaactcatgattcatgatgtcagtaatcggcctgtagggtttctggtcgtcttctctggctcaagtctcgcaacgcggcctccctgacctactcctcgtcgggtctccgaggtctggacggacggacggtctaggtaacttacgttacngtactaggtcctacaataagtaaaagaacgtacaaacgttacttagttaacttacgttaccgggacgggtacgggaaccctaaggtccgttacggtaacccggtccggttaacggtccgaaccggtaccccgaacggtcccgttccccggtccccgtccgggttacccg

SEQ ID NO: 9315 - DNA, 678 bp, Homo sapiens
  misc_feature: GYAE6OF01ED8UT.44.2.A02.1.454.CMB.1.raw
tcagacagtatatacacgaccggtgctcgatttagactcatctacagggggagtcagtctcagtcaggacacagcatgcacatgagggtcccgctcagctccgtggggctcctgctactctggctccgaggtgccagatgtgacatccagatcgacccagtcctccactccctccctgtctgctatcgtggtcggagacagacgtccacctatcacgttcggccgggacaaggtcaggacgactaagttaacggtaacttacttttaaagttggttatacgaagcgaaggacggaccgaaggggaaacccgtcccctacgtaacctccgtagtacttcgtatcgcttcgccgttacttagttttacggaacgtaaacgggttcggggtaccctaagttacgtaacggttcgaggtcggacgtaggtacggtacgtcggtaggaactagttactttaccacgttccgtacacctatcgacgtcgtagtcctacgacctaaccgtagaacgttcgttacgcgtaacgttactttaagttacttacgtacaacgtacgtaagttacgaacttaactcccgtaccgtacttaccggttacggttccggggaacggtacggtaacgttaggttacgggtaacgaacgttaacgtaaccgaaaggttacggttggacggtaccg

SEQ ID NO: 9316 - DNA, 613 bp, Homo sapiens
  misc_feature: GYAE6OF01EPRR0.44.2.A02.1.454.CMB.1.raw
  modified_base (382)..(382): a, c, t, g, unknown or other
  misc_feature (382)..(382): n is a, c, g, or t
tcagacagtatatacacgaccggtgctcgatttagactcatctacaggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtggttaataacttatgtctcctggtaacccaacaaccacccaggaccaaacgcccccaaactcaatgattcatgatgtacagtaatccggccctgtaggggtttctggtcgcttcgtctggctccagtctggcaacgccgccctcccngacctatcctcgtcgggcctccgaggtctggaggacgaggctagtacttattacgtgctagtcctacgtaataaacgtaaaaaggagacctaaacgtacctttaagttaacgttacgttcgggacgggtaacgggacccgtaaggtccgttacggaccccgttacggtaacgggtacccaacggaccccgtaaaggtcccctaccggtccccccgttgggtaccctccccg

SEQ ID NO: 9317 - DNA, 640 bp, Homo sapiens
  misc_feature: GYAE6OF01EIOOL.44.2.A02.1.454.CMB.1.raw
  modified_base (202)..(202): a, c, t, g, unknown or other
  misc_feature (202)..(202): n is a, c, g, or t
  modified_base (324)..(324): a, c, t, g, unknown or other
  misc_feature (324)..(324): n is a, c, g, or t
  modified_base (528)..(528): a, c, t, g, unknown or other
  misc_feature (528)..(528): n is a, c, g, or t
tcagacagtatatacacgaccggtgctcgatttagactcatctacagggggagtcagtctcagtcaggacacagcatgcacatgagggtcccgctcagctcctggggctcctgctactctggctccgaggtgccagatgtgacatccagatgacccagtctccatcctccctgtctgcatctgtcggagacagagtcaccancactcggccgggacaagtcagagactagttaaggtaactccttttagttaggtactcgagcaggacgccgaaggaacgtccccactaacctctatactatcgagtcgacgtcgttactttanacccgtaaggtaacgggttcccggtaacgtacgtaaggttacggttaacgtacgggtacggtctaggggtatacgtacgggttacggaacgtattacttaacctctcctaccgactaactcgacaacgtccgtcaacgtcgtacgtctagtacgttatttctacgtaaacttaactttactacgtacaaccgtataacgttaanagttaacttacgtttcgacgttaacgggtttacgggttccgtacgggtaaaccggggaactcggtacgaaggacgtaaacggtaaactaaacggtcggttcggtcggtaccg

SEQ ID NO: 9318 - DNA, 601 bp, Homo sapiens
  misc_feature: GYAE6OF01DHYJR.44.2.A02.1.454.CMB.1.raw
  modified_base (438)..(438): a, c, t, g, unknown or other
  misc_feature (438)..(438): n is a, c, g, or t
tcagacagtatatacacgaccggtgctcgatttagactcatctacaggggggggtctcaggaggcagcgctctcgggacgtctccaccatggcctgggctctgctattcctcaccctcctcactcagggcacagggtcctgggcccagtctgccctgactcagccctgcctccgtgtctgggtcacctggacagtcgatcaccatctcctgcattggaaccagcagtgacagttggtaggttataactatgtctcctggtaccaacaacacccaggacaaacgccccaaatcatgattcatgatgtcagtaatcgccctgagggtttctggtcgcttcgtctggctccaagtctggaccaacgaccggtccctccctagacctatcctacgtggcctccgaggtctggacggacgagctgacttatacgtgcagctanaagtaataaagaacgactaaactacttagttaacgtagttacgggaacgggtaacgggaacccaaaggtccgtaacggaccccggttacccgtaagggtacccctaacggaccccgtaaacgggtccctacccggtacccccccgttgggtccctaaccccgg

SEQ ID NO: 9319 - DNA, 722 bp, Homo sapiens
  misc_feature: GYAE6OF01BV2TZ.44.2.A02.1.454.CMB.1.raw
  modified_base (238)..(238): a, c, t, g, unknown or other
  misc_feature (238)..(238): n is a, c, g, or t
tcagacagtatatacacgaccggtgctcgatttagactcatctacagggggagtcagtctcagtcaggacacagcatgcacatggacgggtccccgctcagcctccgtggggcctcctgctactcgtggcctccggaggtcgccagatgtagacactccagatcgacccagtcctccactccctccctgtctgctatcgtggtcggagacagacgtccacatccacgtcggaccgganagtcagacgactagttaaggaactttacgtttaaaagttggtaactacgagaccgaaggacggaccgaaagggggaaaccctccccctaacaaccttccgtagacttactagtcgtcgtacgtccgtacctttagtttcggaacgtaaacgggtccggggtccctaaagtacgtaaggttccgaaggtcggacgtaggtaggacttcggtacggggaactaaggttaccttaccgtacttccctacgaacctagtaccgtacgccgtaacgttcacgacctaaccgttaaggaacgttaccgtttacacggtatttacctttaagtctttagaaaccacgtaagggtaaccgtataaaccgtaattaccccgtacccggtccttacggttacccgggttaccgggaacggggttacggtacccttgttaccgggtaaggaacgttaacctaaacggaaacgtacccgttggggtccgtaaccgg

SEQ ID NO: 9320 - DNA, 616 bp, Homo sapiens
  misc_feature: GYAE6OF01D42O8.44.2.A02.1.454.CMB.1.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (446)..(446): a, c, t, g, unknown or other
  misc_feature (446)..(446): n is a, c, g, or t
tcagacagtatatacacgaccggtgctcgatttagactcatctacaggggagctctgggagaggagccccagccttgggattcccaggtgttttcattcagtgatcaggactgaacacagaggactcaccatggagtttgggctgagctggtattttcctgctgtcttaattttaaaaggtgtccagtgtgaggtgcagttggtggagtcgtgggggaggtttggtaaagccgtggggagtcccttagacctctcctgtgcagcctctggattcactttcagtaacgcctggatgacctgggtccnccaggcctaccgaggggagggctgggagtgggtgcgtatagaaccaagctgacggtggangcagactacgctgccaccgtagaaacggcagacttccgaacatctaacaagaagtatagaattaacaaaagtatacggtntctactcgacagatagaaacagaccctaagaaccaccggagacaacgcgtacccgttacttagtaccgttcgttaccggtagggtacgtttacgggtttaccgacgggttacccggggacccgttaaaccggggtacccccttacgggtacccctcccggtttaccccgg

SEQ ID NO: 9321 - DNA, 732 bp, Homo sapiens
  misc_feature: GYAE6OF01CLRUT.44.2.A02.1.454.CMB.1.raw
tcagacagtatatacacgaccggtgctcgatttagactcatctacaggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgactagttggtggttataactatgtctcctggtaccaacaacacccaggcaaacgcccccaatcatgattcatgatgtacagtaactccggccctgtacggggtttctcggtccgtcttctcgtcggtctaccgaagtcgtggaccaaccgtaccgggtcccttccccgtcggaccctacgttcctacggttcggggccctacccggaagggtcccgttagggaaccgggaacggtacgggtccgttacggtaacctttaacgtttaccgtcggtaccctacggtccttaaccgtaaagttaaacgtaaaaaacggacgtaaccgtaaactaaccgtttaggtttaacttacggttacccggggaccggggtaaacggggaaacccgtaacgggtacccgttacgggtacccccggttaccggttaaccgggtacccgaaacccggacccccggtaaagggtcccccgttcccggtcccccccgtcggttaccccgttacccccgg

SEQ ID NO: 9322 - DNA, 763 bp, Homo sapiens
  misc_feature: GYAE6OF01D5N9N.44.2.A02.1.454.CMB.1.raw
tcagacagtatatacacgaccggtgctcgatttagactcatctacagggggagtcagtctcagtcaggacacagcatgcacatgaggtccccgctcagctcctggggctcctgctactctggctccgaggtgccagatgtgacatccagatcgacccagtctccactccctcctgtctgcatcgtgtcggagacagacgtccaccatcacttcggccggacaagtcagacgactaagttaacggtaactttacgttttaaaagttggttaactacgacgacgacggacggacccgaacgggaaaccgtccccctaacaaccttcccgtagtacttccgtaagtcgtcgttcggtcccgttaccgttagttttacggaacgttaaacgggtccggggtaccctagttaccgtaaaggttccgtaggtcggacgtaggtaggtacgttacggtacgggtaactacggtttactttaccgacctttacctaaccctacctaacttaccgacggtacctacggttaccgtaccgtaaccctaaacggttacggtaacgttaccgtttaccgaacgttactttaaccgtttaatttacgttacgtaactaaacgtagttaacgtaacgtaacctattacccgttacccgtaccgttaccgttacccgggttccggggtaccgggtaacggttaacccggttaggttagggtaacggtaacggtaacgttaaacccggtaaaggttacccgttggaccgggttaacccg

SEQ ID NO: 9323 - DNA, 617 bp, Homo sapiens
  misc_feature: GYAE6OF01ECXUP.44.2.A02.1.454.CMB.1.raw
  modified_base (220)..(220): a, c, t, g, unknown or other
  misc_feature (220)..(220): n is a, c, g, or t
tcagacagtatatacacgaccggtgctcgatttagactcatctacagggggagtcagtctcagtcaggacacagcatgcacatgagggtcccgctcagctcctggggctcctgctactctggctccgaggtgccagatgtgacatccagatgacccagtctccatcctcctgtctgcatctggtcggagacagacgtccaccatccacttcggccggganaagtcagagctattaggaacttactttaaagttggtatacagcagacggaccgaagggaaacgcccctacaacctcctgactctatgctcgcgttcctattttgactaaacggtcgggtacccatcgtaacggttcaggtggactaggtaggtacgtcgtagggactagtactttacaccgttctccacctataccagtctagtccgtacgaccgtaaccgtagtaacgttacgtttccgactagttactttaatttacttacgttacaacgtagttaacgtacgtaactaagttacctcccgtacctacgttaccggtttccggggacggtaaccgggtacttaggttgggtacggtaacgttaaccaacggtaaaccgtacgttggtcggtaccg

SEQ ID NO: 9324 - DNA, 677 bp, Homo sapiens
  misc_feature: GYAE6OF01D2IYL.44.2.A02.1.454.CMB.1.raw
tcagacagtatatacacgaccggtgctcgatttagactcatctacaggggagctctgggagaggagccccagccttgggattcccaggtgttttcattcagtgatcaggactgaacacagaggactcaccatggagtttgggctgagctggattttcctgctgctattttaaaaggtgtccagtgtgaggtgcggctgatggagtctgggaggaggtcttaggtcccaggtccggtcgggggggtccccaggagacttcctcctgtgcagcctcgtgggctccaccgtcagcagacaactacatgaggttcggccgcgacggctacgaggggagggctgggagtcgggtctcgagttctaagtttacagttggtgtatttacactatacgtacgcaagtacctccggtagaacgggtcccattaccaccacttcctaccgaacgggtaactaacgttaccgaagggtaaaccttacggttttaacttcgttaactaaaactcgaaaccaaccgttaggaacggacgggtaccgaaaccggacgaccgggtaccgttacgttaacgtttacgtcggttagaaccggtaacggtaaagtaacgggttccggacggttcccgggttagggtacggttttacggtttaagtttttaacggtttcggttttacgtaaccggg

SEQ ID NO: 9325 - DNA, 698 bp, Homo sapiens
  misc_feature: GYAE6OF01C0ZEY.44.2.A02.1.454.CMB.1.raw
  modified_base (242)..(242): a, c, t, g, unknown or other
  misc_feature (242)..(242): n is a, c, g, or t
  modified_base (280)..(280): a, c, t, g, unknown or other
  misc_feature (280)..(280): n is a, c, g, or t
  modified_base (344)..(344): a, c, t, g, unknown or other
  misc_feature (344)..(344): n is a, c, g, or t
  modified_base (460)..(460): a, c, t, g, unknown or other
  misc_feature (460)..(460): n is a, c, g, or t
  modified_base (581)..(581): a, c, t, g, unknown or other
  misc_feature (581)..(581): n is a, c, g, or t
tcagacagtatatacacgaccggtgctcgatttagactcatctacgagggggctggggtctcaggaggcagcgctctcgggacgtctccaccatggcctgggctctgctattcctcaccctcctcactcgagggcacgagggtcctgggcccagtctcgccctgacctcacgcctgcctccgtgtctcgggtacaccgtggacagtcgatcacctagtctcctggtactagttacggaaccngacgagtagtacgtagtttgggtattaactaactcgtnttccgtaccgtagtaaccaaccaacgaccgacgacaaaccgaccccaactacactacgtactanacgtagatacgtacaaggtaacctccggtacccgtcgggttacggtttcgtccgggtcttccgttcgtcgtcggacctacgacgttcgcggaacctaccggaccggtcccttaccncggaaccttcgttaccgtcgggtaccggtaccctacgggtacggtcgggttacggaaacgggtccgtacgtacggtacgtaacggtttactcgtacgacacgttactaacaaacgttaaanaaaccgggtaacaactacttaaccgtagttacgtacggtcgggaaccggtaacgacgtacggtacgtaccggtacgttacgacgacccgacggaccgtcgaccgtcccgcgtacccg

SEQ ID NO: 9326 - DNA, 673 bp, Homo sapiens
  misc_feature: GYAE6OF01AY0YH.44.2.A02.1.454.CMB.1.raw
  modified_base (221)..(221): a, c, t, g, unknown or other
  misc_feature (221)..(221): n is a, c, g, or t
tcagacagtatatacacgaccggtgctcgatttagactcatctacaggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccngcagtgactattgggtgttataactatgtctcctggtaccaacaacacccaggcaaacgcccccaaactcatgattcatgattgtacaaggtaactcggcccttcgtagggtttctggtccgtcttccgtcgtcggccttccgaagtcgtacgggccaaaccgaccggtccctccccgttacgaccctagttcccgtcgtcggggtacccttcccgagggtccttagggaacgggtaccggaacgggtccttagggtaaacctttagttaccctggaccgtaagtccgtaacgtaagttaaacgtaaaaacggaacgtaaccaaccgtaacgtttagttaatacggttccgggacgggtaacggaaccgaaggtccgtacggtacccgtacgtaacggacgtacccgacccgtaacgggccctaccggtccccccgttcggtccctacccgg

SEQ ID NO: 9327 - DNA, 546 bp, Homo sapiens
  misc_feature: GYAE6OF01BGZPL.44.2.A02.1.454.CMB.1.raw
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtcgtgggtcgcctggacagtcggtcaccatctcctgcactggacncagcggtaatnttcttagtcttaactttgtctcctggtatcaacatcatccaaggtaaaccgacccccaaactcatcatctatagacggtcctaataagcgtccctacgtagggtttactaatcgtcttcactcgcctacgacgtccgacacgaccgcctccagactactctcgtcggctcgngcgnggagagngtcgtagtattacttagttgtgtctcgtagtagttcgttcgtcgctactctacttatgtcgttagggagtcggacgacgtccgaccgtgtacgtcacgaccacggacccacccgactcgtcctctcccg

SEQ ID NO: 9328 - DNA, 748 bp, Homo sapiens
  misc_feature: GYAE6OF01C7ONV.44.2.A02.1.454.CMB.1.raw
  modified_base (194)..(194): a, c, t, g, unknown or other
  misc_feature (194)..(194): n is a, c, g, or t
tcagacagtatatacacgaccggtgctcgatttagactcatctacgagggggagtcagtctcagtcaggacacagcatgcacatggacgggtccccgctcagctcctggggctcctgctactctggctccgaggtcgcagatgtgacatccagatcgacccagtcctccatcctcctgtctgcatctggtcganacagagtcaccatcacgtcggccggactaattacagagactaagttaacggtaactttacgtttaaagttcggtactacgagtacgaaggacggaccgaacgggtaaacctaccccgtaactaaaccgtcctaggtacttaccgtagtcgtcctacgtccgttacttacgtttacggaaccgtaaacggttccggggtacctaacgtaaccggtaaggttacgtagggtacggtaccggtaggtacggtacttacgggaggtaactaagtactttaccgacgttaccaccgaaccgttacacggatcgtaacgttaccgaggtaaccctaacgtagaacgttacgtttaccgacttaacgttaacttttaacttaacgttaccgtaaacgtaacgtcggtaacgtaacggtaacctagttacccgaccccgtttacgtaccgggtttaacggttacccgggggaaaggttaaacccgggtcttaaacgggtttacggacggaaacggttaaacgtaaaacccgtaaacggttaacgttcggggtcgttaacccg

SEQ ID NO: 9329 - DNA, 698 bp, Homo sapiens
  misc_feature: GYAE6OF01C4FH3.44.2.A02.1.454.CMB.1.raw
  modified_base (235)..(235): a, c, t, g, unknown or other
  misc_feature (235)..(235): n is a, c, g, or t
tcagacagtatatacacgaccggtgctcgatttagactcatctacagggggagtcagtctcagtcaggacacagcatgcacatgacgggtccccgctcagctcctggggctcctgctactcgtggctccgaggtgccagatgtgacatccagatcgacccagtctccactccctccctgtctgcatcgtgtacggagacagacgtcaccatcacttggccgggacaagtcaaggngactaagtttaacggaactttacgtttaaaagtttggtaactcgaacgcaaggacgggaccgaacggggaaaaccgccccctaacctaaactcccgtagtacgttactagttcgtcgtcgtccgttaccttaagttttcgaacggtaaggttccggggtacctagttacgtaaacggttcgtaggtacggctaggtgagttcgtagggaacttaggtactttcaccgttctaccgtaactatacgacgtactacgtactacgacctaacgtaggtaaacttcgtttacgacgttacgttacttttaagtttacttacgtaactaaacgtaagtagttacgaaacttaacttaccgttaccccgtactacggtttaccggttacgggaaccgggtaaggtaacccgttaggttcgggtaacggacgttaaccgtaaacgtaaagtaccggtggttcggtacccg

SEQ ID NO: 9330 - DNA, 713 bp, Homo sapiens
  misc_feature: GYAE6OF01DY7WT.44.2.A02.1.454.CMB.1.raw
  modified_base (305)..(305): a, c, t, g, unknown or other
  misc_feature (305)..(305): n is a, c, g, or t
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatcgacccagtcctccactccctccctgtctgctatccgtggtacggagacagacgtccaaccatcacgttcggccggactaagtcaggagactaagttaagaacttatttaaagtggtaatcagacgaggacggacgaagggaaccgcccctanaacctcgtagataccgtagtcgcgtgtccgtacgttattcgagtaacgggtccggtaccagtacgtaaggttcgaggtcggacgtaggtcggtacgttacgggtaggaacctaggttactttacccgtaccgttacctaccaacctagtaccagtcgtacgttaccgacggtaaccaaccggttagtaacgttaccgttacgacgtttaacgttaccgttttaagtttaccgttaacgtaaacccgttaagtaacggttaacggtacttaaaccgtaccgttcccgtacccggttaccttacccggtttaaccgggttaacccggggcgggtaaaccggttacttacgggttagggaacggtaaacgtaacgtaaccgtaaaccggttacgttgggtaaccggtaccg

SEQ ID NO: 9331 - DNA, 674 bp, Homo sapiens
  misc_feature: GYAE6OF01BXCUK.44.2.A02.1.454.CMB.1.raw
  modified_base (202)..(202): a, c, t, g, unknown or other
  misc_feature (202)..(202): n is a, c, g, or t
  modified_base (525)..(525): a, c, t, g, unknown or other
  misc_feature (525)..(525): n is a, c, g, or t
  modified_base (591)..(591): a, c, t, g, unknown or other
  misc_feature (591)..(591): n is a, c, g, or t
  modified_base (658)..(658): a, c, t, g, unknown or other
  misc_feature (658)..(658): n is a, c, g, or t
tcagacagtatatacacgaccggtgctcgatttagactcatctacaggggagctctgggagaggagccccagccttgggattcccaggtgttttcattcagtgatcaggactgaacacagaggactcaccatggagtttgggctgagctggtattttcctgctgacttaatttaaaggtgtcagtgtgaggtgcaggttggnggagtcggtgggggtagtttaggaacgccgtgggacttccctagtacctctccgtgtcgcacgccctgtaggtacttcttacgtttacacggtaaccgccgtaggactcggaccggtcgggtcccgccgtacggccgtaccggagggggaacgggtcgtaggggaggttcggggtacgtacgttaagtaacgaaacgaagtcgtagggacgggacggatagcgaacgtaccgtacgtcgcgaccgaccggtagaacggtcagtacctacaaccgtactactaacgagtactagtaacgtactaaaagaacggtcgttacggtntccgttagacgtaagtagaacgtaacgaacgtcgtaacccgaacgaaccgtacggacgacgaccgngtacctacttaacgtacgtggtacggttggtaactttgtacgcgttcccggacgacggtaccccgtntacccgtccgtacccg

SEQ ID NO: 9332 - DNA, 833 bp, Homo sapiens
  misc_feature: GYAE6OF01EOICL.44.2.A02.1.454.CMB.1.raw
tcagacagtatatacacgaccggtgctcgatttagactcatctacagggggggggtctcaggaggcagcactctcgggacgtctccaccatggcctgggctctactcctcctcacgccctcctcactcgagggcacgaggactccgtgggctcgagttctcgccctggctcacgcctccctcgtcgtccggtctcctggacagtcacgtcaccatctcctgacactacggaaaccaactagtcgaccggttcggttcgtttggaccgtcgtccgtccgtaggtaccacgaccaccgaccccaagaaaccaccgaccccaaatctaatttacttagtcggtcgttactaagtccgttacccgtcccgtttccggttcgtcccgttagcgttaccgtccgtttctccgggttaccggtacgtaacggttacgttacggaacccgaacccgtacccggtccccttaaccccgtaccgaaccctacgttcccgttcggtaccgggtacccgtaccggaccggtacgttgggaacgggtaccgggaagtcgttagtaacgtttagttacctcggactacgtaccttacgtaaactaacgtaaccggtaacggtaacggtaaaccttaaccgtttaaccgttaaccggccggttaacgggaacgtaacccggggtaacctacggtacccggtaaaccgttaccccgggtttaaccgtaaacggggttaccaaccgggttaacccgaacgggttccccgtaccccggttccccccggttacccggtaccgttacccctttacccggtttcccccggttcccccgtacccccgtttacccc

SEQ ID NO: 9333 - DNA, 749 bp, Homo sapiens
  misc_feature: GYAE6OF01A5CXF.44.2.A02.1.454.CMB.1.raw
  modified_base (112)..(112): a, c, t, g, unknown or other
  misc_feature (112)..(112): n is a, c, g, or t
  modified_base (186)..(186): a, c, t, g, unknown or other
  misc_feature (186)..(186): n is a, c, g, or t
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
tcagacagtatatacacgaccggtgctcgatttagactcatctacgaggggggggtctcaggaggcagcgctctcgggacgtctccaccatggcctgggctctgctgctccnactctcctcaccaggacacgagggttcctagggcccagtctgccctgactcagcctgcctcgtgtctgggtccnctggacngtcgcaccntcctactgacacgtggaccgagacgtatnttcctagtctttacgttnactcgtgtatcaactntacacnccgtaagtaaccgacccctaactacacttntacttactaggtacgagtaccttaaggtaacgcggtcccgttacgtaacggggttttacctaaggttccgtaccgtttcaccgttacgtaccccgtaccggtaaaccgggttcccgaaaccggaacccgtaccggtaccccgttacccgtaacgggtaaccctaacgttcccgtacggtccggggtacctacggacggcgtacggacgtacgggtacgtcgtagttattaacgtttcgtacggttcgtctcgtaagttcgttacggttccgttaacgacctagttacctaacgtttcgtacggttaccggtacggtaacggtaccgggaaccgtaaacggttacccgttaacccggtacgttaaccggtaaccgcccggtaaccccggaacccgtaacccggtaacccccgttagttcccgaccgttacccgttccgtttcccccggg

SEQ ID NO: 9334 - DNA, 680 bp, Homo sapiens
  misc_feature: GYAE6OF01BCNUV.44.2.A02.1.454.CMB.1.raw
  modified_base (115)..(115): a, c, t, g, unknown or other
  misc_feature (115)..(115): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
tcagacagtatatacacgaccggtgctcgatttagactcatctacagggggctggggtctcaggaggcagcgctctcgggacgtctccaccagtggcctgggctctgctattccncaccctcctcactcgagggcacgagggtcctgggcccagtctcgccctgactcagcctgccctcgtgtcgtgggtcaccgtggaccaggtcgatccacctattcctcngctagtggaacccnggctagtgaacgtgtttgggtattaactaacgtatcgtcctccgtacgtaaccaacaaccacctagtacgaaccaaaccggtacccccaaatcaacgtagtacttacgatgtagtcgtacaacgttaccgtccggtccgttagggtacgggtttcgtcggtcgttcgttcctcggtcgtaccgttactacggttcgtaacggaacctaccggtaaccggtccttcccgtacgacctacgttccgtacggtcggtccgtacgacggtacgtcggaaacggcgtcggtacgtacgtactttaacgtcgtgacctacgtctaagtaactaacgtaaacgtacacgtaactgttaatacggtagtccgggaacggtaccggactagggtaccctaggacccttacgggatacccggaaccggtcccgagttcccccgcgtaccccgg

SEQ ID NO: 9335 - DNA, 686 bp, Homo sapiens
  misc_feature: GYAE6OF01CCIOF.44.2.A02.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (407)..(407): a, c, t, g, unknown or other
  misc_feature (407)..(407): n is a, c, g, or t
  modified_base (651)..(651): a, c, t, g, unknown or other
  misc_feature (651)..(651): n is a, c, g, or t
  modified_base (660)..(660): a, c, t, g, unknown or other
  misc_feature (660)..(660): n is a, c, g, or t
  modified_base (670)..(670): a, c, t, g, unknown or other
  misc_feature (670)..(670): n is a, c, g, or t
tcagacagtatatacacgaccggtgctcgatttagactcatctacgagggaaagggggaggaactgctcagttaggacccagagggaaccagtggaacgcccagctcagcttctcttcctctgctactctggctccagacttaccgacgggtaattgtgtgacacaatctcacgcctaccctgttactttgtctacggaaggggaaacncgccgtaccctntccgtagcgacggccaggtcaaggtagttacggttaaggaaccttacgtacgccgtagtaataccaacacgaacctccgtacggacccaggtccctaccgacggttcctaccgtctatcgtatcgagtcagtaacgtcgaacgtcgggccggacggcactccgacgacgttacggtcaggtacggngtacgggtcggtactaggacgactaaggttaccttccagttaccactacagtcgacggcgacgtacgggaacgaccgttaagttgttacgtacgtttaacgttagtcgtaagtactacgtaaccggtcgacggtcgtacggtacgttacggtacgtttacggttacggacggtagggtaccaggtccggaaggtacgtacgtacggtaaacggacggttaggtcgtacggtacgctaccgttanaccggtttntaccgttacnccgtttcgcccgtacg

SEQ ID NO: 9336 - DNA, 415 bp, Homo sapiens
  misc_feature: GYAE6OF01CQEU2.44.2.A02.1.454.CMB.1.raw
  modified_base (136)..(136): a, c, t, g, unknown or other
  misc_feature (136)..(136): n is a, c, g, or t
  modified_base (172)..(172): a, c, t, g, unknown or other
  misc_feature (172)..(172): n is a, c, g, or t
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (324)..(324): a, c, t, g, unknown or other
  misc_feature (324)..(324): n is a, c, g, or t
  modified_base (361)..(365): a, c, t, g, unknown or other
  misc_feature (361)..(365): n is a, c, g, or t
  modified_base (367)..(415): a, c, t, g, unknown or other
  misc_feature (367)..(415): n is a, c, g, or t
tcagacagtatatacacgaccggtgctcgatttagactcatctacagggggggggtctcaggaggcagctctctcggaatatctccaccatggcctgggctctgctcctcctcaccctctcactcagggcacaggntccgtggctcagtctgccctggctcagcccttcccncggtgtcccgggtctccgtggacagtcacgtcaccgnttcctctgacacgtggacgccaggtcgtacnccgacccgaaacggccccaaaccccggtccgaccctactccgttccgttccccaccccttcctacgtactacttacgtgtacgnggtacgggcggtcgtacggacgaacggcgtacagtgnnnnncnnnnnnnnnnnnnnnnnnnnnnnnnnnnnnnnnnnnnnnnnnnnnnnnn

SEQ ID NO: 9337 - DNA, 684 bp, Homo sapiens
  misc_feature: GYAE6OF01AMYEH.44.2.A02.1.454.CMB.1.raw
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
  modified_base (516)..(516): a, c, t, g, unknown or other
  misc_feature (516)..(516): n is a, c, g, or t
  modified_base (542)..(542): a, c, t, g, unknown or other
  misc_feature (542)..(542): n is a, c, g, or t
tcagacagtatatacacgaccggtgctcgatttagactcatctacagggggctggggtctcaggaggcagcgctctcgggacgtctccaccatggcctgggctctgctattccctcaccctcctcactcgacgggcaccgacgggtcctcgggcccagtcctcgccctgactcacgcctcgccttcgtgtcgtcggtccacgtggacagtcactccacctntcctctnactagtccgacagcagtacgtatgttcggtagttactacgtntacgttcctcgtacggtaaccaaaccgtaaccaacccgtacggaacccaacccgaacccccaatcgtactacgtacttccgtagtacgtgtactacgtaacgttaaccttcccggtccgttacgggtcggttttacgcgttacccgttccgtcgttccgtacgtcgtaccgtacgtcggtactacgtacccgtcccgcccttcgccgtactctacgtcgtcggcctaccgtgtcgacggacgcggngtaccgtagtctatactcgacacgtntaacgtaataaagtactaacgtactacgttaccgtaagtccgtacgtacggacggtacgaacgtaccgtaccggtacggtaccgtaccggtaccgtaccgtaacccgcggttaacccgtccgtccccgtcccggttacccgg

SEQ ID NO: 9338 - DNA, 762 bp, Homo sapiens
  misc_feature: GYAE6OF01DMU8R.44.2.A02.1.454.CMB.1.raw
  modified_base (234)..(234): a, c, t, g, unknown or other
  misc_feature (234)..(234): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (409)..(409): a, c, t, g, unknown or other
  misc_feature (409)..(409): n is a, c, g, or t
  modified_base (425)..(425): a, c, t, g, unknown or other
  misc_feature (425)..(425): n is a, c, g, or t
  modified_base (477)..(477): a, c, t, g, unknown or other
  misc_feature (477)..(477): n is a, c, g, or t
  modified_base (709)..(709): a, c, t, g, unknown or other
  misc_feature (709)..(709): n is a, c, g, or t
  modified_base (735)..(735): a, c, t, g, unknown or other
  misc_feature (735)..(735): n is a, c, g, or t
  modified_base (743)..(743): a, c, t, g, unknown or other
  misc_feature (743)..(743): n is a, c, g, or t
tcagacagtatatacacgaccggtgctcgatttagactcatctacgagggaaagggggaggaactgctcagttaggacccagagggaaccagtggaacgccccagctcagccttctccttcctcctgccttactctcggcctccaagactacccgaccggggtaaattgtgttacgacactaactcctccacgtccccacccttgttctttcgccgtaccggaaagggggaaanccgcccctaccctctcctcggacgaccgggccaggtcaggtagtacgttaagacttactacgtccgtagtacacaacncgaactccgcggaccncggccctaccgcgtcctcctacgatctatntatccgactacgacgtaacgggtaccgggcccggtcggaccaccgtacccncgtccggtcggtaacncgggtgacggtacggtcggtaccgtaaggacacggtaacgttccctaacctntaccctaccaacgtcgtacgccggtacccgtacgaaccggacggttaaccgttacgttaacgttaacgttacgtttaagtttaactctttacgtaaccctaacccggtaccgtaacggtcccggtaacggtcccggttaacggttaccggttacgttacgggttcccgggaccgggtaaccggaccgtacgtccggtagacgtaacctaccgtaacgtacggcggtacccgnggttaccgacttaccgtcttccgttnacccgttntcccctacggttccctacg

SEQ ID NO: 9339 - DNA, 478 bp, Homo sapiens
  misc_feature: GYAE6OF02GTVS2.44.2.A02.1.454.CMB.1.raw
  modified_base (456)..(456): a, c, t, g, unknown or other
  misc_feature (456)..(456): n is a, c, g, or t
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggaactctttaaattggtatcagcagaggccagggaaagcccctcaactcctgatctatgctgcgtccattttgcaaagtgggtccatcaaggttcagtgcagtgatctgggacagatttcactctcaccatcagcagtctgcaacctgaagtatttcgcagcttattattgtcaacagagttgaacaatatcccgctcactttcgggcgagggaccagttgtgganagttacaaacgactggtgtacg

SEQ ID NO: 9340 - DNA, 576 bp, Homo sapiens
  misc_feature: GYAE6OF02JX40K.44.2.A02.1.454.CMB.1.raw
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
tcagacagtatatacacgaccggtgctcgatttagactcatctacaggggagtcagtctcagtcaggacacagcatgcacatgaggtcccgctcagctcctgggctcctgctactctggctccgaggtgccagatgtgacatccagatcgacccagtctccatccctccctgtctgaccatctgtccggagacagacgtcaccatcacttgccgggacaagtcagacncattaggaacttctttaaatggtactacagacaggaggccaagggaacnccccgtacaacctccngactctatcgctgctctatttcgagtaaggtcggtccattcgaacggttcagtcggctagttggatcgtagggactagtatttcgacttactacgacctagtctacggctaacggtctcggacaacgttgaacgtctttcgatacgtactttaacgttgttacgtactaacgtagtacgttaagaaccttaacgtccgttacccgtctacgttaccgtttaccggggcgtaacggtactagttccggttagacgtacgtaaccgaacgtcgttacggtgtacg

SEQ ID NO: 9341 - DNA, 574 bp, Homo sapiens
  misc_feature: GYAE6OF02F13YM.44.2.A02.1.454.CMB.1.raw
  modified_base (302)..(302): a, c, t, g, unknown or other
  misc_feature (302)..(302): n is a, c, g, or t
  modified_base (387)..(387): a, c, t, g, unknown or other
  misc_feature (387)..(387): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
tcagacagtatatacacgaccggtgctcgatttagactcatctacaggggagctctgggagaggagccccagccttgggattcccaggtgttttcattcagtgatcaggactgaacacagaggactcaccatggagtttgggctgagcgtgagtttcctaggctgactagtttaaaggtgtcagtgtgaggtgcagttggtggagtcgtgggggaggtttggtaaagccgtggggagtcccttagactctcctgtgcagcctctggattcactttcagtaacgcctggatgacctgggtccnccaggcctccgagggagggctggagtgggtgcgtatacgaacaagctgacggtggacagcagactacgctgcaccgtgaaacggnagattcacatcacaagagatgattacgaaaagntacggtntctctgacagtatacgaacagcctaggaaccacggagaaccacgacgtacccgtcttacgttacgtcggttcgtagggttacttgggttttacaggttcccgggaccgtaacggggtaccccttggggtacccctacccggttcccg

SEQ ID NO: 9342 - DNA, 520 bp, Homo sapiens
  misc_feature: GYAE6OF02IA9UZ.44.2.A02.1.454.CMB.1.raw
  modified_base (360)..(360): a, c, t, g, unknown or other
  misc_feature (360)..(360): n is a, c, g, or t
  modified_base (509)..(509): a, c, t, g, unknown or other
  misc_feature (509)..(509): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgcgtccgggtctcttggacagtcagtcaccatctcctgcactggcaccagcagtgacattggtgttataactttgtctcctggtaccaacaccacccaggcaaagcccccaaaattcatcatttatgatgtcagtaagcgccctcaggggtccctgatcgcttctctgctccaagtctggcaacncggcctccctgacccgtctctgggctccaggctgagatgaggctgacttatttctgctcctcattatgcaggcgacgttagttttatgttcttcggaactgggacctaaggtccaaccgtcctacgtcacgacccaacggcccaacccnctcgtctaccg

SEQ ID NO: 9343 - DNA, 585 bp, Homo sapiens
  misc_feature: GYAE6OF02G99YM.44.2.A02.1.454.CMB.1.raw
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccttccttcctgtcttcttctgttggaggcagcgtcaccatcacttgccgggcgagtgccgacattaggacttttttggcctggtttcagcaggancctggcaaagcccctaagtccctgatcttttcnggactccactttgaagagtggagtcccagccaggttcagcggcagtggtctgggacacatttcacttctcaccatcagcagcctgcagcctggagtatttcgacgtacttacttactcgacctaacaattacttacttttttaagtcccgttaacttacggtttttggaccgtacggggtaacctaaaggtccgttagggacgtacgttacgaaaagggtaaaccttggtacgggtccgttacggacctaacccgtaacttaccgttacggttacctttaccgtactttccccg

SEQ ID NO: 9344 - DNA, 546 bp, Homo sapiens
  misc_feature: GYAE6OF02IS99H.44.2.A02.1.454.CMB.1.raw
  modified_base (303)..(303): a, c, t, g, unknown or other
  misc_feature (303)..(303): n is a, c, g, or t
  modified_base (431)..(431): a, c, t, g, unknown or other
  misc_feature (431)..(431): n is a, c, g, or t
tcagacagtatatacacgaccggtgctcgatttagactcatctacaggggagctctgggagaggagccccagccttgggattcccaggtgttttcattcagtgatcaggactgaacacagaggactcaccatggagtttgggctgagctggtatttccttgctgctattttaaaaggtgtccagtgtgaggtgcagttggtggagtcgtgggggaggtttggtaaagccgtggggagtcccttagactctcctgtgcagccctctggattcactttcagtaacgcctggatgacctgggtccncgaggctccgagggaagggctggagtgggttggccgtattagaaccaagctgacggtggacagcagactcgctgcaccgtgaaaggcagactcacatactcaagagatagattacaaaagatacggtntctctagacagatagaacagcctagaacaccgagacacgacgccgtactattactggtcgtaggtacgttggttacgtagttcgggaccgtacgggaccctgggtcctaccgtcc

SEQ ID NO: 9345 - DNA, 564 bp, Homo sapiens
  misc_feature: GYAE6OF02F519S.44.2.A02.1.454.CMB.1.raw
  modified_base (377)..(377): a, c, t, g, unknown or other
  misc_feature (377)..(377): n is a, c, g, or t
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggaacttctttaaattggtatcagcagaggccaagggaacgcccctacaactcctgatctatgctgcgttcctattttgactaaaggtcggggtcccatcgaaggttcaggtggcagtggatgtgggacagtatttcactctcaaccntcagcagtctgaccaactgaagtctttccgctagtctttatttatgtacaacgtagtacgtacgaactaaattacctaccccgtactaccgttacgttttaccggggaccgggttaacgggaaccttaggtttacgggtagggtaacgtacgttaaccgaaaaccggtacgttcgggtagggtaccg

SEQ ID NO: 9346 - DNA, 551 bp, Homo sapiens
  misc_feature: GYAE6OF02FO7UG.44.2.A02.1.454.CMB.1.raw
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtggttataactatgtctcctggtaccaacaacacccaggcaaagcccccaaatcatgattcatgatgtcagtaatcggccctgaggggttttctggtcgtcttctctggctccaagtctggaccaaacgaccggccctccctgacccatctcgtgggctccgaggctggaggacgaggctgactattacngcagctcaatagtaaagacncaaacacttgttaatacgttcgggacggtagggaccctaaggccgttacggacccgtcgttaaggcacggaccccgtaagggcctacggtaccccccgtaccgg

SEQ ID NO: 9347 - DNA, 569 bp, Homo sapiens
  misc_feature: GYAE6OF02I5OEF.44.2.A02.1.454.CMB.1.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtctgggtcgcctggacagtcggtcaccatctcctgcactgganccagcggtaatattcttagtcttaactttgtctcctggtatcaactatcatccaaggtaaacncccccaaaactcatcatctatgaggcctaataagagccctgtacgggtttctaatcgtcttacactcgtcctccaagtcccgacaacaccggcctccctagacctaatctcgtcggcctccgaggctaggacggacgaggtctaggtaattattagttgttcgtctacgagtattcgttcgtcgactatctactttatcgtcgttacggaagtcgggactaaggtcctaccggtacgtaggtccacgacccgaacggcccctaaacccagtcgtaccacttcccg

SEQ ID NO: 9348 - DNA, 553 bp, Homo sapiens
  misc_feature: GYAE6OF02FZFXX.44.2.A02.1.454.CMB.1.raw
  modified_base (411)..(411): a, c, t, g, unknown or other
  misc_feature (411)..(411): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaacccagcagtgacattggtggttataactatgtctcctggtaccaacaacacccaggcaaacgccccaaactcatgattcatgatgtcagtaatcggcctcgaggggtttctggtcgcttctctggctccaagtctggccactcagccctcctggccatcactgggctccgaggctagaagatggagggtntattattactgcctagtcctatcgacagctacgcctcgagttgggttgggttcggttcgggacgggtaacgggaacccgtaaggccgttagacccggttccgtcggggttaccgaccggtaccccgaaggccgttaccccgg

SEQ ID NO: 9349 - DNA, 592 bp, Homo sapiens
  misc_feature: GYAE6OF02HRUH9.44.2.A02.1.454.CMB.1.raw
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctccctgtctgcatctgtcggagacagagtcaccatcacttgccgggacaagtcagagcattaggaactactttaaaattggtaatcagcagaggcaagggaaacgcccctacaactcctagatctatgctgcgtcctattttgacgtaaaggtggggtaccctagtactaaggttcaagttcggactaggttaggatcgtagggactagtagttctactcctaccaaccatacagcagtctacgcaaacctagtaaagtactttcgacgtagtactttaattagtttacgtaccaaacgtacggtaagttacaaacgtaaacttaactccccgtacctaccgttacgttttccggggaacgggtaacgggtacctaagttacggtggtaacgtacgtaacgtaaacgtaacttaggtggtaccg

SEQ ID NO: 9350 - DNA, 586 bp, Homo sapiens
  misc_feature: GYAE6OF02FS2SN.44.2.A02.1.454.CMB.1.raw
  modified_base (439)..(439): a, c, t, g, unknown or other
  misc_feature (439)..(439): n is a, c, g, or t
  modified_base (513)..(513): a, c, t, g, unknown or other
  misc_feature (513)..(513): n is a, c, g, or t
tcagacagtatatacacgaccggtgctcgatttagactcatctacaggggagctctgggagaggagccccagccttgggattcccaggtgttttcattcagtgatcaggactgaacacagaggactcaccatgggagtttgggctgagctggattttccttgctgcttattttaaaaggtgtccagtgtgaggtgcagttggtggagtcgtgggggaggtttggtaaagccgtggggagtcccttagactctcctgtgcagcctctggattcactttcagtaacgcctggatgacctgggtccgccaggctccgaggggaaggggctgggagtgggttggccgtattagaaccaagctggacggtgggacagcagactacgctgccacccgtgaaacggcagattcaccatctcaaagagatgtaacttacaaaaagtntaacggtgtaccttcgtgacagatagaacagcctagaaccgaccggaggaccacgacgaccgtactactttacnggtctagggtattggtttacacggtttccgggacccgtacggggtaacccctgggtacccgtacccgttcccg

SEQ ID NO: 9351 - DNA, 760 bp, Homo sapiens
  misc_feature: GYAE6OF02GOMEE.44.2.A02.1.454.CMB.1.raw
  modified_base (384)..(384): a, c, t, g, unknown or other
  misc_feature (384)..(384): n is a, c, g, or t
tcagacagtatatacacgaccggtgctcgatttagactcatctacagggaaacggggggggtaaggtacccctgtggaaaaacgggtcagaggaccaaacggatgggaggggtcaggctaggaactgaggagtcagtctcagtctaggacgacagcatggacagtgaggtcccgcctcgacgcttcctggggctcctgcgtactcgtggctccgaggtagcccgagatgtgacattcccagatagaccctagtcgtaccttcctccctgttctgtctttctatagagacagtagtcgccatcgacccgttagaccgggctaagtcgagaccagttaacaggacttagtttaaagttggtatcagacaagaagaccaagggaacnccctagtaaccttcctagtactctcgtcgtaccttgccctaccacgtcctacgaccgtaacgggtcggtaacgtccttacgtttaccgtaaacggtttcgtaagggttcgggtaccgtaagggttacgggtaacgttacggtaggggtaacctaaggtaacttttaccgaacccgttcgtacccttaacccgttattaacccgtttacccgtaagttcccgtagaacccgttaaccgtacggtaacggtttaccttttaccggaaccgttaaacccggttttaaccggttaaccgttacgtttaaccgaaaccgttacgggttaaccggtttaacccgttaacgggttaccccgttacccccggtttttaacccgg

SEQ ID NO: 9352 - DNA, 260 bp, Homo sapiens
  misc_feature: GYAE6OF02JY3BF.44.2.A02.1.454.CMB.1.raw
  modified_base (187)..(187): a, c, t, g, unknown or other
  misc_feature (187)..(187): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
tcagacagtatatacacgaccggtgctcgatttagactcatctacaggggagtcagtctcagtcaggacacagcatgcacatgagggtccccgctcagctcctgggctcctgctactctggctccgaggtgccagatgtgacatccagatgacccagtctccatcctcctgtctgcatctgtcgganacagagtcaccatccaacttggccgggacaagtcagagcattaggaactctttaaaatggtatcgtancagan

SEQ ID NO: 9353 - DNA, 594 bp, Homo sapiens
  misc_feature: GYAE6OF02IHK3I.44.2.A02.1.454.CMB.1.raw
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (458)..(458): a, c, t, g, unknown or other
  misc_feature (458)..(458): n is a, c, g, or t
tcagacagtatatacacgaccggtgctcgatttagactcatctacaggggagctctgggagaggagccccagccttgggattcccaggtgttttcattcagtgatcaggactgaacacagaggactcaccatggagtttgggctgagctggattttccttgctgcttattttaaaaggtgtccagtgtgaggtgcagttggtggagtcgtggggggaggttttggtaaagccgtggggacgtcccttagactctcctgtgcagcctntggattcactttcagtaacgcctggatgacctggtccncnggctccgagggagggctgggagtgggtgcgtatagaacaagctggacggtggacagcagactacgctcgccaccgtagaaacggcagtacttccacatccacgaaaganatgaacttacaaaagtntacggttntctcngcagaatgaacngtccagaaccacgagacacgacgtccgttatacttacgtcggttacggtagggttacgtttcgggttttaccagggtttccccggggaccgtaaccgggggttaacccccgtgggttaccccctaacccggttccc

SEQ ID NO: 9354 - DNA, 641 bp, Homo sapiens
  misc_feature: GYAE6OF02HFKI8.44.2.A02.1.454.CMB.1.raw
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatccctccctgtctgcatctgtcggagacagagtcaccatcacttgccggacaagtcagagctaagttaggaacttactttaaattggtaatcgagcaggacggccgaaggaaacgcccctacaacctcctgatctatgctgctctatttgacgtaaggtcgggtaccatacgtaaggttcaggtggacgtaggtagatcgtagggactagtactttacactctacactactcacgcacgtcctgactacgtccgtaggacgttacgttacgtaccgttaactttacttaaccgtacgtaacccgtaaaacttaacttttaacttttaccttttttttaacgtaacccgtttaacgtttaaccggttttaccgggacccgggtaacgggtaacccgtaacggtaccggtagggtaaacgtaacgtaaacggtaacggtaaacgttcgggtacggtaccgttacggaccttaacccgg

SEQ ID NO: 9355 - DNA, 625 bp, Homo sapiens
  misc_feature: GYAE6OF02F43ID.44.2.A02.1.454.CMB.1.raw
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
  modified_base (476)..(476): a, c, t, g, unknown or other
  misc_feature (476)..(476): n is a, c, g, or t
  modified_base (617)..(617): a, c, t, g, unknown or other
  misc_feature (617)..(617): n is a, c, g, or t
tcagacagtatatacacgaccggtgctcgatttagactcatctacagggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtggggggagtttggtaaagcctggggatcccttagactctcctgtgcagcctntggattcactttcagtaacgctggatgacctgggtccncaggctcgaggagggcnggagtgggtgcgtatacgaacaagctaggacggtggacagcagactacgctgaccacccggtagaaacggccagtacttaccgaacctatacctacgaaaggacgtaattaggtaacttaaacgaaaaaggtacgtttaacgggttacgtaccttacgnggacctaaggtattaacgaaacctacggccgtaagaaacccgaaccggacggaaaccacgaccgtaccgttactagttaaccgtgtcggtaggtattcggttacgtaggttccgggacgtaaccgggtaccctggtacccnccgttccg

SEQ ID NO: 9356 - DNA, 676 bp, Homo sapiens
  misc_feature: GYAE6OF02I2K01.44.2.A02.1.454.CMB.1.raw
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
tcagacagtatatacacgaccggtgctcgatttagactcatctacagggggagtcagtctcagtcaggacacagcatgcacatgagggtcccgctcagctcctggggctcctgctactctggctccgaggtgccagatgtgacatccagatgacccagtctccatcctccctgtctgcatctgtcgganacngagtcaccatcacttgccggacaagtcagagcattaggaactctttaaagttgtatcagcagaggccgaagggaaacgccccgtacaactccgtgactctatgcgtgccgttacctagttttcgacgtaaacggtcggggttacccaagtaccgtaaggttcgtaaggttcggacgtaacggtgggtaacgttcggtacgggtaacgtagttaactttcgtaacccgttccttacccgtaaccaacgttccgaacggtcgtacggttacctacgaccgtaacccgttaagtaacgtacttttccgacgtacgttacctttaagtttacgttacgttacctaaaccgtagtaacgttacgaaacttaacttaaccgttcccgtaccttccgttaacggtttacccggggcgggtaaacggtaccgtaacgttagggttacggtaacggtacttaaccggaacgttaacgtaggtacggtaaccgg

SEQ ID NO: 9357 - DNA, 573 bp, Homo sapiens
  misc_feature: GYAE6OF02F6R9G.44.2.A02.1.454.CMB.1.raw
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctccctgtctgcatctgtcggagacagagtcaccatcacttgccggcaagtcagagcattaggaactctttaaattggtatcagcagaggccaagggaacgccctacaactcctgactctatgctgcgttcctattttgacgtaaaggtcggggtacccagttacgtaaggttcaggtcggtctaggtggtactcgtagggactaggtactttcgacttcgtaccacctatcagctacgtctcgacctactagaagttacgttcgactagtactttaagtttacgttagtacaacgtagtagtacgtaactaacttacgtcccgtactacgtaccgtttcgggacggtaacggaccgtacgttggtacggtagtactaaccgtaaacgtacgttaggtaggtaccg

SEQ ID NO: 9358 - DNA, 619 bp, Homo sapiens
  misc_feature: GYAE6OF02FOLC4.44.2.A02.1.454.CMB.1.raw
tcagacagtatatacacgaccggtgctcgatttagactcatctacagggggagtcagtctcagtcaggacacagcatgcacatgagggtccccgctcagctcctgggactcctgctgctctggctcccagataccagatgtgacatccagatgacccagtctccatcctccctgtctgcatctgtgggagacagagtccaccatcacgttgccgggcgagtcagggcagttagcaattatttagccttggtatcagcagaaaccagggaaagctcctaaacctcctgacttctttggtctgctatcctactttgctaatcgacggggtccatccgtcgttcacgcgcgagtggatcgtggacagtatttcgtctctacactactccagcacgccctggcacggacctacggaaacgtacgttgttacggtaccttaaaccgtttacgtttaaccttacgttaacctaaaaagttaaacccgaaacttaaccggtaccggtacccccttaccgtaacccgttaacgttttccccgggaacccgttacccggggtaaaccgttaaacggtacggtaacgttaacgttaaccctaaaccggtaacgttacggtaggtaccgg

SEQ ID NO: 9359 - DNA, 621 bp, Homo sapiens
  misc_feature: GYAE6OF02FY9D4.44.2.A02.1.454.CMB.1.raw
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctcctgtctgcatctgtcggagacagagtcacctatcacttggccgggcgagtcgccgacagttacggtactttttggccttggtttcagtcaggtacgcctggacaaacgcccctaaagtccctagtacttcttttcgtggacttcctatttagaagtagtggacttcccagcccgtaggttccaggtcggacaggttcggttcgtcgggacacgtatttaccgacttctaccgtacctactcacgtccacgtcctgccacgccgtggacgtacgtttcgacgttacttacttactcgacctaaactaattaactttacttttttacgtaccgttacgttacgttttacggaccgtaacggggaccgttaacggtcgtacgggtaatacgttaacgaaacggtacgttacggttacggtcgtacggtacctaccgtattccgttagttacccg

SEQ ID NO: 9360 - DNA, 641 bp, Homo sapiens
  misc_feature: GYAE6OF02HHH5H.44.2.A02.1.454.CMB.1.raw
  modified_base (220)..(220): a, c, t, g, unknown or other
  misc_feature (220)..(220): n is a, c, g, or t
  modified_base (261)..(261): a, c, t, g, unknown or other
  misc_feature (261)..(261): n is a, c, g, or t
tcagacagtatatacacgaccggtgctcgatttagactcatctacagggggagtcagtctcagtcaggacacagcatgcacatgagggtccccgctcagctcctggggctcctgctactctggctccggaggtgccagatgtgacatccagatgacccagtctccatccctccctgtctgcatctggtcggagacagacgtcaccatcacttggccgggnaagtcagagcagttaggaacttactttaaattggtatcagnaaggaggaccgagggaaacgcccctacaacctcctagatctatgctgcgtctattttgacgtaaaggtcgggtacctagtacgtaaggttcgaggtggacgtaggtagggtatacggtagggactaggtactttccgtacttcgtaccacctagtaccagtcgtacgttacgtacgaccgtaaccgtaggtaagttacgttacgacgtagttactttaagtttacgttagtaaccgtaaagtacgggtacttacgtaaactaaacttacccgtacccgtaccttacgttaccggtaccggggtaacggaccgggttaacgtacggttagggtacgtaacgttaacgtaaccggtaaacggtacggttacggacgttaccg

SEQ ID NO: 9361 - DNA, 584 bp, Homo sapiens
  misc_feature: GYAE6OF02GJKY0.44.2.A02.1.454.CMB.1.raw
  modified_base (262)..(262): a, c, t, g, unknown or other
  misc_feature (262)..(262): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
tcagacagtatatacacgaccggtgctcgatttagactcatctacaggggagctctgggagaggagccccagccttgggattcccaggtgttttcattcagtgatcaggactgaacacagaggactcaccatggagtttgggctgagctggattttccttgctgctattttaaaggtgtccagtgtgaggtgcagttggtggagtcgtgggggaggttttggaaagccgtggggagtcccttagactctcctgtgcagcctntggattcactttcagtaacgcctggatgaccgtggtccgccaggctccgagggagggctgggagtgggtgccgtatagaacaagctgacggtggacngcagactacgcngcacccgtagaaacggcagattccaccatctacaagagatagtaattacaaaagtattaacggttgtaccttacgtacgtcgaagtatacggaactacgcctagaacgaccgagaaccacacgccgttactacttacgtggttcgtaggttacttcggtttactacggttccgggaccgtaaccgggtacccgtcgggtaccctaccgtcccg

SEQ ID NO: 9362 - DNA, 631 bp, Homo sapiens
  misc_feature: GYAE6OF02F20LC.44.2.A02.1.454.CMB.1.raw
  modified_base (132)..(132): a, c, t, g, unknown or other
  misc_feature (132)..(132): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
tcagacagtatatacacgaccggtgctcgatttagactcatctacagggggagtcagtctcagtcaggacacagcatgcacatgagggtcccgctcagctcctgggctcctgcctactctggctccgaggtnccagatgtgacatccagatgacccagtctccatcctcctgtctgcatctgtcggagcagctcacctatcacttggccgganaagtcagngcattaggacttactttaaagtggtatcagcaagcggcgaggaacnccctacactcctgactctatgctgcgtctatttgactaaacggtcgggtaccctataccgtaaggttccgagttacggctaggttacggactcgtagggaaccgtagttactttaccgaactccgttacaaccgtacgtacacggtactaccgttacgtacgacctaaacgttaacggtaacgttacgtttaccgacgtacggttactttaacgtttaagtttccgaaacttacgtaagggtcttacgtaaaccgtacttaccgtaacccgttgttacccgttacgtttacggggaacccggtaacggtacctaagtttcggaagtaaccgataccggtaaacgtaacgttggtaccggtaccg

SEQ ID NO: 9363 - DNA, 670 bp, Homo sapiens
  misc_feature: GYAE6OF02F7J6K.44.2.A02.1.454.CMB.1.raw
  modified_base (311)..(311): a, c, t, g, unknown or other
  misc_feature (311)..(311): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgctattcggaaccagcagtgactagttggtgttaataactatgtctctgtaccaacaacaccaggacaaacgccccaactcgatgacttcatgatgtanagtaactccggtcctcgtagggtttctggtcgtcttcgtctcggtcctacgtaagttcgtacggaccaacgtaccggtccctcccgtacgacctacttccgtcggtcgggtacctccgacggtcgttacgggaacgggtacgacggtcgttacgactttaacgttacgtcgtactacgtaccgtactaaacgtaaagtaaaaacgaacgtactaaacgtacgttaagtttaacgttacggttacgggacgggtaacggtaacccgtacggttaccggtaccggtaccccgttcggttaacggaccgttaaccgggacccgttaaccgggtcccgttaccccggcccccgttaacccggg

SEQ ID NO: 9364 - DNA, 683 bp, Homo sapiens
  misc_feature: GYAE6OF02GNSDH.44.2.A02.1.454.CMB.1.raw
  modified_base (526)..(526): a, c, t, g, unknown or other
  misc_feature (526)..(526): n is a, c, g, or t
tcagacagtatatacacgaccggtgctcgatttagactcatctacagggggagtcagtctcagtcaggacacagcatgcacatgagggtcccgctcagctcctgggctcctgctactctggctccgaggtgccagatgtgacatccagatcgacccagtctccatccctcctgtctgcatcgtgtcgagacagagtccaccatcacgttggcccgggacaagtcagacgactaagttaacggaacttacttttaaagttgtagttacaacgacgaggacggaccgaagggtaaacccgccccgtacaaaccgttcctacggtacttactaagttcgcgttcgtaccgttccttattttacgacgtaaacggttccggggtaccctaagtacgtaacggttacgaggtcggacgtaggtggtacgtcggtagggtaactagtttacttctaccgtacctacctacacgtcagtaccgtgttactcacgtaaccgtaagtagtactttcgactgtacgtttaactttntacgtaacacgtaagtctaacgaacgtaactttaaccggtcccgttacccgttacgtttacccggttccggggtaaccggaacggttaccgttaggttaccgggttaggaacttaaccggtaaaccgtaaaggttaacccggtggttaccggtaccg

SEQ ID NO: 9365 - DNA, 430 bp, Homo sapiens
  misc_feature: GYAE6OF02GU5BR.44.2.A02.1.454.CMB.1.raw
  modified_base (114)..(114): a, c, t, g, unknown or other
  misc_feature (114)..(114): n is a, c, g, or t
  modified_base (215)..(215): a, c, t, g, unknown or other
  misc_feature (215)..(215): n is a, c, g, or t
  modified_base (374)..(374): a, c, t, g, unknown or other
  misc_feature (374)..(374): n is a, c, g, or t
  modified_base (376)..(430): a, c, t, g, unknown or other
  misc_feature (376)..(430): n is a, c, g, or t
tcagacagtatatacacgaccggtgctcgatttagactcatctacaggggggggggtctcaggaggcagcgctctcgggacgtctccaccatggcctgggctctgctgctcctnactctcctcacccaggacactagggtcctgggcccagtctgccctgactcgagccttgccttccgtgtctgggtcgccgtaggactggtcggtccaacctntccttcctgccaagtcgggacgccaggccggtacacgccccgaacggccccaaacccctagtcgtaccaccttccgtccgttcccccaaccttccttacgtacttaactcctgtcttaggacggtcgggactggaccgaacgggtccactaagtaggcngnnnnnnnnnnnnnnnnnnnnnnnnnnnnnnnnnnnnnnnnnnnnnnnnnnnnnnn

SEQ ID NO: 9366 - DNA, 695 bp, Homo sapiens
  misc_feature: GYAE6OF02H7KO3.44.2.A02.1.454.CMB.1.raw
  modified_base (191)..(191): a, c, t, g, unknown or other
  misc_feature (191)..(191): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
tcagacagtatatacacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctccctgtctgacatctgtcgganacagacgtccaccatcacgttcggaccgggactaacgtcaaggagactaagttaacggtaacttacgttttaaaattgggtaattcgaaggaccgaaggacggaccgaaaggggaaaccnccccccttanaaaccttccgtagacttactaatcggcttcggtaccgtaccttaattttacggacgtaaaacgggttccggggtaccctaagtacgtaacggttcgaaggttcggacgtaggtacggtatacggtagggaactaaggtaacttacacctctaccgtaactactacgacgcaacgtccgtagcgtaacggtcctaagtacttagttagtttacgaaccttaactttaacttacgacgtaaacccgtaaagtaacgttaaattaacggttagtttaacttcgtacgtaggtttacggtttacggaccggtaaacggggtaccctaaggtaccgtaggaactaacgttaaccaacggttaacgtcggtacgtaccgg

SEQ ID NO: 9367 - DNA, 708 bp, Homo sapiens
  misc_feature: GYAE6OF02F94PV.44.2.A02.1.454.CMB.1.raw
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
  modified_base (624)..(624): a, c, t, g, unknown or other
  misc_feature (624)..(624): n is a, c, g, or t
  modified_base (696)..(696): a, c, t, g, unknown or other
  misc_feature (696)..(696): n is a, c, g, or t
tcagacagtatatacacgaccggtgctcgatttagactcatctacagggggagtcagtctcagtcaggacacagcatgcacatgagggtccccgctcagctcctgggctcctgctactctggctccgaggtgccagatgtgacatccagatcgaccagtctccatcctccctntctgcatctgtcgganacagcgtcaccatcaacttcggccggtacaagtcgagacgctaagttacggtaaccttacttttaaagttcggttaactacgaacgtccgaaggtacgggaccggaaaggggaaacccgtccccctacaaccgttccgtagtacttctaagtcgaccgttgtcccttacgttagttttacgaacgtaaacgggtccggggtaccctaagtaaccggttaaacggttccggtaagggtcggtacgtaagggtcggtacgttaccgggtagggtaaccgtaaggtttacctttccgaacctttaccgtaccctaaacctcgtaccgaaggtaccgtaccgttacgtacgtaacccgtaaacgttaacggtaacgttacgtttccgaccgttaagttacctttaagtttcggtaacttaccgaaataggtaaccgtanaaacgtaacttcctacccgtacttcgtaccgttcgggtcggaccgtatcgttgagactacgtaaccgtaacncgtagtgtaccg

SEQ ID NO: 9368 - DNA, 625 bp, Homo sapiens
  misc_feature: GYAE6OF02ICQ51.44.2.A02.1.454.CMB.1.raw
  modified_base (154)..(154): a, c, t, g, unknown or other
  misc_feature (154)..(154): n is a, c, g, or t
tcagacagtatatacacgaccggtgctcgatttagactcatctacagggggctgggtcacaagaggcagcgctctcgggacgtctccaccatggcctgggctctgctgctcctcactctcctcactcaggacacagggtcctgggcccagtctnccctgactcagcctgcctccgtgtctgggtatccgtggacagtcgatctaccttctcctgccactggactcgacgcaggtcgaggcttactaaccttacttaatcgtccgtccttccgtaggtactacaaacgaactacgtaccccgaaccaaaacccccctaaaacttcgttacgacttacattacgaaactactactaacgccggtccctcgtacggttactttctagtcgttacgtcttctacgtcggtactccggacgtccgaactaccgaccgcctccctagactaacttcctcgttcggacctccgtaacgcgtaggacggagaacggttactaaattcttctcgttcctactatactacgtcttacgtttggttggttcggtctcgggaggtacggaccgtaggtaccgtacggtcgtagtcgacggtaccacggtcctccgtccccgtagtcctcttcctccg

SEQ ID NO: 9369 - DNA, 718 bp, Homo sapiens
  misc_feature: GYAE6OF02GWL0T.44.2.A02.1.454.CMB.1.raw
  modified_base (196)..(196): a, c, t, g, unknown or other
  misc_feature (196)..(196): n is a, c, g, or t
  modified_base (687)..(687): a, c, t, g, unknown or other
  misc_feature (687)..(687): n is a, c, g, or t
  modified_base (715)..(715): a, c, t, g, unknown or other
  misc_feature (715)..(715): n is a, c, g, or t
tcagacagtatatacacgaccggtgctcgatttagactcatctacagggggagtcagtctcagtcaggacacagcatgcacatgagggtccccgctcagctcctgggctcctgctactctggctccggaggtgccagatgtagacatccagatcgacccagtctccatccctcctgtctagctatcgtggccgganaccgagtacgtaccacctatacgtacgttacggcccgggactaacgggtacaagggactaaccgtaagttaaacgggtaaaccttttaacgttttaaaagttagggtaacttccgaaggtaccgtaacgggtacgggaaccccggaaacgggggtaaaaccccctaccccttaacccgtaaaccgttcccgtcggtaaacttccgtaacgttccggacgtcggtaccgttaccgtttagtttaaccggacgttaaacgggtcggtaccctaagtacggtaacgttccagggtcgacgtgacggtatccgagggtaactagtacttccacctcactaccagtccgacgcacgtccgtgacccgtaggtccaggttacgttattccgtttaacgacctttaaacgtttactaccgtacgtacctaaagtagttaactaagttacgttattccgtaagttcggtaggtccggaaggtaccggactacgtacggngtaactacgtaacgtactaggtacggtnacg

SEQ ID NO: 9370 - DNA, 737 bp, Homo sapiens
  misc_feature: GYAE6OF02GXGBI.44.2.A02.1.454.CMB.1.raw
  modified_base (732)..(732): a, c, t, g, unknown or other
  misc_feature (732)..(732): n is a, c, g, or t
tcagacagtatatacacgaccggtgctcgatttagactcatctacaggggagctctgggagaggagccccagccttgggattcccgaggtgttttcattcagtgatcaggactgaacacagagactcacagtggagtttggcgtgagctggtacttttcctgtctgtacttaagttttaaaaggtgtccgagtgtggacggtgcgtaggttgggtggtagtcggtagggggtaggtttagggtaaagtccgtgggggtacgttcccgttagacttcctccgtgtgcagcctcgtggtacttctacgtttcaagtaccgtccgtggactgaccggtcggtcccgccgtacggtccgtaccggaggggacgggcgtagggacgggttcgggttcggtaccgttaagttaacgaaaccgtaaagtccgtacggacgggaggtacgagacgaaggtaccgtacgcgtacggccgtaaccggacggtaaacgaccgtaagtacttaccgaaccgtacgttacgtaacgaaaggagtagttacgaaacgttaacgaaaacggttacgttaggttccgtaccttcgaggaccgtaaaagcgtaacgaaacgaccggtaccaacgaacgacccgggttaacaaccggtaaacgcgttacctacgttacttccgttacgtcgggtaagtcgttacggttcgaccgtacgggtccgtaaacgggtccccgtagggtaccctntcccg

SEQ ID NO: 9371 - DNA, 899 bp, Homo sapiens
  misc_feature: GYAE6OF02HV71K.44.2.A02.1.454.CMB.1.raw
  modified_base (237)..(237): a, c, t, g, unknown or other
  misc_feature (237)..(237): n is a, c, g, or t
tcagacagtatatacacgaccggtgctcgatttagactcatctacaggggggggggtctcaggaggcagcgctctcgggacgtctccaccatggcctgggctctgctattcctcaccctcctcactcagggcacagggtcctgggcccagtctgccctgactcagcctgccctccgtgtcgtcgggtcaccgtgggacaggttccgatccaccatcctcctgctagttcggaaaccngcagtcgactagtttgggtagtttaaactaacgtagtcgttaccttccgttacggtaacccaaacaacccacccgaagggaccaaaaacccggccccctaaaactcgtaactaggtaacttacgaattacggaacgttcgttacgtaaagttaacgtccccgggtaacccgttagggtttaaccgggggttttccgttacggggttccgttccgtttaccgtccggttacgggtcccttaaccggtaacgtccggttacggaaccgtaaacccggtcccgtccccttacccggtaccgaaccttcgttaccgtccgggtcgggtaccctccggtacggcggttacggaacgggaacggaccgttacggtagtaaccgtttaacgttaccggacgaccttaagtcccgtaaataaacggttaaaacgtaaaaacgggtacctaaacccgtaacgttaacggttttaacgttaaacggtttaaccgggtacccgggggaaagggtaaccccgggttaaacgtacccgggttaaccggttaacccgggttaccccgtttaaaccggggtaacggttaacccccggaaacggtaccccggtacggggttaaccccccgtaccccccggggttaccccttaaccgggggttacccctttaaccccgg

SEQ ID NO: 9372 - DNA, 644 bp, Homo sapiens
  misc_feature: GYAE6OF02JGSJT.44.2.A02.1.454.CMB.1.raw
  modified_base (386)..(386): a, c, t, g, unknown or other
  misc_feature (386)..(386): n is a, c, g, or t
  modified_base (580)..(580): a, c, t, g, unknown or other
  misc_feature (580)..(580): n is a, c, g, or t
tcagacagtatatacacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtcgtgggtcaccgtggacagtcgatccaccattcctcctgactagttacggaacccagcagtacgactagtttggtaggttaactaacttatcgtcctccgtacggtaccaaacaaccacccgaggaccaaacccgacccccaaactcatgtattaccagtagactcggtactaagttaaccgtccggccgttacggtacggggtttntcggttcgtcttaccttcgtcgtactacgagtcgtcgacgtaccgaccgtcctacccgacgtacctatccgtcgcgggtccctacgacggtcgtacgggacggtacggcggtaccttagtaccttaacgttacgtcgtcgacgtctacgaattacgaacgtaacggtaggacctttacgttacttagtcgacgngaacggacgacgtctacggtaccgtacgtacggctaccggacgacggccgtaccgtccccgtcg

SEQ ID NO: 9373 - DNA, 763 bp, Homo sapiens
  misc_feature: GYAE6OF02I843Y.44.2.A02.1.454.CMB.1.raw
  modified_base (133)..(133): a, c, t, g, unknown or other
  misc_feature (133)..(133): n is a, c, g, or t
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
tcagacagtatatacacgaccggtgctcgatttagactcatctacagggggagtcagtctcagtcaggacacagcatgcacatgagggtccccgctcagctcctggggctcctgctactctggctccgaggtnccagatgtagacatcgaagactggacccctagtcctccttccttcctgttacttcttctggttggagtcagctcaaccntccacttggccgggacgtacgtcgtagggttccggttttacgggngacgttgttcgtaccgttaggtttaccaaaaacggtaaaaaggggggacgtaaccggtccccgtaaacgggtccctacggttacctcgtaccggtaacgaaaccaggtacgtaggtaacgggtacgacggtaccccgtacgtacggttacaggtccaccgtacgtaccgtaggggtcggacggggaccgtaaggtcccaacgttactaccacgttaacgtttacgacccggtaaccgtcggacccgggtactaacggaacgtaacgtttactacgtacgtaacctttatttaccgtgtaacagactaagttactacgtaagttacgttccgtaccccgttttataaccgttttacggaccggtaacgggtaaccgtaacggtacgtaaacggtaaactaaccgtaaaacgtaacgttacgtacggtacttaccggaccgtaaccctagttaccgtacgtttacgttaccttaccgttcccggttacccctacttacctactaacgg

SEQ ID NO: 9374 - DNA, 700 bp, Homo sapiens
  misc_feature: GYAE6OF02JNI6X.44.2.A02.1.454.CMB.1.raw
  modified_base (215)..(215): a, c, t, g, unknown or other
  misc_feature (215)..(215): n is a, c, g, or t
  modified_base (495)..(495): a, c, t, g, unknown or other
  misc_feature (495)..(495): n is a, c, g, or t
tcagacagtatatacacgaccggtgctcgatttagactcatctacagggggggggtctcaggaggcagcgctctcgggacgtctccaccatggcctgggctctgctattcctcaccctcctcactcaggcacagggtcctgggcccagtctgccctgactcgagcctgcctcgtgtctagggtcaccgtggactgtcgtatcaccattccgtccngactattcggaaaccagctaagtcaactagtttcgggtagttaactaacttgtcgtccgtaccgtagtaaccaactaaccgacccgaaggacccaaaaccggacccccctaaactcctaatagtacttacgacttaacgtaacttcctaaccgtacgtccggtaccttacggttcggttaactttcggacgttacgtccgttacttccgtcgtcggtccttaccgacgggttccgactaaccgtccgtccctcgtacacctactcgtcgtcggtacctcnccgtcgacgtacgacgacgtactaattcttcgttcgttacgtctactacgtcgacgacggtacgttacggttacgtttacgtacgtttaccgtacggtaaacggtacgtaccggtaacgtaccgtaccgtaccgtacggtaacctaccggtacctaaccgtacccaacccgtctacctaccgtaccgttccgttccgttaccccg

SEQ ID NO: 9375 - DNA, 759 bp, Homo sapiens
  misc_feature: GYAE6OF02JKNR4.44.2.A02.1.454.CMB.1.raw
  modified_base (193)..(193): a, c, t, g, unknown or other
  misc_feature (193)..(193): n is a, c, g, or t
  modified_base (326)..(326): a, c, t, g, unknown or other
  misc_feature (326)..(326): n is a, c, g, or t
tcagacagtatatacacgaccggtgctcgatttagactcatctacagggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacngtcgatccacctatccgtcctgctagttcggaaccagcagtagactagtttggggtacgttaataacctagttcgtcctccgtacggtaaccaaaccaaccgaccacggacaaaccgaccccctaaacactanacgtattacacgtagagttcgtacaaggttaacgtccggtaccctcgggttacgggttcgtcgtccgtcttaccgttcgtacggtcctaccgtacgttcgtacgtacgaaccgccggtaccccgttcgaaccgtacctacgttccgtaccggtcgggtaccctccggtaaaggtccggttaaggaacggggtaccgtaggtaccgtacggttaaccttaacgttaccggtcgtacccgtagtaccgtaactaaaacgttaaaacggtaaaacgtaactaacccgttaaacgtacgtttacggtttaaaccggtaggttacccggggaacgtaaccgggtacgaacggtcccgtaacggttacccgttacgggtcgaacccggactaacccggtccggtccgtaccccggtcccgttaacccgtccttaacccg

SEQ ID NO: 9376 - DNA, 236 bp, Homo sapiens
  misc_feature: GYAE6OF01CZ3KG.25.16.B05.1.454.CMB.1.raw
  modified_base (218)..(236): a, c, t, g, unknown or other
  misc_feature (218)..(236): n is a, c, g, or t
tcagactgtacagtcacgaccggtgctcgatttagagctcacgtagttgggtttggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnnnnnnnnnnnnnnnnnn

SEQ ID NO: 9377 - DNA, 544 bp, Homo sapiens
  misc_feature: GYAE6OF01BGF4C.25.16.B05.1.454.CMB.1.raw
  modified_base (310)..(310): a, c, t, g, unknown or other
  misc_feature (310)..(310): n is a, c, g, or t
  modified_base (442)..(442): a, c, t, g, unknown or other
  misc_feature (442)..(442): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaaggagacagcctcagaaactattatgcaggctggtaccagcagaagccaggacaggcccctattcttgtcatcttaggtaaaacaccggccctnagggactcccaagaccgattcctctggctccagctcaaggaacacagtccttcctgaccatcactggggctcgaggcgaagatgaggctgactattactgtaacctcccgggaacaccagtcacctaaaccngtttggtgttcgggcggaacgggaccaaagtccgtaggacccgtcgtaagtccgacgccccaaaggccgtacgcccccctagggtcccaccgtccgttcccg

SEQ ID NO: 9378 - DNA, 257 bp, Homo sapiens
  misc_feature: GYAE6OF01E1CY5.25.16.B05.1.454.CMB.1.raw
  modified_base (253)..(257): a, c, t, g, unknown or other
  misc_feature (253)..(257): n is a, c, g, or t
tcagactgtacagtcacgaccggtgctcgatttagagctcacgtagttgggtttgggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttccgccatctgaactgtacagtctgagcgggctggcaaggcgcatagnnnnn

SEQ ID NO: 9379 - DNA, 783 bp, Homo sapiens
  misc_feature: GYAE6OF01DSEEH.25.16.B05.1.454.CMB.1.raw
  modified_base (99)..(99): a, c, t, g, unknown or other
  misc_feature (99)..(99): n is a, c, g, or t
  modified_base (211)..(211): a, c, t, g, unknown or other
  misc_feature (211)..(211): n is a, c, g, or t
  modified_base (258)..(258): a, c, t, g, unknown or other
  misc_feature (258)..(258): n is a, c, g, or t
  modified_base (285)..(285): a, c, t, g, unknown or other
  misc_feature (285)..(285): n is a, c, g, or t
  modified_base (342)..(342): a, c, t, g, unknown or other
  misc_feature (342)..(342): n is a, c, g, or t
tcagactgtacagtcacgaccggtgctcgatttagagctcacgtaaggggtggctcagaagcagagttctggggtgtctccaccatggcctggaccctntctggctcactctcctcactctttgcataggttctgtgatttctctgagctgactcaggaccctgctgtgtctgtggccttgggacagacagtcaggatcacatgccaaggnacagcctcagaactatatgcaggctggtaccagcagaagccaggacnggccctatctgcatcgtttagaaaacncggcctagaggactccgagacgattctcgtcggctccgagtctacgaacggtaaacncgtacgtcttacctaggaaccctagttccgtaacgttcgggggtaccttaccggaacgggtaccggtaaagtacgttcgggtaacgggttacccttacggtaacccgtttaacgttttaacccggacggttttaaaacccccgttccccgggggtaaaccttaaccccggtaacgggtttaccgtaaccgtttaaaccccgttaggtttttaccggggttaccgggtttacccgggtaaccggtaacggggttaacccctaaacgggtcccgtttaaccgggtaaccccggttaacccgttaaagggttccccgtaaaccgggtcccccggtaaaaggggttcccccttaaccggggtccccccccgtttaagggggttaccctaaacccggttttcccggttacccgggtttaccccccgtaccccgttttaaccccggg

SEQ ID NO: 9380 - DNA, 855 bp, Homo sapiens
  misc_feature: GYAE6OF01CQXAA.25.16.B05.1.454.CMB.1.raw
tcagactgtacagtcacgaccggtgctcgatttagagctcacgtaaggggagctgtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgaccaaaggagacagcctacagaaaactattatgcaggctggtaccagacaagaacgccgaggacacggtccccttattcttgtactattacgtttaacggtaaaaaccacccggtccctacgaacgggtactaccccgaaggacccgtattcctcgtacggcctacccgagtcctacgaaacggtaaaacccaccgtaacggttcccttttacccgtttacggaacccctacgttacccgtaacccgggttcggggggtacccttaccgggaaacgggggtacccgggaaaaggtacggttacgggaacgggttacgttaacggttaaacctttaacgtttaacccggttaccggttaaaaccccggttaccccccggggtaaaacctaacccggtaacgttacccggtaaaccccgtttaaaacccggttaggttttttacggggttaccggttttacccgggggaccggggtaaaccggggtaaacccgtaaacggttcccggttaaccgggtaacccccggtttaacccgttaaacgggttaccccgaaacccgggtaaccccccgtaaacgggtcccccgttacccggtacccccccccggttagggttacccctacccgtttccccgtttacccccgg

SEQ ID NO: 9381 - DNA, 684 bp, Homo sapiens
  misc_feature: GYAE6OF01EKFJ7.25.16.B05.1.454.CMB.1.raw
tcagactgtacagtcacgaccggtgctcgatttagagctcacgtaagggggtgggctcagaagcagtgttctggggtgtctccaccatggcctggacccctctctggctcactctcctcactcttgcataggttctgtgatttcttctgagctgactcaggaccctgctgtgtctgtggccttgggacagacagtcaggatcacatgccaaggagacagcctcagaaactattatgcaggctggtaccagcagaagccaaggacaggcccctatttctgtcattcgtttaggaaaaacaccggccctcgaagggactacccagaccgtattctactcggctccacgctacgaaggaaaaccacgacgtcctttacccttacgaccctaatccgaacgttcgggggacctacgacgggacgaagtagtgaagggcctagaacttattactacgtaacgtcccgggaacaccgtaggtacgtacctaaacctaggttttcgggtcgggttacgggaccgggtaacgggaacccgtaaggtccggttaccggtaacccggttaccgtaaacggttcccgaacgggttacccccgaaaggggtccccttacccgggtaccccccccgttagggttacccttaacccgtttcccgttccccggtttaccccccaaccccgtttcccccg

SEQ ID NO: 9382 - DNA, 756 bp, Homo sapiens
  misc_feature: GYAE6OF01BEO37.25.16.B05.1.454.CMB.1.raw
tcagactgtacagtcacgaccggtgctcgatttagagctcacgtaagggggtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgaccaaaggagacagcctacaagaaacttattatgcaggctaggtaccagcagaagccaggacacggcccctattctgtcattacgttaacggtaaaaccaccggccctacgacggactacccgagaccgtattcctacgtcggcctaccagtcctacgaacggaaaccactacgtcctttaccgtacgaaccctagtaccgacgtcgggggacctacggaacgggaccgggaaagtagttacgggacggtacgttacggtaacctttaacgtttaaccgttaaccggttaaaccccgtaccccggggtaacctaacccggtaggttaccgtacccgttaaacccgttaggttttacggggtacggtttaccggggaccgggtaacggggtaacccaagggtcccgttaaccgggtaacccgttacccggtaaaccggtccgaaccgggtacccccggaaagggtccccgttacccccggtacccccccggttacgggtacccctaccgtttccccggtacccgtttcccccccgtaccccttaccccg

SEQ ID NO: 9383 - DNA, 234 bp, Homo sapiens
  misc_feature: GYAE6OF01BEYC1.25.16.B05.1.454.CMB.1.raw
  modified_base (172)..(172): a, c, t, g, unknown or other
  misc_feature (172)..(172): n is a, c, g, or t
  modified_base (221)..(234): a, c, t, g, unknown or other
  misc_feature (221)..(234): n is a, c, g, or t
tcagactgtacagtcacgaccggtgctcgatttagagctcacgtagttgggtttgggggaagaggaagactgacggtcctcccaggagttcaggtgctgggcaccgttgggcacgggggaggtgtgtcacaagatttgggctctgggcacagcggccctgggctgcccggtnaaggactacttccactgtacagtctgagcgggctggcaaggcgcatagnnnnnnnnnnnnnn

SEQ ID NO: 9384 - DNA, 566 bp, Homo sapiens
  misc_feature: GYAE6OF01EUU50.25.16.B05.1.454.CMB.1.raw
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
  modified_base (391)..(391): a, c, t, g, unknown or other
  misc_feature (391)..(391): n is a, c, g, or t
tcagactgtacagtcacgaccggtgctcgatttagagctcacgtaagggggtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaaggagacagcctcagaaactnttangcaggctggtaccagcagaanccagacaggccctatctgcattcgttagaaaacnccggcctagagggactcccagaccgtattctctggctccagcctcgaaggaaaccncacgtcttccctagacctatccacgtcgggctcgaggcgaagngtgagctagactattacgtcgtaaccgtcccggacaccgagtcgtactaaccgtagttcggtacgttacggcggtacggtaccgaagccgtagtacccgtaccgtaagtccgacgtacccgaggccctcggtcccccgtggtaccacccttcgtccgttccccgtcccgttcccg

SEQ ID NO: 9385 - DNA, 545 bp, Homo sapiens
  misc_feature: GYAE6OF01AYCYE.25.16.B05.1.454.CMB.1.raw
  modified_base (220)..(220): a, c, t, g, unknown or other
  misc_feature (220)..(220): n is a, c, g, or t
  modified_base (408)..(408): a, c, t, g, unknown or other
  misc_feature (408)..(408): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcataggttctgtgatttcttctgagctgactcaggaccctgctgtgtctgtgccttgggacagacagtcaggatcacatgccaaagganacagcctcaagaaactattatgcaggctggtaccagcagaagccaggacaggcccctattctgtcatctttaggaaaacaccggcctcagggactcccagaccgattctcgtgctccagctcaaggaacacagtcttacctgaccatccacgtgggctcgaggacgaagatgaggctagactattacngtaactcccgggaacaccgagtacacctaacgtagtttcggtcgttccggacggaggaaccaggtcctacggacccgtactaagtccgaacgccccgaaggcctccggtcccccgtaggtcctccgtcgttaccccg

SEQ ID NO: 9386 - DNA, 716 bp, Homo sapiens
  misc_feature: GYAE6OF01C3VD1.25.16.B05.1.454.CMB.1.raw
  modified_base (235)..(235): a, c, t, g, unknown or other
  misc_feature (235)..(235): n is a, c, g, or t
  modified_base (291)..(292): a, c, t, g, unknown or other
  misc_feature (291)..(292): n is a, c, g, or t
tcagactgtacagtcacgaccggtgctcgatttagagctcacgtaagggggtgggctcagaagcagagttctggggtgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtncttataactatgtctcctgtcccaacacaccagcaacggcccaatcatctatttannatgtcagtcatccgcctcgttggacgtttcgtggtcgtctttctacgtcgtctcctaagtcctcggtacaaccgtccggtaccctcctcgtaccctagtccgtcggggtcctccgaggcctggacggacggtacggtccttaacgtttatttagtttacgtactaacgtttctaaataccgtaaggaaccgtaaccaaaccctaacggtacgttaccgggttccgggttacgggttaccgggtaccggggtaacgggtaacccgtaaaggggtttaccggaacccccggttaccccggtaccggggttacccgaaccggtaacccccggtaaccgggtacccccgttcccgggtaccccccccgttaccgggttacccctaacccggtttcccgttccccggttacccccccgggttccccccc

SEQ ID NO: 9387 - DNA, 663 bp, Homo sapiens
  misc_feature: GYAE6OF01D3MWY.25.16.B05.1.454.CMB.1.raw
  modified_base (238)..(238): a, c, t, g, unknown or other
  misc_feature (238)..(238): n is a, c, g, or t
tcagactgtacagtcacgaccggtgctcgatttagagctcacgtaagggggtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgaccaaggagacagcctcaagaaactattangcaggctaggtaccagcagaacgccaggacacggcccctagttcttgtctattacgtttaggaaaaaccgacccggccctacgacgggactacccgacgaccgtattctcgtggcctcagctacaaggaacacagtccttctacgacctatcacgtgggcctcgaggacggaagataggacggctaggtacttaagttaccttacggtaacccgtccccgggaactaacccgtagtacgtaaccgttaaccgttagttttcggggtacggtttaccgggacgggtaacgggaaccgtaacggtccgtacgtacccggtaccgtaaacgttccgaaccgtacccgaacggtcccgtacccgtcccccccgttacgggtccctaccccggttcctttccccgggttccccccgtccccgttaccccg

SEQ ID NO: 9388 - DNA, 253 bp, Homo sapiens
  misc_feature: GYAE6OF01B00QM.25.16.B05.1.454.CMB.1.raw
  modified_base (252)..(253): a, c, t, g, unknown or other
  misc_feature (252)..(253): n is a, c, g, or t
tcagactgtacagtcacgaccggtgctcgatttagagctcacgtagttgggtttgggacagaattcacctctcaccatcagcagcctgcagcctgaagatgttgcaacttattactgtacaaaaatttgacagtgaccgtggatgttcggcccaggaccaaggtgacatcaaacgactgtggctgcaccatctgtcttcatcttcccgcatctgaactgtacagtctgagcgggctggcaaggcgcataggnn

SEQ ID NO: 9389 - DNA, 825 bp, Homo sapiens
  misc_feature: GYAE6OF01ACGPC.25.16.B05.1.454.CMB.1.raw
  modified_base (148)..(148): a, c, t, g, unknown or other
  misc_feature (148)..(148): n is a, c, g, or t
  modified_base (813)..(813): a, c, t, g, unknown or other
  misc_feature (813)..(813): n is a, c, g, or t
  modified_base (816)..(825): a, c, t, g, unknown or other
  misc_feature (816)..(825): n is a, c, g, or t
tcagactgtacagtcacgaccggtgctcgatttagagctcacgtattgggtctgggagaggagccccagtcctggggactgaatacagacggctcaccctggagtcatggctgcacttgggtttttcttgccttcttctttaaagggnggttctctgagagaaaatgaaattgagtgtgagcggttatgagtgggaagaaaacaaaagaatcagacggactaaagttgtaaggtgcggtagggggtccggtcgtgggggacgccctgtcacgtacggtggggttctttcgagaaggtcggccggtagacgtctcgtggactcggcgtcgactcgacgtcctctaatactactaagtttagtaccgaacgtaaacttccttacccgtagtaaaacctaagtttaacgtttaccggttaccgtacggtttaaccgtttttcccggaccccttaaccccgtaaaccccggaaaaccgggggtcccccctaacgttttccccggggttacccccttttccccccccgggtacgggtcccccgtaccccccggtttcggacccccgttacccggaacgggtacccggttaacccccgaacccccgttacccgggaaaaccgtaaaacccgacccggaaccgggtcccccggggtcccccggttaggggtcccctccggtacccggttaccgggtaaccgtaaccgggtaacccctttaacccgttccccgtaacgttaccggtaacgttaccggttccgttacgggtacggggtcccggtacgggttacggacggaaaccgggccgaccgtagtacgngcnnnnnnnnnn

SEQ ID NO: 9390 - DNA, 644 bp, Homo sapiens
  misc_feature: GYAE6OF01CRF6O.25.16.B05.1.454.CMB.1.raw
  modified_base (221)..(221): a, c, t, g, unknown or other
  misc_feature (221)..(221): n is a, c, g, or t
  modified_base (369)..(369): a, c, t, g, unknown or other
  misc_feature (369)..(369): n is a, c, g, or t
  modified_base (624)..(624): a, c, t, g, unknown or other
  misc_feature (624)..(624): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaagganacagcctacagaaactattatgcaggctaggtaccagcagaagccaggacacggcccctattcttgtactatctttaggtaaaaccaccggcctagaagggctcccgaagaccgtattctcgtcggctccgagcctacgacggaaacncagtcctttacctagaacctataccgacgtgggacctgaacgggacggaaagtagtggacggtctacgaactttattacgtacgttaaacccgtcccgggaactacccgtaggtactaacccgttaaacctgttttcgggtcgttaccgggacgggaacgggtacccaaaggtccgtaacggtacccggttactaagggtccctaaacggaccccgtaaagggtccctacccgggtaccccccttgggtaccccncccgtttcccttacccccgg

SEQ ID NO: 9391 - DNA, 903 bp, Homo sapiens
  misc_feature: GYAE6OF01C217O.25.16.B05.1.454.CMB.1.raw
tcagactgtacagtcacgaccggtgctcgatttagagctcacgtaaggggagctgtgggctcagaagcagagttctggggtgtctccaccatggcctggacccctctctggctcactctcctcactctttgcataggttctgtgtattttcttctgagctgactcaggaccctgctgtgtctggtggccttgggacagacagtcaggatcacatcgaccgaaaggacgacacgcctacaagtaaaactattaagtgacacggcttacggtaaccagacgaaggaacgaccgaacgggaccgacggtacccctttaatttccgttacgtactacgtttaccgttttaaacggtaaaaaaccgtaccccgggtaccctacggtaacggggtacctaccccggaacggtaacccggttaactttcccgttcggttaccgggtcccttacccgaacggtccttaacggaaacgggtaaaaccaccgtacggttccctttacccgtttacgaaccctacgttacccgtaacgggttcggggaccttacgggaaccggggtaacgggtaaaggtacgttacgggacgggttaccgtaaggttaaaccctttaacgtttaaccggtaaccggtttaaaccccgggtaacccccggggtaaaaccgttaacgggttaccgttaacccgttaaaccgtttacggggtttttacggggttaccggggtttaaccggggaccggggtaaccggggtaaaccgtaacgggttcccgttaaaccggggttaccccggttaaccgttaaaaccgggtccgtaaacccggaccccgttaaacgggtccctttaccccgggtaccccccggtttacgggtacccttaacccggttcctttaccccgggttaaccccccc

SEQ ID NO: 9392 - DNA, 983 bp, Homo sapiens
  misc_feature: GYAE6OF01BJZHJ.25.16.B05.1.454.CMB.1.raw
tcagactgtacagtcacgaccggtgctcgatttagagctcacgtagttaggggtttgggggcagaagtctctctcagtcaggacacagcatggacgactgagggtccctgctcgacgctccgtgggactcctgctgctctggctccagctatcagatgtgcatccagatcgacccagtcctccactcctccgtgtctgcatcgtgtaggagacagacgtccacatccacgtcggaccggcgaacgtacgtaaggggtactaagtttaggtaaactttacgttacggccgttacgggtaactccgaacgacctaacggtaaaaccggtagggtaaacgtttaccctaaacccttcccgtactacgttacccttacgttacgtaccgttacggtacctaacgttccccgttaacgttttacggtaccgttaaacgggttttcccggggggtaccccgttcgtttaccgggtaacgtttaccggacgggtacccgggtacgttaacgggttccggggttacccgtaacgggggtaacctaacgggttaaactttcccgtaaccgtttacccgttaaccgtaaccccgtaacgttacccgtaaaccggtaccgttaaccgggttacccgttaaccgggtaaccgttaacccgggtttaacccggttaacggttaaaaccgggtttaaccgggttttaaccgggttttaacccggtttaaaccccgttttaaaacccggttttaacgtttttaaacccggttaccgggttttaaaaaccctttaaaacgggtttaaccggttaaacccgggttaacgggttaaacccgggttaacccgggttaaaccgggtttaacggttacccgggttaacccggggtaacccccgggtaaacgggggttaaaccccggtaaacgggttacccgggttaaaccgttaacccggttaaacccggttaaaccgggtaaccgttacggggttaccccggg

SEQ ID NO: 9393 - DNA, 812 bp, Homo sapiens
  misc_feature: GYAE6OF01BKZ26.25.16.B05.1.454.CMB.1.raw
  modified_base (105)..(105): a, c, t, g, unknown or other
  misc_feature (105)..(105): n is a, c, g, or t
tcagactgtacagtcacgaccggtgctcgatttagagctcacgtaaggggagctgtgggctcagaagcagagttctgggtgtctccaccatggcctggacccctntctggctcactctcctcactctttgcataggttctgtgatttctctgagctgactcaggaccctgctgtgtctgtgccttggacagacagtcaggatcgacagtgaccaaaggagactacgcctacgaagtaaaaccttagttaatcgtaccaagggtccttacggttaaccgaacgcgaaacggaaacggacccgtaacgggaacctaaccgggtaccccctttaagtttccgtttacggtacctaacgttaccgtttttaaacggtaaaaaacccgtaaaccccgggtcccctttaacgaacggggtaccttaaccccggaacggtaacccgttacgttaccgtacggtacggtccgttaccgaacggtccgtaacgaaagggaaaccacgtaacgtcctttaccgtttacggaaccctacgtaccgtaaccggttcggggccttacggaacgggtacggaaaacggtcgttaacgggaacgggaccttaggaaccgtttaacgtttaaccgtcggttaaacccgtccgggtaaacccgaacgtaacggtaccgtaaccgttaacctacgggttttacggttacggtttaccggggacgggtaacgggtaccgtaacgtccgtaacggtacccgttaacgttacgtacgtaaccggacccgaaacggtctaccggaccccgtaggtccctacgtccgttaacccg

SEQ ID NO: 9394 - DNA, 633 bp, Homo sapiens
  misc_feature: GYAE6OF01B6XA5.25.16.B05.1.454.CMB.1.raw
  modified_base (174)..(174): a, c, t, g, unknown or other
  misc_feature (174)..(174): n is a, c, g, or t
  modified_base (241)..(241): a, c, t, g, unknown or other
  misc_feature (241)..(241): n is a, c, g, or t
  modified_base (456)..(456): a, c, t, g, unknown or other
  misc_feature (456)..(456): n is a, c, g, or t
tcagactgtacagtcacgaccggtgctcgatttagagctcacgtaagggggtgggctcagaagcagagttctggggtgtctccaccatggcctggacccctctctggctcactcctcctcactcttgcataggttctgtgatttcttctgagctgactcacggaccctgctgtntctgtggccttgggacagacaggtcaggatcacatgaccaaggagacagcctacaagtaaactatangcaggctggtaccagcaagaacgccaaggacacggtcccctattctgtactacttacgtttaaggtaaaaacccaccggtccctacgaacgggtacctaccccgaagacccgtacttcgtcgtcggcctccgagtccctacgaacggtaaaccacacgtccttccgttacgaacctactaccgacggttcggggacctacggacgggtacgaagngtaggaaggtctacggtaacttattaccgtcgtaaccgtcccgggaactaccaggtactaacctaaccgtaggtttcggtggttccggcggtaacggaccaaggtcctaacggtccgtaccgtaagccgacgaccgacggcctccgcccctagtcctcctcgtcccttcccgcctcc

SEQ ID NO: 9395 - DNA, 606 bp, Homo sapiens
  misc_feature: GYAE6OF01D6Y4B.25.16.B05.1.454.CMB.1.raw
  modified_base (146)..(146): a, c, t, g, unknown or other
  misc_feature (146)..(146): n is a, c, g, or t
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (252)..(252): a, c, t, g, unknown or other
  misc_feature (252)..(252): n is a, c, g, or t
  modified_base (446)..(446): a, c, t, g, unknown or other
  misc_feature (446)..(446): n is a, c, g, or t
  modified_base (593)..(593): a, c, t, g, unknown or other
  misc_feature (593)..(593): n is a, c, g, or t
  modified_base (596)..(597): a, c, t, g, unknown or other
  misc_feature (596)..(597): n is a, c, g, or t
  modified_base (599)..(599): a, c, t, g, unknown or other
  misc_feature (599)..(599): n is a, c, g, or t
  modified_base (601)..(606): a, c, t, g, unknown or other
  misc_feature (601)..(606): n is a, c, g, or t
tcagactgtacagtcacgaccggtgctcgatttagagctcacgtattgggtctgggagaggagccccagtcctggggactgaatacagacggctcaccctggagtcatggctgcactgggtttttcttgcctcttctttaaagggnggtttctctgagagaaaatgaaattgagtgtgagnggttangagtgggagaaacaaaagatcagacggcaaattgtaaggtgcgtagggggccgtcgtgggggacnccctgtcacacgtggggtcttcgagaaggcggccggtgaagtctcgtggactcggcgtcgatcgagcctctatatcattacgcgaacgaaattcttacctagaaactaagtacttcgtacagtacttttcgcctaccaaccgaacggccctagtccggtccttcccccgtggcccgtcccgtgcctccaggacncaccctcgaagaacacgacgccggcccgtgggcctcgccgtacggtacgaacggtaccttaacgttcccgtaacttcgtaacctacggttccgttggaccggcgggtccgttacgggaccgtaaacgggccgtaacgtacgtaggcncgnncncnnnnnn

SEQ ID NO: 9396 - DNA, 817 bp, Homo sapiens
  misc_feature: GYAE6OF01CPA3G.25.16.B05.1.454.CMB.1.raw
  modified_base (83)..(83): a, c, t, g, unknown or other
  misc_feature (83)..(83): n is a, c, g, or t
  modified_base (107)..(107): a, c, t, g, unknown or other
  misc_feature (107)..(107): n is a, c, g, or t
tcagactgtacagtcacgaccggtgctcgatttagagctcacgtaaggggagctgtgggctcagaagcagagttctgggggtntctccaccatggcctggacccctntctggctcactctcctcactctttgcagttaggttctgtgtattttcttctgagtctagactcgacggaccctgctgtgtcgtgcggtccgttagggacagacaggtcgaaggactacacgtaactcggaccgaaagggacaccgtacggccctaagaagtaaaaccttatttacgacgacgtaacggtcgtacggaccgagaaccgaagaaccgaccgacggaaccgaccggtccccttagtttccgttagtactaacgttaccgtttaaacgtaaaaaccgacccgtcctacggaacggtacctaccgtaacggactacgttcgtcgttacggcctaccgagctaacggaacgaaccacgtaactccgtttaccgtacgaacctcgaccgtacgggtacgggtccgtaacgggaaggtacgggtaaagtacggtacggtacggtaacgttaacgtaaacgtttaacgttaacccgttaccggttaaacccggtaccccgggtaaacgaaccgttaacggtacccgttaacccgtttaaaccgttacgggttttacgggttaccgggtttaccgggaaccggggtaaccggtaaccgtaaaccggtccgtaccgtaacccggttaccgtaacggtaaccgtcccggaaaccgacggtcccgtaccccgttaccccggtaccgtacccgtacgttccccgttacccccgg

SEQ ID NO: 9397 - DNA, 823 bp, Homo sapiens
  misc_feature: GYAE6OF01DNOUA.25.16.B05.1.454.CMB.1.raw
  modified_base (106)..(106): a, c, t, g, unknown or other
  misc_feature (106)..(106): n is a, c, g, or t
  modified_base (250)..(250): a, c, t, g, unknown or other
  misc_feature (250)..(250): n is a, c, g, or t
  modified_base (416)..(416): a, c, t, g, unknown or other
  misc_feature (416)..(416): n is a, c, g, or t
tcagactgtacagtcacgaccggtgctcgatttagagctcacgtaagggagcgtggtggctcagaagcagagttctggggtgtctccaccatggcctggacccctntctggctcactctcctcactctttgcagtaggttctgtgtatttcttctgagctgactcaggaccctgctgtgtctgtcggccttagggacagacacgtcaggactcgacatcgaccaaggacacaacgtcctacaagaaactnttaatgacgagtctggtaaccagacaacgaacgtaccgacggaaccgtaccggtacccctttagtttccttacgttccgtaacgtttaccgtttaaacggtaaaaacccgtaccccggtaccccgttagaaacgggtaccctttaccccggaacggtaacccgttntttaccgtcgttaaccggtcccgtcccggtaccttacggaaacggtaaaccctaccgtaccgttacctttacccgttacgaacccttacgtacccgtaccggtacgggtacccggttacggtacgggtaccggaaaggtacggtaggtaacggtacgtttacgtaacgttacgtttaacgtacgttaaccggtacccggtaacctacgtacgtaccgtaccgtaacgttacgtttggtttaccggtacgggtaccgggacggtaccggtaaccgtaccggtaccggttaaccggttacccgttaaacggtacccggacccggtacccggtaaaccgtcccggttaacccccggtcccccgttacggttacccttaccccgttcccgtttacccggtttacccccccc

SEQ ID NO: 9398 - DNA, 715 bp, Homo sapiens
  misc_feature: GYAE6OF01DJNNA.25.16.B05.1.454.CMB.1.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
tcagactgtacagtcacgaccggtgctcgatttagagctcacgtaagggggtgggctcagaagcagagttctggggtgtctccaccatggcctggacccctctctggctcactctcctcactcttgcataggttctgtgatttcttctgagctgactcaggaccctgctgtgtctgtgccttgggacagacagtcaggatcacatgccaaaggnacagcctcaagaaactattangcaggctggtaccagacagaacgccaggaccacggcccctatttctgtcattcgtttaaggtaaaaccaccggccctacgacggactcccaagaccgattctctcggcctaccgacgcctacgaacggtaaaccgaccggtcctttacccgttacgaaccctaacgtaccgtaaccggttcggggggaccttacgaacggggaccggaaaggtacgttacgggaaacgggtccttaggtaacctttaagtttaaccgtacgttaaaccccgtcccgggaactaacccgtagtaccgtaccgttaaccttaggttttcgggtacggttaccgggacgggtacgggaacccaaggtccgttacggtaaccccgttacgtaacggtacccgacggaaccccgaagggtccccttacccggcccccccgttacggtaccctacccgtttccgttcccgttccccccgtcccttccccgtaaccg

SEQ ID NO: 9399 - DNA, 663 bp, Homo sapiens
  misc_feature: GYAE6OF01BA4EA.25.16.B05.1.454.CMB.1.raw
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
  modified_base (542)..(542): a, c, t, g, unknown or other
  misc_feature (542)..(542): n is a, c, g, or t
tcagactgtacagtcacgaccggtgctcgatttagagctcacgtaagggagctgtgggctcagaagcagagttctggggtgtctccaccatggcctggacccctctctggctcactctcctcactctttgcataggttctgtgtacttttcttctgagctgactcaggaccctgctgtgtctgtggccttgggacagacagtcaggatcanatgaccaaaggagacacgtcctanaagaaaacttattagtgacgaggtcgtacggtaccagacaagaacgaccgaaggaaccaccggtacccctattcgttacgtactacgtttacgtttaaacggtaaaaacccacccggaccctacgaacgggtacctaccccgaagacccgtaacttccgtcgtcggtccctaccgacgtacctacgaaacggaaacctacgacgttccttaccgtacaaccgtactaccgacggttgggacctacggaacgggacgaaagtcgaggacgtctagtaactacgttaacgtacgtaaccgaccccgganaaccgtgtacgtacctaaccgtttagttcggtgtccgggacggtacgaccgagcctaccgtaccgtactagcgtaccgacgtacgtcctacccggtccctacggtcctcgttccgtccccg

SEQ ID NO: 9400 - DNA, 674 bp, Homo sapiens
  misc_feature: GYAE6OF01E4LGP.25.16.B05.1.454.CMB.1.raw
tcagactgtacagtcacgaccggtgctcgatttagagctcacgtaaggggagctgtgggctcagaagcagagttctggggtgtctccaccatggcctggacccctctctggctcactctcctcactctttgcataggttctgtgattttcttctgagctgactcaggaccctgctgtgtctgtggccttgggacagacagtcaggatcacatgccaaaggagacagcctcagaaacttattatgcaggctggtaccagcagaagccgaggacacggcccctggtagttgtcatctaataggtaaaaatcgcccggccctcgagggactacccagacccgtattcctaccgtggcctccgacgcctctaacggaaaccacaacggtcccttaccgttacgaaccctactacgtaaccgtcgggggtccgtacgtaacggggaccgggtaggaagtcggaaggtcgtacgtacgttacgttttcgttaggttaaccggttaacccgggtactaaaccgtaggtacgtaacgttaccgttaacccgtttcctttaattacgttccgtttacggtaaaccgtacgggtaacccgtaacgggttccctaacccggttccgttaacggtacgacccggtaaccccgaacgggaacccccaaccccgtaccgtcgtacccg

SEQ ID NO: 9401 - DNA, 582 bp, Homo sapiens
  misc_feature: GYAE6OF01E00J4.25.16.B05.1.454.CMB.1.raw
  modified_base (396)..(396): a, c, t, g, unknown or other
  misc_feature (396)..(396): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcataggttctgtgattttcttctgagctgactcaggaccctgctgtgtctgtggccttgggacagacagtcaggatcacatgccaaggagacagcctcaagaaactattatgcaggctggtaccagcagaagccaggacaggcccctattcttgtcattctttaggaaaaccaccggccctcgagggactcccagaccgattctctgctccagctacaggaaacacagtcttccttagaccatcacgtcgggctcgaggcgaagngtgacggctagaacttatactcgtaacctccgggacacagtcgactaactgtttggtgttcgggacggtacggaccgtaagtccgtacgtacccggttccgtaaacggtccgaccggaccccgaaagggtcccgttacccggacccccccgttccgggtacccttacccgtcccgtttaccccggg

SEQ ID NO: 9402 - DNA, 766 bp, Homo sapiens
  misc_feature: GYAE6OF01DVPUF.25.16.B05.1.454.CMB.1.raw
  modified_base (106)..(106): a, c, t, g, unknown or other
  misc_feature (106)..(106): n is a, c, g, or t
  modified_base (242)..(242): a, c, t, g, unknown or other
  misc_feature (242)..(242): n is a, c, g, or t
tcagactgtacagtcacgaccggtgctcgatttagagctcacgtaaggggagctgtgggctcagaagcagagttctggggtgtctccaccatggcctggacccctntctggctcactctcctcactctttgcataggttctgtgtattttcttctgagctgactcaggaccctgctgtgtctgtcggtccttgggacagacaggtcaggatcaacatcgaccaaaggacgacacgaccctanaagtaaacttattatcgacaggtctacggtacagcaagaacgcgaacggacaccggtaccccttagttcgttgtactagtttacgtttaaacggtaaaaacccgtacccggtaccctacgaacgggtacctacccgaacgtaccgtacttccgtacgtcggtacctaccgagtcctaacgaacggaaacctaccgtaccgttcctttacccgtacgaacccttaccgtaccgtaaccgggttcgggggaccttaaccggaacggggtaccgggtaaagacggttacgggaacgtacgttaacgtactttaacgttacgtaccggttaaacccggtcccggtaaccacgtacgtaccgtacccgttaacgttacggtttacgggtcggttaccgggacgggtaaccggtacccgtaacggccgttaaccggtaccccgttaccgtacggtaacccgtacccgaccggtaaccgttcccgtaccccgaccccgttaccggtacccttcccgttcccggttcccccg

SEQ ID NO: 9403 - DNA, 711 bp, Homo sapiens
  misc_feature: GYAE6OF01C2RJV.25.16.B05.1.454.CMB.1.raw
  modified_base (230)..(230): a, c, t, g, unknown or other
  misc_feature (230)..(230): n is a, c, g, or t
  modified_base (695)..(695): a, c, t, g, unknown or other
  misc_feature (695)..(695): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcattaggttctgtgtattttcttctgagctgactcaggaccctgctgtgtctgtcggccttagggacagacagtcaaggatcacagtcgaccgaaaggngtaccacgaccctacaagtaaaaccttattaagtcgacgacgggtacttacggtaaccaagacgaaggaacgaccgaacggaccgaccggtcccctttaatttcgttacgtactaacttaccgtttaaacggtaaaaacccgacccggtacccgtacgaacgggacctacccgacgaccgtacttcgtcgtacggtcctaccgacgctaaccgaacgtaaaccacgtaacgtcctttaccgtacgacctacgtaccgtacggtcggggtactacggaacggacggtaagtagtacgggacgtcgtaacgtacgtttaacgtacgttacggtaacccgtccgggaactaccgtaagtccgtaaccttaagttcggttaggttacggtacggacggaacggtacgaagtccgttacgaccgttacgtagtccgaacgcccgaacgtccgtcccgtaccctacgtacncccgttcgttaccccg

SEQ ID NO: 9404 - DNA, 819 bp, Homo sapiens
  misc_feature: GYAE6OF01CQ88C.25.16.B05.1.454.CMB.1.raw
tcagactgtacagtcacgaccggtgctcgatttagagctcacgtaaggggagctgtgggctcagaagcagagttctggggtgtctccaccatggcctggacccctctctggctcactctcctcactctttgcataggttctgtgtattttcttctgagctgactcaggaccctgctgtgtctgtggccttgggacagacagtcaggatcacagtcgaccaagggacacagcctacgaagtaaaacttattagtgacgacggtcgtacggtaaccgagacgaaggaacgaccgacggaaccgaccgggtacccccctttaattttccgttacggttacctaaacgtttaccgttttaaaaccgggtaaaaaaacccgtaaccccgggtaccccttacggtaaaccggggtaccttaccccgaacggtaacccggttaaccttccgttcgtcggtaccctacccgaggtaccctacggaaacggtaaaaccaccgtacgttacccgttttcccgtttaacggaacccttacgtacccgtaaccgggttcggggaccgtttacggaacggggaaccgggtaaagtacggtacgggaccggtcgttacgtaacgtttaccttaacgttaccggttaacccggtacccggtaactaacccgtacgtacgtaaccgtttaaccgttaggtttcgggttacggttaccggggtacgggaacgggtaacccgaggtaccgttaccgaacccgttaccgtaacgtccgaaccgtacccgacgtcccgtacccgtcccccgtcggtacctcccgttcccgttacccccg

SEQ ID NO: 9405 - DNA, 878 bp, Homo sapiens
  misc_feature: GYAE6OF01C8C6S.25.16.B05.1.454.CMB.1.raw
  modified_base (82)..(82): a, c, t, g, unknown or other
  misc_feature (82)..(82): n is a, c, g, or t
  modified_base (106)..(106): a, c, t, g, unknown or other
  misc_feature (106)..(106): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
tcagactgtacagtcacgaccggtgctcgatttagagctcacgtaaggggagctgtgggctcagaagcagagttctggggtntctccaccatggcctggacccctntctggctcactctcctcactctttgcataggttctgtgtattttcttctgagctgactcacggccctgctgtgtctggtcggccgttgggacagacagtacgaggactacaacatacggaccgaaaggggactaccacggtccctanaaagtaaaaccttattanagacgaggtctacggtaccagacaaggaacgaccgagaccgacggtacccctatttcgtcgtactacgttacttaacggtaaaaccacccggtaccctacggaacgggtaccctaaccgaaccggtaaccgtactttaccgtaccgtacggtaccctaccgtacgtaccgttaaccgaacggtaaaaccctacgtaccgttacccgtttaccgtttaaaccgacccgttacgtaaccgggttaacccgggtcggggtaaccttaccgggaaagggggtaccggtaaaacggtaggtacgggtaacggttacgttaccggttaaactttaccgttaaaccgttacccggttaaacccggtacccgggtaacctaccggttaacggttaccgttaacccgttaaccggtttacgggtttacggggttaccgggtttaacgggggaccgggttaaaccgggaacccgttacgggtaccccggttaaacggtaccccggtttaaccggaaccggttaccggaacccggtaacccggtacccggtacccgttacccccgggtaccccgttaccgggttacccctaaccggtttccccggtttacccccccgg

SEQ ID NO: 9406 - DNA, 732 bp, Homo sapiens
  misc_feature: GYAE6OF01AF937.25.16.B05.1.454.CMB.1.raw
  modified_base (130)..(130): a, c, t, g, unknown or other
  misc_feature (130)..(130): n is a, c, g, or t
  modified_base (143)..(143): a, c, t, g, unknown or other
  misc_feature (143)..(143): n is a, c, g, or t
  modified_base (724)..(724): a, c, t, g, unknown or other
  misc_feature (724)..(724): n is a, c, g, or t
  modified_base (728)..(729): a, c, t, g, unknown or other
  misc_feature (728)..(729): n is a, c, g, or t
  modified_base (731)..(732): a, c, t, g, unknown or other
  misc_feature (731)..(732): n is a, c, g, or t
tcagactgtacagtcacgaccggtgctcgatttagagctcacgtattgggtctgggagaggagccccagtcctggggactgaatacagacggctcaccctggagtcatggctgcactggttttctgcctnttctttaaagggngttctctgagagaaaatgaaattgagtgtgagcggttatgagtgggaagaaacaaaagatacgaagacggactaaagttaggtaaaggtgacggttaagggggccggttcggtagggggactcccgtggtaccgacgtacgggttggggttcctttacgaggaaggtccggccggttaggaacgtcgtcgtggaccgtcggccgtcgatcgacggtcctactatactccgtattacggcgaaaacgtaacttccttacccgagtaaacctaatttacgttcgtactaagttactttttcccgaccctacccgtaacccggtaaaccgggtcccctaacgtttcccgggttaccccgtttccccccccgtgggtacccctcccccgttacggccccgttaccgaccgggtaccgacccgtaccccgtaccggacgaaaccgacgacggacccgcccggtcggtccgtcgcccgtcggtaccgacgtaccgttacctaccacgttcgtacgtaccgttgtacggtaccggccgggactcgggaccgaccggtaccgacgtacgtacgagtcgcgagtcgacgngtcnngnn

SEQ ID NO: 9407 - DNA, 699 bp, Homo sapiens
  misc_feature: GYAE6OF01DN6Q9.25.16.B05.1.454.CMB.1.raw
  modified_base (659)..(659): a, c, t, g, unknown or other
  misc_feature (659)..(659): n is a, c, g, or t
tcagactgtacagtcacgaccggtgctcgatttagagctcacgtaaggggatctgtgggctcagaagcagagttctggggtgtctccaccatggcctggacccctctctggctcactctcctcactctttgcataggttctgtgtatttcttctgagctgactcgaggaccctgctgtgtctgtggccttgggacagacagtcaggatcacatcgaccaaaggagacagcctacaagtaaactattatgcaggtctcggtaccagacaagaacgaccgaggacgacggccccttaattcgttcgtactacttacgtttaacggtaaaaacctacccggtacccctacgaacgggacctaccccgagtaacccgtagtttcctacgtcggtacctaccgtaacgtacttaaacgggaaacctacgacgtcctttaccgttacggaacctacgttacaccggttacgggggccttaaccggacgggtacggaaacgtaggttacggaaggtctacggtaactttacgtaaccgtacggtaaccgtacccggaactaccgtagtacgtacgttaacgtgttttacgggtcgttaccgggacgggacggtaaccgaacgtcgtacggtacccgtacgtaacgtaccgacgcccgaaggtcccncccggtaccccgtacgcctaccgttccgtccgttcccccg

SEQ ID NO: 9408 - DNA, 660 bp, Homo sapiens
  misc_feature: GYAE6OF01CDEMC.25.16.B05.1.454.CMB.1.raw
tcagactgtacagtcacgaccggtgctcgatttagagctcacgtaaggggagctgtgggctcagaagcagagttcgtggggtgtctccaccatggcctggacccctctctggctcactctcctcactctttgcataggttctgtgatttcttctgagctgactcgaggaccctgctgtgtctgtcggccttgggacagacagtcaggatcacatgaccgaaaggagacagcctacgaagaaaactattatgacgaggcgtaggtaccagacaagaacgaccgaggaccacggccccttattcttcgtacacttacgtttaacggaaaaaccgaccggtaccctacgaacgggtactacccgacgaccgtacttctcgtcggcctccacgtctacgaagaaaccacgtacgtcctttacctacgacctacgtaccgtacggtcggggacctacggacgggacgaagagtaggagtctagacttagttacgacgtacccgtaccggacacgtagtacgtacctaaccgttaggtttcggtacggttaccgggacggaacggtaccgtacgtccgtaccgtacccgttaccgtaacggccacccggaacccgtacggtccctaccccggtacccccgtagtccctaccgttcccgttaccccg

SEQ ID NO: 9409 - DNA, 764 bp, Homo sapiens
  misc_feature: GYAE6OF01E0XLQ.25.16.B05.1.454.CMB.1.raw
tcagactgtacagtcacgaccggtgctcgatttagagctcacgtaagggggtgggctcagaagcagagttctggggtgtctccaccatggcctggacccctctctggctcactctcctcactcttgcataggttctgtgattttcttctgagctgactcacggaccctgctgtgtctgtggccttgggacagacagtcgaggatcacagtcgacccgaagggagacacgcccttacaagaaaacttatttagcgcgaaggcgtcggtaaccgagaccgaaggaacgaccgaggaaccaccggtcccctaatttcttagtactacttacgtttaaacggaaaaaccgaaccccggccctacgaacgggtactacccgaacgacgtacttctaccgtcgacctaccgtacgacctacgaaggtaaaccaccgtacgtacctttacccgtagaccctagtaccgtaccgtacggggtaccgtacgacgggaacggaacgtaacgtaggtaacggtcttacgtaacttaacgtttaaccgtaaccgggttaacccgttaccccgggaaccctaccgtaacggtaccgtaacctaacccgttaaggtttcgggttcggttaccgggtacgggaaccgggtaccaacgtccgtacggtaacccgttacgtaaacggttaccgaccggtaacccgaccggttccgacccccggtccccgttacccggtactaaccccttccgtaccccgtttcccccgccccgttaccccg

SEQ ID NO: 9410 - DNA, 825 bp, Homo sapiens
  misc_feature: GYAE6OF01AKO76.25.16.B05.1.454.CMB.1.raw
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
tcagactgtacagtcacgaccggtgctcgatttagagctcacgtaagggggtgggctcagaagcagagttctggggtgtctccaccatggcctggacccctctctggctcactctcctcactcttgcataggttctgtgtattttcttctgagctgactcacggaccctgctgtgtctgtcggccttgggacagacagtcaggatcacatgaccaagganacncgacctacaagtaaactattatgacaggtctaggtaccagcgaagaagaccgaggaccacggccccttattcgtacgtctacgttacgtttaacggtaaaaaacccaacccggtcccgtacgtaacgggtaccttaccccgaacggtaacccgtaactttcccgtacccggttccgggtacccttaccccgaagtccccgttaaccgaaaacgggtaaaacctaacccgtacgttacccttttacccgtacggaacccctacgttacccgtaccgggtccgggggtacctaccgggacgggtaccgggaaagtcgtaaggtacgggtccttaaggttaacctttaacgttaccgttaacccgtaaccccggtaccccgggtaacaccgtaggtacccgtaacttaaccggttaggtttcgggtacgggttaccggggacggaacgggtacccgaaggtccgtaccggtacccgttaccgttaacggacccgtacccggtaacccgggaaccggttccccggttacccccgggtacccccggtttacccggtaccttaaccccgttccccggttacccccgttcccccctaaccccgttcccc

SEQ ID NO: 9411 - DNA, 913 bp, Homo sapiens
  misc_feature: GYAE6OF01AC2FI.25.16.B05.1.454.CMB.1.raw
tcagactgtacagtcacgaccggtgctcgatttagagctcacgtaagggggtgggctcagaagcagagttctggggtgtctccaccatggcctggacccctctctggctcactctcctcactcttgcatggttctgtgatttctctgagtctgactcacggtacctgctgtcgtcgtggtcggccgttgggacagacaggtcaggtactcgacatcgaccgaaaggacacgaacgcctagaacgtaaacttattagcggaccgtacggtacgtacggtaaccgacgtacgaaacggaaccggtaccgaacggtaccgaaccgggtacccctttagttaccgtttagtacccgttaacgtttaccggtttaaacggtaaaaaacccggtacccggtaccccgttaaggtaaccggggtaaccttaccccggtaaacggtaacccggtttacgtttaaccggtccgggttaccggtaaccgtttaccgacggtaacccgttaaccggaaaccgggtaaaccctacggtaccgtttaccgtttaccgtaaccgtaccgtaacggtaccgtaccggggtaccggggtacccgtagggaaacgggggtaccgtaaaggtaccgtagggtaaccggttccgtaacggtttaaacccgttacgtaacggttaccggtaacccgttaccgggaaccgtaccggtaagtacccgtacggttaacttcgggttacggttacccgggtcggaaccgggtaacgacccgtacggtacccgggttactaacccggtttaccggaacgttacccggaaccgggttaaccccgttaccgggaacccgttccccgggttaccccggttacgggtaccccttacccggtttaccgggtccccccgttttaccccgtcccggttaaccccg

SEQ ID NO: 9412 - DNA, 902 bp, Homo sapiens
  misc_feature: GYAE6OF01AG4BR.25.16.B05.1.454.CMB.1.raw
  modified_base (102)..(102): a, c, t, g, unknown or other
  misc_feature (102)..(102): n is a, c, g, or t
  modified_base (138)..(138): a, c, t, g, unknown or other
  misc_feature (138)..(138): n is a, c, g, or t
  modified_base (219)..(219): a, c, t, g, unknown or other
  misc_feature (219)..(219): n is a, c, g, or t
tcagactgtacagtcacgaccggtgctcgatttagagctcacgtaagggggtgggctcagaagcagagttctggggtgtctccaccatggcctggacccctntctggctcactctcctcactctttgcataggttctntgtattttctctgagctgactcgaggaccctgcttgtcgtctggtggtccgtttagggacacgacagtacaggatacaacntcggaccgaaaggtacgacacgtacctacaagtaaacttacttagcgacgtaggtaccgtacggtaaccaacggacgaaacgaacgacccggaacggaccggaaaccccggttaccccttacgttaccgtttacgtaaccgttaactttaaccggtttaaaaaccggaaaaacccggtaaccccggtacccgtaaaccggtaacgggtaaccttacccccggaacggttaaccccgtacttacccgttcggtcggtaaccctaccgtaacggtacccgtaaaccggtaaacgaaacccgaacgtaaccgtttccccggtttaacctaacccgtaaacctaccgttacccgggtaccgggttaaccgggtaccgttacccgggaaggggtaaaccgtaagggtactaccggggtaacgtaacttaacggtaaccttaacggttaccgttaacccggtaacccgttacccgggaacccaacgggttccgtaaacccgttacttaacggttacgggtttcgggtttaacgggtaaccggggtacggaacgggtaacccgtagttacccgtaacgggttacccgtaaccgtacggacccgtaccggaacccgggtccgtacccaccccgttcccgggtacccttaccggtcccctttacacccccggttcccctccccgttaacccg

SEQ ID NO: 9413 - DNA, 957 bp, Homo sapiens
  misc_feature: GYAE6OF01E4B23.25.16.B05.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (528)..(528): a, c, t, g, unknown or other
  misc_feature (528)..(528): n is a, c, g, or t
tcagactgtacagtcacgaccggtgctcgatttagagctcacgtaagggggtggctcagaagcagagttctggggtgtctccaccatggcctggacccctctctggctcactcctcctcactctttgcattaggttctgtgtattttcttctgagctgactcacggacctgctgtgtctggtggcctggacagacngtcaggatcacntgaccgaaaggacacgacgaccttacgaacgtaaaaccttagttacgtacggaccgacggtaccgttacgggaaccgaacggaaccgtaaacggaaccggacccgaacggaaccgtaacccggttacccccttaagtttcccgttagtttaccgtaaacttttaccggtttaaaaacccggtaaaaaaacccgtaccccggggtaacccttaaacggaacgggtaaccgttacccccaacgggtaacccgtttacgtttcccgttacgtaccgggaacctttaccgaaccgtaccgttaaccgaaacgggttaaaacccncggtaaccttttacccgttacccgttaaccgtaacccggtaagtaccccgggttaacgggtccggggtaaccgtccgggtaaacggggtacggaaacggtagttacgggtaacgggttccgtaaaccggttaacgtttaaccgtttaccggttaaacccgttaacccgggttaacccccgggaaccaacccgggtttaagtaccggttaaacccgaaccggttttaaggggtttcgggtaccgggttaacgggaccggggtaaaacgtacccggaaacggttcccgtaacggttacccgttaacggttaaacccgtaccggtacccggaacccggttaccggtcccccgaccccggtaacccccccggtttcggtaacccttaaccccgttcccctttaaccccggtttccccctaccccgttacccgg

SEQ ID NO: 9414 - DNA, 252 bp, Homo sapiens
  misc_feature: GYAE6OF02H3JUN.25.16.B05.1.454.CMB.1.raw
  modified_base (223)..(252): a, c, t, g, unknown or other
  misc_feature (223)..(252): n is a, c, g, or t
tcagactgtacagtcacgaccggtgctcgatttagagctcacgtattagggtttggggaagaggaagactgacggtcctcccaggagttcaggtgcctgggcaccttgggcacggggaggtgtgtcacaagatttgggctctgggcacagcggccctgggcctgcctggtcaaaggactacttccactgtaccagtctgagcgggctggccaaggcgcatagnnnnnnnnnnnnnnnnnnnnnnnnnnnnnn

SEQ ID NO: 9415 - DNA, 301 bp, Homo sapiens
  misc_feature: GYAE6OF02ITBCC.25.16.B05.1.454.CMB.1.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (258)..(301): a, c, t, g, unknown or other
  misc_feature (258)..(301): n is a, c, g, or t
tcagactgtacagtcacgaccggtgctcgatttagagctcacgtaattgggtttgggacagaattcactctcaccatcagacagcctgcagcctgaagatgttgcaacttagttactgtcaaaaatttgacagtgacccgtggatgttcggcccagggaccaaggtggacatcaaacgaactgtggctgcaccatctgtcttcatcttccgcatctgaactgtacagtctgancgggctggcaaggcgcataggnagnnnnnnnnnnnnnnnnnnnnnnnnnnnnnnnnnnnnnnnnnnnn

SEQ ID NO: 9416 - DNA, 521 bp, Homo sapiens
  misc_feature: GYAE6OF02ICN55.25.16.B05.1.454.CMB.1.raw
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
  modified_base (444)..(444): a, c, t, g, unknown or other
  misc_feature (444)..(444): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaaggagacagcctcagaaactattatgcaggctggtaccagcagaagccaggacaggcccctattcttgtcatctttaggaaaacaccggccctnagggactcccagaccgattctctggctccagctcaggaacncagcttctgaccatcacgtgggctcgaggcggaagatgaggctgactattactgtaacctcccgggacaccgagtcgactaacctagtttggngtttcgggcggaagggaccaagcgtacggaccgtcctaagtccacgcccaaggcctcgccccctggtcacctctccg

SEQ ID NO: 9417 - DNA, 533 bp, Homo sapiens
  misc_feature: GYAE6OF02JXLBF.25.16.B05.1.454.CMB.1.raw
  modified_base (333)..(333): a, c, t, g, unknown or other
  misc_feature (333)..(333): n is a, c, g, or t
  modified_base (371)..(371): a, c, t, g, unknown or other
  misc_feature (371)..(371): n is a, c, g, or t
tcagactgtacagtcacgaccggtgctcgatttagagctcacgtatttgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccggcgagtcagggcattggaaattattggcctggtatcagcaagaaaccagggaaacgttcctaacctcctcatctatgctgcatccactttgctaagtttcgggtccctntcgattcagcgcaggtgggtctgggacagtatcactcncacatcagcagcctgcagcctgaagtatgttcgactaactttattactacgttaactaaaatttgaactagttacgtaccgtaggtacgttcggttccggaccgtaacgggaccgtaagggtacggaacgtaacgtaaccgtaaacggtacgtaggtacggg

SEQ ID NO: 9418 - DNA, 559 bp, Homo sapiens
  misc_feature: GYAE6OF02IRARD.25.16.B05.1.454.CMB.1.raw
  modified_base (549)..(559): a, c, t, g, unknown or other
  misc_feature (549)..(559): n is a, c, g, or t
tcagactgtacagtcacgaccggtgctcgatttagagctcacgtattgggtctgggagaggagccccagtcctggggactgaatacagacggctcaccctggagtcatggctgcacttgggtttttcttgcctcttctttaaagggaggttctctgagagaaaatgaaattgagtgtgagcggttatgagtgggagaaaacaaaagaatcagacggacaaattgtaaggtgcgtagggggccggtcgtgggggagccctgtcacacggtggggtctttcagaaggcggccggtgaagtctctggactcggcgtcgatcagcctctatatcattagtcgacgaaatcttcctagaacaattattcgtcagtattttcgcctccaccgaacgggcccagtccggtccttccccctggccgtccctgcctccgaggacgccaccctccgagaaccacgacgccggcccgtgggcctcggcccgtggtaccgaaggaccttaccttacccacgtcgtaccagtctgacggcgggcgtggcgaggcgcgatagnnnnnnnnnnn

SEQ ID NO: 9419 - DNA, 257 bp, Homo sapiens
  misc_feature: GYAE6OF02HXK9J.25.16.B05.1.454.CMB.1.raw
  modified_base (255)..(257): a, c, t, g, unknown or other
  misc_feature (255)..(257): n is a, c, g, or t
tcagactgtacagtcacgaccggtgctcgatttagagctcacgtagttgggtttgggacagaattcacctctcaccatcagcagcctgcagcctgaagatgttgcaacttattactgtcaaaaatttgacagtgacccgtggatgttcggcccagggaccaaggtggacatcaaacgactgtggctgcaccatctgtcttcatcttcccgccatctgaactgtacagtctgagcgggctggcaaggcgtcatagnnn

SEQ ID NO: 9420 - DNA, 562 bp, Homo sapiens
  misc_feature: GYAE6OF02JBH46.25.16.B05.1.454.CMB.1.raw
tcagactgtacagtcacgaccggtgctcgatttagagctcacgtaagttaggggtttagggggcagtaagtctctctcgagtcaaggaactacagacatggacatgagggtccctgctcagctcctgggactcctgctgctctggctcccagctatcagatgtggcatccagatgacccagtctccatcctcctgtctgcatcctgttggagacagagtcacctatcacttggccggcgagtcagggcattggaaattattggcctggtatcagcagaaaccgaggtaacgttcctaacctcctcactctatgctgcatccacgttcgactacgttcgggtcctcgtcgtatcgagcgtcgtaggtggtcgtaggacagtacgttcactctacactatcagcacgcttgacacgccgtagagtgtcgttagactactttacttacgtacgttaacttaaaagttcgtaacgtaacgtacgtaccgtagtacgttcggttaccggaccgtaacgggtaccgtaaggtcggtaacgtacgtaacgtaaccgtacgtcggtacgg

SEQ ID NO: 9421 - DNA, 597 bp, Homo sapiens
  misc_feature: GYAE6OF02FJYNR.25.16.B05.1.454.CMB.1.raw
  modified_base (313)..(313): a, c, t, g, unknown or other
  misc_feature (313)..(313): n is a, c, g, or t
tcagactgtacagtcacgaccggtgctcgatttagagctcacgtaaggggagcgtgtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaggagacagcctcaagaaactattatgcagctggtaccagcagaagccaggacacggcccctattcttgtcatctttaggtaaaaacaccggcctanagggactcccgagaccgattctctcggctccgagcctacgaacggtaaacacacgtacctttcccttagaccctatccaacgtcggggcctcgacgggcggaaagagtagacggctagacttaagttactacgtaaccgtcccgggaaccaccgagtacgacttaaccgtagtttggtacgttcgggacggtaacgggacctaaggccgtaggacccggttactaacgtccaacggccccgaaggccctccggccccccgttcggtccctaccttccgttcccg

SEQ ID NO: 9422 - DNA, 261 bp, Homo sapiens
  misc_feature: GYAE6OF02JXX7A.25.16.B05.1.454.CMB.1.raw
  modified_base (225)..(261): a, c, t, g, unknown or other
  misc_feature (225)..(261): n is a, c, g, or t
tcagactgtacagtcacgaccggtgctcgatttagagctcacgtagttgggtttgggggaagaggaagactgaccggtcctcccgaggagttcaggtcgctgggcaccttgggcacgggggaggtgtgtcacaagatttgggctctgggcacagcggccctgggctgcctggtcaaggctacttccactgtacagtctggagcgggcctggcaaggcgcagtagnnnnnnnnnnnnnnnnnnnnnnnnnnnnnnnnnnnnn

SEQ ID NO: 9423 - DNA, 694 bp, Homo sapiens
  misc_feature: GYAE6OF02JATF2.25.16.B05.1.454.CMB.1.raw
  modified_base (229)..(229): a, c, t, g, unknown or other
  misc_feature (229)..(229): n is a, c, g, or t
tcagactgtacagtcacgaccggtgctcgatttagagctcacgtattagggtttgggggcaaggaagtcgtctctcacgtacaggacacagcatggacatgagggtccctgctcagctcctgggactcctgctgctctggctccagctatcagatgtgcatccagatgacccagtctccatcctccctgtctgcatctgttggagacagagtcaccatcacttgccggnagtcaggcattggaattattgctggtatcagtacaagaaaccgagggtaaaacgttccgtaacctcctacctaacttcctaagtcgtcttcgactatcctactttcgacttaaggtttaccggggtcccgtctacgtacttacgagcggtcgtaggtcgggttacgtgggtacgtagtaaacgtttacgtactttaccgactacctactacgaacggccaacgtcccgttacggacctaccggtacccgtaaggtaaacgtagttcgggtttaacgtaccttaaacttttactttaaaccggtttacttaaaaccgtttaaaaaagtttcgtaaactaacgggttaccggtaacccgtttagggtaacttccggggtttaacccgtacccgggttaaacggggacccggttaaagggttcgggtaacctaacggtaacgaaaccggttaacgtgggttaaccggg

SEQ ID NO: 9424 - DNA, 607 bp, Homo sapiens
  misc_feature: GYAE6OF02H1JCO.25.16.B05.1.454.CMB.1.raw
  modified_base (350)..(350): a, c, t, g, unknown or other
  misc_feature (350)..(350): n is a, c, g, or t
tcagactgtacagtcacgaccggtgctcgatttagagctcacgtaagggggtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaggagacagcctcagaaactattatgcaggctggtaccagcagaagccaggacaggcccctattcttgtcattcttaggtaaaaaccaccggcctcgagggactcccagaccgattctctggctccagctcgagaaacncagtcttctgaccatcacgtggggctcgacggacggaagatggaggctaggacttattacgtacgttaaccgtcccgggaacaccgtagtcgaccttaaacctagtttacggtcgttccgggacgggtaacgggaaccgaaggtaccgtggacccgttaccgtaacggtaccgaacggaccccgaagggtccctaccgcccccccgttacggtaccctaccgttcccgttaccgtttcccccctacccgttaccccg

SEQ ID NO: 9425 - DNA, 735 bp, Homo sapiens
  misc_feature: GYAE6OF02HXMA6.25.16.B05.1.454.CMB.1.raw
tcagactgtacagtcacgaccggtgctcgatttagagctcacgtaaggggagctgtgggctcagaagcagagttctggggtgtctccaccatggcctggacccctctctggctcactctcctcactctttgcataggttctgtgattttcttctgagctgactcaggaccctgctgtgtctgtggccttgggacagacagtcaggatcacatgccaaggagacagcctcagaaactattatgcaggctggtaccagcaagaagccgaggacacggcccctattcttgtcattctttaaggaaaaccaccggcctacgagggactacccgagaccgtatctactcggctccagcctacgaacggaaacactacgtacctttcccttacgaacctacgtcaaccggtcggggtcctacgacgggaccggtaaaggagtacggacggtcgtacgaacgtttaacttaccgtacggttaaacccgtacccggggaacctaacccgaacgggttaccgtaacccgtttaaaccccgttaaggtttttccggggttaccgggtttaccggggaccggggtaaacggggtaaaccccgtaacgggtcccgttaaccgggtaaccccggttaacccggttaaacggttacccgaaccggtaacccccggtaaagggtccccgttacccggtaccccccccggttacggggtaccccttacccggttacccgtttccccccggg

SEQ ID NO: 9426 - DNA, 621 bp, Homo sapiens
  misc_feature: GYAE6OF02HYYWK.25.16.B05.1.454.CMB.1.raw
tcagactgtacagtcacgaccggtgctcgatttagagctcacgtaaggggagctgtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaaggagacagcctcaagaaactattatgcaggctcgtaccagcagaagccaggacaggcccctattcttgctatctttaggaaaaaccaccggcctacgagggactcccagaccgatttcctcgtggcctccagcctacgaacggaaaccacacgtcctttccgttagaccctatccgacgtcggggctcgaacgggacggaaagtagtggaggctagaacttagttacctagtaaaccgtcccgggaacaccgagtacgaccttaacctagtttcgggtcgttaccgggacggtaacgggacctaaggtccgtttaacccgtaccgtaacgttccgaacggtaccccgaagggtcccttcccggtcccccgttacggtaccacccgtttccgtccgttacccccc

SEQ ID NO: 9427 - DNA, 253 bp, Homo sapiens
  misc_feature: GYAE6OF02GGJVP.25.16.B05.1.454.CMB.1.raw
  modified_base (250)..(253): a, c, t, g, unknown or other
  misc_feature (250)..(253): n is a, c, g, or t
tcagactgtacagtcacgaccggtgctcgatttagagctcacgtagttgggtttgggacagaattcactctcaccatcagcagcctgcagcctgaagatgttgcaacttattactgtcaaaatttgacagtgacccgtggatgttcggcccagggaccaaggtggacatcaaacgactgtgctgcaccatctgtcttcatcttccgcatctgaactgtacagtctgagcgggctggcaaggcgcatagcnnnn

SEQ ID NO: 9428 - DNA, 597 bp, Homo sapiens
  misc_feature: GYAE6OF02IJRBM.25.16.B05.1.454.CMB.1.raw
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
  modified_base (338)..(338): a, c, t, g, unknown or other
  misc_feature (338)..(338): n is a, c, g, or t
  modified_base (393)..(393): a, c, t, g, unknown or other
  misc_feature (393)..(393): n is a, c, g, or t
tcagactgtacagtcacgaccggtgctcgattttagagctcacgtattggggtttacgggggccacgaagtcctctctcacggtcaaggacgacagcgactggactatggacggtcccgttgcgtcagcgttcctgggactcctgtcgtgctcgtcgcgtccagctagtcagctaggtcgaccatccagactcgaccctacgtcctccacttccctccctgtctcgcagtcgtgttgganacgagacgtcaaccatcacttgccggnagtcgaggcagttgaaattgttggctggtatcagcaagaaaccagggtaaacttccaacctctacatctancgctgcatcatttgactagtttcgggccctgtcgtattcagtcgctaggttcggntgggacagtatcactctcactactcacgcacgcctgacacgtacctagaagtattagttacgaacttaactttacttacgtagttaaacctaaaagtttgaacgtagtacgtacccgttaggtacgttcggttaccggaccggtaacgggtaaccgtaacgggtacggtaacgtacgttaaccgaaacgttacgtaggtaccgg

SEQ ID NO: 9429 - DNA, 731 bp, Homo sapiens
  misc_feature: GYAE6OF02HJABB.25.16.B05.1.454.CMB.1.raw
tcagactgtacagtcacgaccggtgctcgatttagagctcacgtaagggggtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaggagacagcctacagaaactattatgcaggctggtaccagcagaagccaggacacggcccctattcttgtctattcgtttaggaaaaaccaccggccctacgagggactccccgagaacccgtatttcctcgtcggccttccgagtcctacgaaacggaaaccacgacgtcctttccgttacgaaccctataccgtacgtcgggggtacctacggacgggacggaaacgtgtacggacggtcgtacggtaaccttaacgtttaccgttaacggttaaccccgttaccccggggactaacccgtaggtaccgtaaccttaaacccgttaggtttttcgggtacgggttaccgggaccggggtaaaccgggtaacccgtaaaggtccgtacggtaaccccgttaccgtaaacggtccgaacccggtacccggtaacgggtccccgttacccggtccccccgttacgggttaccctaccggtttcccggtttaccccggtttccccccgtccccttaccccg

SEQ ID NO: 9430 - DNA, 255 bp, Homo sapiens
  misc_feature: GYAE6OF02JFA2M.25.16.B05.1.454.CMB.1.raw
  modified_base (252)..(255): a, c, t, g, unknown or other
  misc_feature (252)..(255): n is a, c, g, or t
tcagactgtacagtcacgaccggtgctcgatttagagctcacgtattgggtttaggacagaattcactctcaccatcagcagcctgcagcctgaagatgttgcaacttattactgtcaaaaatttgacagtgacccgtggatgttcggcccagggaccaaggtggacatcaaacgaactgtggctgcaccatctgtcttcatcttcccgcatctgaactgtacagtctgagcgggctggcaaggcgcatagnnnn

SEQ ID NO: 9431 - DNA, 665 bp, Homo sapiens
  misc_feature: GYAE6OF02GS5HO.25.16.B05.1.454.CMB.1.raw
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
tcagactgtacagtcacgaccggtgctcgatttagagctcacgtaagttaggggtttcggggcctagaacgtctctcgtcagtcaaggacacagcatggacatgagggtccctgctacagctccgtggacctcctgcctgctcttggctcccagcctatcgacgatggtgcactccagtatgacccagtctccgatccgtcctgtctgcatctgttganacngagtcacgatcactgccggnagtcaggcattgaattnttagcctaggtatctagcgagtaaaccgaggtaacttaccctaaccgtcctacgaactcctaatacggctacgtactactcctaacgtttcgactaacgtttcggggtccctcgttcgtactttacgacgtccgtcctacggttcggtccgtagggaacgtacgtaacttcgtacgttactcgaccgtactcgacgtaccgacgaccgttagaccgtacgtcccgtagtaagtacgtgttccgtaacttaaccgttttaacttacgttacgttaaacgtaaaaactttcgaaacgttacgtaccgaccgttaggaacgttttcgggtaaccggtcccggtaacgggtaacccggaagggttaccggtacgtaaccgtacgtaaaacgtaccggtaggttaaccggg

SEQ ID NO: 9432 - DNA, 711 bp, Homo sapiens
  misc_feature: GYAE6OF02IVXZ1.25.16.B05.1.454.CMB.1.raw
  modified_base (457)..(457): a, c, t, g, unknown or other
  misc_feature (457)..(457): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcattaggttctgtgatttcttctgagctgactcaggaccctgctgtgtctgtggccttgggacagacagtcaggatcacatgccaaaggagacacgcctacaagaaaactattatgacaggctaggtaaccagacaagaagccaggacagccccttattcttgtacattcgtttaaggtaaaaccgaccgtccctacgacgggactacccgaagtaccgtattcctctacggcctaccagtcctacgaacggtaaacacacggtacctttccgttacgaccctactaccgaacggtcggggtacctacggaacgggacgggtaaanaggtaggacggtacgtacgtaacttaacgttacgtaacggttaacccgtacccggggtaaccaaccgtagtaccgtaacccttaaacgtacggttttacggggtacggtttccggggaccgggtaagggtaacccgtaagtccgtaaccggtaacccgttaaccgttaaccggaccgtaacggtaaccccggaaggttccccgtacccggaccccccgttcgggtaaccctcccggttacccgttaacccccgg

SEQ ID NO: 9433 - DNA, 623 bp, Homo sapiens
  misc_feature: GYAE6OF02JCA6Y.25.16.B05.1.454.CMB.1.raw
  modified_base (413)..(413): a, c, t, g, unknown or other
  misc_feature (413)..(413): n is a, c, g, or t
tcagactgtacagtcacgaccggtgctcgatttagagctcacgtaagggggtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgaccaagggagacagccctacaagaaactattatgcaggctggtaccagcagaagcaggacacggcccctattctgtcattctttaggaaaaaccaccggcctacgaagggtactcccgagaccgtattctctggcctccagtcctcgaaggaaacacagtccttcctagacccatccgacgtcggggctacggagggacggaagngtaggacggctagacttattacgtacggtaacccgtcccgggaacaccgtagtacgaccttaacctggtttcggtcgttccgggacggtacgggtaaccaaggtccgtacggtacccgttacgtaacggtccgaaccggacccgaaggtccctcccggtcccccgttacggtaccctaccgttccgtccccgttaccccctcccttcccg

SEQ ID NO: 9434 - DNA, 679 bp, Homo sapiens
  misc_feature: GYAE6OF02G21IV.25.16.B05.1.454.CMB.1.raw
tcagactgtacagtcacgaccggtgctcgatttagagctcacgtaaggggagctgtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaggagacacgcctacaagaaacttattatgcaggctggtaccagcagaacgccgaggacacggcccctattctgtctattcgtttaacggtaaaaccacccggcctacgagggacctacccgaagaccgtacttctcgtcggcctccgacgtctacgaacggaaacacgacgtccttaccgttacgaaccctactaccgtaccgggtcggggacctacggacggggacgggaaagtaggtagggacgggtctaggtaacctttacgttaaccgtacggttaacccgtacccgggaacctaaccgtaggtaccgtaccgttaaacgttaggttttcgggtaccgttccggggacgggtaacgggaccgtacgcgttccggacccggttcgtaccgggtaccgacggtacccgtaagggtcccctacccgggcccccgttcggtaccctccgttcccgttaccccg

SEQ ID NO: 9435 - DNA, 317 bp, Homo sapiens
  misc_feature: GYAE6OF02IZ2WZ.25.16.B05.1.454.CMB.1.raw
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (267)..(268): a, c, t, g, unknown or other
  misc_feature (267)..(268): n is a, c, g, or t
  modified_base (271)..(272): a, c, t, g, unknown or other
  misc_feature (271)..(272): n is a, c, g, or t
  modified_base (274)..(275): a, c, t, g, unknown or other
  misc_feature (274)..(275): n is a, c, g, or t
  modified_base (277)..(317): a, c, t, g, unknown or other
  misc_feature (277)..(317): n is a, c, g, or t
tcagactgtacagtcacgaccggtgctcgatttagagctcacgtatttggggtttgggacagaattcactctcaccatcagcagcctgcagcctgaagatgttgcaacttattactgtcaaaaatttgacagtgacccgtggatgttcggcccagggaccaaggtggacatcaaacgactgtgctgcaccatctgtcttcattccttcccgccatctgaactgtacagtctgagcgggctgcaaggctcaattagantgcntcgtanntgnntnntnnnnnnnnnnnnnnnnnnnnnnnnnnnnnnnnnnnnnnnnn

SEQ ID NO: 9436 - DNA, 253 bp, Homo sapiens
  misc_feature: GYAE6OF02H2ZD3.25.16.B05.1.454.CMB.1.raw
  modified_base (190)..(190): a, c, t, g, unknown or other
  misc_feature (190)..(190): n is a, c, g, or t
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (250)..(253): a, c, t, g, unknown or other
  misc_feature (250)..(253): n is a, c, g, or t
tcagactgtacagtcacgaccggtgctcgatttagagctcacgtagttgggtttgggacagaattcactctcaccatcagcagcctgcagcctgaagatgttgctaacttattactgtacaaaatttgacagtgacccgtggatgttcggcccagggaccaaggtgacatcaaacgactgtggctgcacntctgtcttcatctcccgcatctgaactgtacagtctgagcggntaggcaggtcacanagnnnn

SEQ ID NO: 9437 - DNA, 700 bp, Homo sapiens
  misc_feature: GYAE6OF02IKQ4Y.25.16.B05.1.454.CMB.1.raw
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
tcagactgtacagtcacgaccggtgctcgatttagagctcacgtaaaggggagctggggtgggctacagaagcagagttctgggggtgtctccaccatggcctggacccctctctgctcactctcctcactctttgcagtaggttctggtcgagtttcttctgagcctgactcaggaccctgcttcgtgtctggtcgccttgggacagcagtcaggntcantgaccgaaaggnacgngcctagaagtaaacttattatgctaggtcgtacggtaaccacgtaccgaggaacgaccgaccggaactacggacccttatttcgttgtacgattaccgtttaaagtaaaaccgacccggtcctacggaggtactcccgacgtaccgtacttcgtctcgtcctccgacgactacgaacggaaccacgtacgtaccttaccgttacgacctacgtccgtacggttacgggctacggaacggggtacgggaaacgtcgtacggtacggtacttaggtaacctttaggttacctacggttaacccgtaccggaactaccgtagtacggtacttaacgttggtttacgggtcggttacgggacgggaacgggacctaggtccgtacgggtacccgtacgtaaccggtcgacccggtacgaacggtccgtcccggtaccccgttagacccttccgtcccgttacccccg

SEQ ID NO: 9438 - DNA, 761 bp, Homo sapiens
  misc_feature: GYAE6OF02I4X1A.25.16.B05.1.454.CMB.1.raw
  modified_base (194)..(194): a, c, t, g, unknown or other
  misc_feature (194)..(194): n is a, c, g, or t
  modified_base (226)..(226): a, c, t, g, unknown or other
  misc_feature (226)..(226): n is a, c, g, or t
  modified_base (355)..(355): a, c, t, g, unknown or other
  misc_feature (355)..(355): n is a, c, g, or t
tcagactgtacagtcacgaccggtgctcgatttagagctcacgtaaggggtgggctcagaagcagagttctggggtgtctccaccatggccctggacccctctctggctcactctcctcactctttgcataggttctgtgatttcttctgagctgactcaggaccctgctgtgtctgtggccttgggacagacngtcaggatcacatgccaaggagacaggcctanaagaaactattatgcagcgtggtaccagcagaagccacggacacggcccctattcttcgctatcgtttaacggtaaaaccgaccgccctcgagggactcccgagtaccgtattctctcggtcctaccgngtacctacgaacgtaaaccacgtacgtacctttcctacgaccctacgtaccaacggtcgggacctcggaggaccggtaaagagttaggacgggtcctaaggtaaccgttactttaaccggttaccggttaaaccccgggttaccccgggtaaacgtcggttaacgtaacccgttaaccgtacggttttttgggtaccgggtttaccggggacgggggttaaacggggacccttaaacggggtcccgttaacccgggtaacccgtttacccggtaacgtaccccggttaaccggtaaacccccgggtaacgggttaccccgtaccccgggtacccccccgttacggttaccccaccggttttcccggtaccccggtttcccccggtaccccttccccgtttaacccg

SEQ ID NO: 9439 - DNA, 556 bp, Homo sapiens
  misc_feature: GYAE6OF02I05A5.25.16.B05.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (329)..(329): a, c, t, g, unknown or other
  misc_feature (329)..(329): n is a, c, g, or t
  modified_base (348)..(350): a, c, t, g, unknown or other
  misc_feature (348)..(350): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
tcagactgtacagtcacgaccggtgctcgatttagagctcacgtaagggggtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaggnacagcctnagaaactatatgcaggctggtaccagcagaagccaggacaggcccctattctgtcattcgtttaggaaaaaccaccggccctgacgggactcccgagaccgattcnctggctcagctcgagaacnnncttctgaccatccngtgggctcgaggacgaagancgagtctgactattacngtaaccgccggacaccgagtcacttaactagtttcggtagttcggacggtacgacagcgtacgaccgtacgtaacgtccgacgtacccgaaggtccctaccggacccccgttcggtacctaaccgttcccgtaccgtttacccccacccttaccc

SEQ ID NO: 9440 - DNA, 610 bp, Homo sapiens
  misc_feature: GYAE6OF02FWZCU.25.16.B05.1.454.CMB.1.raw
  modified_base (219)..(219): a, c, t, g, unknown or other
  misc_feature (219)..(219): n is a, c, g, or t
  modified_base (421)..(421): a, c, t, g, unknown or other
  misc_feature (421)..(421): n is a, c, g, or t
tcagactgtacagtcacgaccggtgctcgatttagagctcacgtagttgggtttgggctgaactgggttttcctcgttgctcttttaagaggtgtccagtgtcaggcgcatctcggtggagtctgggggaggccgtggtccaagcctgggaagtccctgagactctcctgtgtggcgcctagactcaccttcagtagttatggctttcgtctgggtccncagtgtccaggcaaagggctggagtcggctggggaagtttacttggtctgacaagacaaatgacatatcacgcggagtccgtgagggccgagttcacctatctccagggacaattcaagacgaaccctcgtatctagacaaactcgaaactaacttcgagagtcgaagactacggtcgtttatactgtgacgacctcgaggngtacggctaggtaaaagtcgtaagtctacgacgttcccgtcgaccttcgtacgggccgagggctacgttcgtcgttacgacgttcgtccgtagtaccgtcttaccgaccgaacggccctaagtccggtacctcccggtacggcccgtcccgttgcctaccgacggtcgaccgtcccgtggtacccgggg

SEQ ID NO: 9441 - DNA, 726 bp, Homo sapiens
  misc_feature: GYAE6OF02G0Q92.25.16.B05.1.454.CMB.1.raw
tcagactgtacagtcacgaccggtgctcgatttagagctcacgtaaggggagctgtgggctcagaagcagagttctggggtgtctccaccatggcctggacccctctctggctcactctcctcactctttgcataggttctgtgatttcttctgagctgactcaggaccctgctgtgtctgtggccttgggacagacagtcaggatcacatgcccaaggagacagccctcaagaaactattatgcaggctggtaccagcagaagccaggacacggcccctattcttgtctattcgtttaaggtaaaaccaccggccctacgagggactccccgagaccgtattctcgtcggcctccgacgtctacgaacggaaaccacgacgtccttaccgttacgaaccctataccgacggtcggggacctacggacgggacgggaaagtacgttacggacgggtccgttaggtaaccgtttacttaaccgttacggttaaacccgtaccccggggtaaccaacccgtacggtaccgtaaccgtttaaacccgttaggttttcgggtccgggtttaccggggaccgggtaaacgggtacccgtaacggtaccgttaccggtaacccggttacccgtaaacggttcccggaaccggtacccccgtaaaggggtccccttacccgggtacccccccgtttacggggttccctaacccggttcccgtttaacccccgg

SEQ ID NO: 9442 - DNA, 674 bp, Homo sapiens
  misc_feature: GYAE6OF02IQJL5.25.16.B05.1.454.CMB.1.raw
  modified_base (229)..(229): a, c, t, g, unknown or other
  misc_feature (229)..(229): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcataggttctgtgatttcttctgagctgactcaggaccctagctgtgtctgtggccttggacagacagtcaggatcacatgaccaaggagacagcctnaagaaaactattaatgacaggctaggtaaccagcaagaagccgaaggtacacggcccctattccttgtcatacgtttaaggtaaaaaccaccggtccctacgaggtactacccagaccgtattcctcgtggctacccgagcctacgaacggaaaacacgtagtacctttacccgttacgaaccctataccgaacggtaggggccttacgaaggggtacggtaaaagagttacggacgggtacctagaacgtttaacttaacgttacggttaaacccgttccccgggaacaacccgtagtacgtaccttaacctagttttcggtcgtttacgggacggtaacgggacctaaggcgtacggtaacccggttccttaaacggtccgaacgaccccgaaagggtccctaccggtcccccggttacggtactacccgttcgttaccccgg

SEQ ID NO: 9443 - DNA, 283 bp, Homo sapiens
  misc_feature: GYAE6OF02FLDBU.25.16.B05.1.454.CMB.1.raw
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (258)..(259): a, c, t, g, unknown or other
  misc_feature (258)..(259): n is a, c, g, or t
  modified_base (261)..(261): a, c, t, g, unknown or other
  misc_feature (261)..(261): n is a, c, g, or t
  modified_base (265)..(283): a, c, t, g, unknown or other
  misc_feature (265)..(283): n is a, c, g, or t
tcagactgtacagtcacgaccggtgctcgatttagagctcacgtagttgggtttggggacagaattcacctctcaccatcagcagcctgcacgcctgaagatgttgacaacttattactgtacaaaaatttgacagtgaccgtggatgttcgccaggaccaaggtgacatcaaacgactgtgcctgccacgatcngtctcatcttcccgccatctagactcgtacagtctgagcggntggacaggcnctatagcancnngnatcnnnnnnnnnnnnnnnnnnn

SEQ ID NO: 9444 - DNA, 722 bp, Homo sapiens
  misc_feature: GYAE6OF02IL1QM.25.16.B05.1.454.CMB.1.raw
  modified_base (535)..(535): a, c, t, g, unknown or other
  misc_feature (535)..(535): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcataggtttctgtgatttcttctgagctgactcaggaccctgctgtgtctggtggccttgggacagacagtcaggatcacagtcgaccaagggacacgacgcctacgaagtaaaccttagtattgacgtaggacttacggtaaccgagaccgaagaacgaccgaacggaaccgtaccggaccccctttaattttccgttacggttactacgtttacgttttaacgggtaaaaaaccctacccggacccttaacgaacgggtaccgtaccccgtaacggaccgtaacttctaccgtcggtcccaccgacgtactaccgtaaggaaaacctacgacgttaccctttccgttacgaacccttagtcccgtaacgggtcgggacctcggaacgggtaacgagtaacgngggtaccgacttagtaactttacgacgttacggtacccgtaacccggacctcgtaggtcctacgtacttaggtttcggtcgggtacgggcgggtaactacggccgtacgtacccgtagtaacgtaccgacggaccgtaacggcccttcccggccccttcggaaccctccggttccctccgtcccccg

SEQ ID NO: 9445 - DNA, 652 bp, Homo sapiens
  misc_feature: GYAE6OF02FG51H.25.16.B05.1.454.CMB.1.raw
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (310)..(310): a, c, t, g, unknown or other
  misc_feature (310)..(310): n is a, c, g, or t
tcagactgtacagtcacgaccggtgctcgatttagagctcacgtaaggggagctgtgggctcagaagcagagttctgggggtgtctccaccatggcctggacccctctctggctcactctcctcactctttgcataggttctgtgattttctctgagctgactcaggaccctgctgtgtctgtggccttgggacaggacagtcaggatcacatcgccaaaggcgacagcctacagaaaactnttangcaggctggaccagcagaacgccaggacacggccctattctgtcatcttagaaaacaccgcctnacggactcccgagaccgtattccgtcgtcggctccgacgctacgaaggaaacacgtacgtcccttaccgttacgaaccctataccgtaccgtcgggggtcctaccggacgggtaccgggaagtacgtaggtaacgccgttaggaaccttaacgttacttacggtaaacccgtcccgggacctaacgtacgtacggtaaccttaaacccgttaagttttcgggttacggttacgggtaccgggaccgggtacctacggacgtacggtacccgtaccgtaacgtcccgacgaccccgtacggccctaccgtcccccgttacggtcccacgttcccgttaccccg

SEQ ID NO: 9446 - DNA, 603 bp, Homo sapiens
  misc_feature: GYAE6OF02FH0WU.25.16.B05.1.454.CMB.1.raw
  modified_base (252)..(252): a, c, t, g, unknown or other
  misc_feature (252)..(252): n is a, c, g, or t
  modified_base (350)..(350): a, c, t, g, unknown or other
  misc_feature (350)..(350): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcataggttctgtgtatttcttctgagctgactcaggaccctgctgtgtctgtggccttgggacagacagtcaggatcaacatcgaccaagggacgacacgccctacaagtaaaactattangcaggctaggaccaggacagaacgccaggaccacggacccctattctgtcattcttaaggaaaaccaccggcctagacggctcccgagacgtacttcncgtggcctccgagcctacgaagaacacgtagtcttacctacgaccatcacgtcgggctacgacgggacgaagagtaggacggtctacgtaacttacgttaaccttacgtaaccgtcccggaacaaccgtaggtacgtacctaacgttagtttcggtacgttccggacggagaccgtagcgtacgtaccgtaacgtaacgtccgaacgaccgtaacggcctaccggccccgttggtaccctacgtccgttcccg

SEQ ID NO: 9447 - DNA, 642 bp, Homo sapiens
  misc_feature: GYAE6OF02FZY5K.25.16.B05.1.454.CMB.1.raw
  modified_base (357)..(357): a, c, t, g, unknown or other
  misc_feature (357)..(357): n is a, c, g, or t
tcagactgtacagtcacgaccggtgctcgatttagagctcacgtaagggggtgggctcagaagcagagttctggggtgtctccaccatggcctggacccctctctggctcactctcctcactctttgcataggttctgtgattttcttctgagctgactcaggaccctgctgtgtctgtggccttgggacagacagtcaggatcacatgccaaggagacagcctcaagaaactattatgcaggctggtaccagcaagaagccaggacaggcccctattcttgcatctttaggtaaaaccaaccggcctcgaagggactacccagaccgattcctctggcctccagctcgaggaaacncagcttccttagacctatcacgtcggggtctacgagggcggaaagagtcggaggactgtaacctaagtttacctaggttaacccgtcccggggaaccacccgtagttacgaccttaaccgtagtttcgggtgttacgggacgggagggaacccgtagccgtacggaacccggttacctaacgggtccaaacgggtaccccgtaaacgggccctacggtcccccccgttacgggttaccctacccgttcccgtttacccggttcccccggtacccccttaccccgg

SEQ ID NO: 9448 - DNA, 701 bp, Homo sapiens
  misc_feature: GYAE6OF02JH76I.25.16.B05.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (282)..(282): a, c, t, g, unknown or other
  misc_feature (282)..(282): n is a, c, g, or t
tcagactgtacagtcacgaccggtgctcgatttagagctcacgtaagggggtgggctcagaagcagagttctggggtgtctccacatggcctggacccctctctggctcactctcctcactcttgcataggttctgtgatttcttctgagctgactcacggaccctgctgtgtctgtgcttggacagacngtcaggatcatancgaccgaaagagacacgacctacaaagtaaaacttatttaagcgactacggtacgtacgtaccgaacgacgaacgaacngggaacccaagggacccctaaggttacccgttagttactacgtacttacgtaaaaccttaccggtaaacctaaccgaccggtaactaccggaagtacccgagtaccgacttacgtacctacgacgtacgtacgacgtaacacgtaaacgactacgtacgtaccctagacgacgttacggacgtacggacgacgaacgacgtaacggagtcgtagaacttagtaactacgttaaccgtaccggtaaactacccgtaacgtaccgacgttaacgtacgttaaccggttacgttacgggtacggtacggtaccgaaacggtaccgtaacgaccgtacgtacgtacctaacggtaccgtaacgaccgtacggtacccgttccggtacctaccgtccgtacccttaccgttaccctccgtaccg

SEQ ID NO: 9449 - DNA, 725 bp, Homo sapiens
  misc_feature: GYAE6OF02JVR6C.25.16.B05.1.454.CMB.1.raw
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagactgtacagtcacgaccggtgctcgatttagagctcacgtaaggggagctgtgggctcagaagcagagttctggggtgtctccaccatggcctggacccctctctggctcactctcctcactcttgcataggttctgtgtattttcttctgagtctgactcacggtaccctggcttgtcgtctggtcggtccgttgggacgaggactagtaccgaggtatccacagtcgaccgaaaggcgacacgtactgaataacctattagcgacaggtcaggtaccagacacggacgccgtagacgaccgtaccctattacgtgtactacttacgtttaacggtaaaaccnccggaccgttanaacgggtacctaccgtagaccgtagttccgtagtccggtctacgtgtaccgtacggaacgaaacctcgtacgtcctccgtaacacctagtaccgacggtggtccgtacgacgggtaccaaggtcgtacggcgttacggtcttaacgtttagttaaaccgttaccggtaacccttccgggaacctaccgttaggtacctaacccgtttaaccgttaggttccggttacggttaaccgggacggtaaccgggactaccggttcgaaacccggttacccgtcggttaaacctccgggaaccgttaccccgggaacgttccggtccccggtaccccggttgacccggtttacccttaacccgggtcccc

SEQ ID NO: 9450 - DNA, 708 bp, Homo sapiens
  misc_feature: GYAE6OF02IKIJX.25.16.B05.1.454.CMB.1.raw
  modified_base (148)..(148): a, c, t, g, unknown or other
  misc_feature (148)..(148): n is a, c, g, or t
  modified_base (159)..(159): a, c, t, g, unknown or other
  misc_feature (159)..(159): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
tcagactgtacagtcacgaccggtgctcgatttagagctcacgtaagggggtgggctcagaagcagagttctggggtgtctccaccatggcctggacccctctctggctcactctcctcactcttgcagtaggttctgtgatttcttntgagctgactnagaccctgctgtgtctgtggcctagggaccagacagtnaggatcanagtgccaaaggnaacngcctcaaagaaactattagngacgagctagacagacgagacgcgaagacacgtacctattctgactaagttacgttaaacgtaaaaaccgaccggtcctacggacggtacctaccgagtacctattcgacgtcgtcctacgagcgtacggaacgtaaacacgtacgtaccttaccgtacacgtaactcgacggtcgggacacggaacgggaacggaagtacgtaggacgtacgtagtaacgttaagtaaccgttaacggtaacccgacccggaacctaacgacgtaccgaaccttaaacggttgttacggttcggtaccgggacggaaccgggtaaaccgaacggtaaccgttaccgtaaccggttaccgtaaacggtaccgaaaccggtacccggtaaaccggtcccgtaacccggtaccccccggttacggtaccgttaacccgttacccggtttaccccggttacccccgtcccggttaacccc

SEQ ID NO: 9451 - DNA, 752 bp, Homo sapiens
  misc_feature: GYAE6OF02FRN3S.25.16.B05.1.454.CMB.1.raw
tcagactgtacagtcacgaccggtgctcgatttagagctcacgtaaggggagctgtgggctcagaagcagagttctggggtgtctccaccatggcctggacccctctctggctcactctcctcactctttgcattaggttctgtgtattttcttctgagctgactcgacggaccctgctgtgtctgtcggtccgttgggacagacagtcgaaggactacactagtcgaccgaaaggacgaacacgtccctacgaaacgtaaaacttagtttatacgaccgaaggtccgtacgggtaaccacggacaaacggaacgaccgaacgggaaccgaccggttaccccttaagtttccgtttacggttaccttaacgtttaccggttttaaaaccggtaaaaaacccgtaccccggtacccttaacggaacgggtacctacccgaacgtacccgtaactttccgtcgtcggtacctccgtagtccgtacgtaaacggaaacctacgtacgttacctttaccgttacgaacctacgttccgtaacgggtccgggcctacggaacgggacggaagtacgtagggtaccgctacgttactacgtttacgacgttaacccggccgtaacctacgtagttacgtacccgttaacgttgtttcggtacggtaccggtacggaaccgtaaccgacgtcgacgtacccgttagacgtacgacgtaccgtaaggtcccgccgtacccgtcgtcgtactccgtccccg

SEQ ID NO: 9452 - DNA, 905 bp, Homo sapiens
  misc_feature: GYAE6OF02JR4K6.25.16.B05.1.454.CMB.1.raw
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttgcataggttctgtgtatttcttctgagctgactcgacggccctgctgtcgtcngtcggccttaggacngacagtcgaggtatcacgtagtcggaccgaaaggganaccgtaccgtacccgttaacgaaaacggtaaaaccttattaacgtcggtaccgaagggtccgttacgggttaaccacggacaacggaaccgaccggtaacggacgacccggtaccccgtttactttccgttcgttactactttaccgtttaaacggtaaaaccgtacccggacccgttacgaacggttacctacccgaaccggaccgttacctttccgttccgtaccggtacctccggtaccgtttaccgtaccgaaaccggtaaacctaccgaccggttaccttaccgtaccgtaaccctacgtccgtaccggtcggggtacctacgggtacggaccggaaagtaggttaccggacggtcgtacgtaacgttaacgtttacccggttaaccggttaaaccccgtacccggtaaccgtaaaccgttaccggtaaccgttaaccgtttaaccgggtttaccgggttttaccgggttccgggtaacccggggtaacgggtaaacccggtaaccgggttacggttacccgtttaccgggtaaccccggtttaaacggttaccccggttaaccggaaccccggttaaccccggtacccgggttaacccggtcccccggtttaacccccggttaaccgggttcccggttaccgttacccccggtttacccccggg

SEQ ID NO: 9453 - DNA, 966 bp, Homo sapiens
  misc_feature: GYAE6OF02G1KWX.25.16.B05.1.454.CMB.1.raw
tcagactgtacagtcacgaccggtgctcgatttagagctcacgtaaggggtaggcgtgtgggctcagaagcagagttctggggtgtctccaccatggcctggacccctctctggctcactctcctcacttcttgcattaggttctagtgtatttctctgagcttgactcacggaccctgcctgtgtcctaggtcggccttacgggacagacgacgttcgaggatacacgaagtcgaccaaagggacgacgacgtccgtacgaaacggttaaaacttacttaagcgtacggtacggtacgtaccggttaaccaggaccgaacgtaacggtaccgaacggaaccgtaaccgggtaccccttagttttaccgttacggttaccttaacgtttaaccggtttaaaccgggttaaaaaacccaccccgggttacccgttaacggtaaccggaaccgttacccccggtaaacggtaacccggtactttacccggttacgtaccgggttaacccttacccgggaacgttacctaacccggtaaacggtaaacccgtaacgttaacccggttaccttacccgtttaaccggaaccgttaccgtttaaccggaaccgggttcgggtaaccgtaacccgggtaagggtaacccggtaaggttaacggtaacgggaaacgttccggtaaacggttaccgtaaaggttttaacccgaaccgtttaaccccgggaaaccgtacccgaaacccgtaggttaaccgtacccgtttaaaccggttaggtttaaccgggttccgggttaaccgggaaccgggttaaacgggtaacccgtaggttacccccgtaaggttaaacccgggttaccctttaaccggaacccggtacccggtaacccgggtaccgaacccggggtttcccctacccccggggttaacccgtttacccgggtaccccctttaccggttaacccccccgg

SEQ ID NO: 9454 - DNA, 764 bp, Homo sapiens
  misc_feature: GYAE6OF02JT8GQ.25.16.B05.1.454.CMB.1.raw
  modified_base (131)..(131): a, c, t, g, unknown or other
  misc_feature (131)..(131): n is a, c, g, or t
tcagactgtacagtcacgaccggtgctcgatttagagctcacgtaaggggagctgtgggctcagaagcagagttctggggtgtctccaccatggcctggacccctctctggctcactctcctcactctttncataggttctgtgatttcttctgagctgactcaggccctgctgtgtctggtcgcttgggacagacagtcaggatcacatcgacaaaggtcgaacacggtccctagaaacgaaacttattacgcgacgaacggcgttacgggaccaaggcgtaagaacgccgaagggtaccaccgggtcccctatttcggttaccgtctacgttacgttttaaacggaaaaacctaccccggggtacctacggaccggtaacctacccggacgtaaccgttacttacgtcccgtggtaccctaccgacggtccctaacgaaacggaacctaccgtacgttcccttaccgttacggaaaccccttacgtacggtaacccggttcggggtaccccttaccggacggggaaaccggttaaagtacgggtagtaaacggggtccttaaccgtaacgttacgttacggtaccgtaacccgggttaccgggaacctaacggtcgttaccgaaccgtttaaaccggtcgtttaacgggtttacgggttcggaaccgggtaacgtaccgtaggtacctcggtaacccgttcgtaacgtccgaaccgtccgtaagccctaccggtcccgtccgtacctccgttacccgtcccg

SEQ ID NO: 9455 - DNA, 1131 bp, Homo sapiens
  misc_feature: GYAE6OF02H4W2W.25.16.B05.1.454.CMB.1.raw
  modified_base (107)..(107): a, c, t, g, unknown or other
  misc_feature (107)..(107): n is a, c, g, or t
  modified_base (252)..(252): a, c, t, g, unknown or other
  misc_feature (252)..(252): n is a, c, g, or t
tcagactgtacagtcacgaccggtgctcgatttagagctcacgtaaggggagctgtgggctcagaagcagagttctggggtgtactccaccatggcctggacccctntctggctcactctcctcactctttgcataggttctgtgtatttcttcgtgagctgactcgacggtaccctgctgtgtctggtcggccttagggacagtacgagtaccgaaggtatccaactagtgacccgaaagggaacgaccgnggtccctacgaaagtaaaactttacgttagtcgacgtacggtcgttcggtaaccagacgaaggaaccgacgaaggaaccgtacggaccccctttagtttccgttagtacctaacgttttaccggtttaaaacggtaaaaacccgtaccccgggtaccccgttacgggaacggtaccgtaccccgtaagtaacccgtttaacgttcccgttaccgttacggtcccttaacccgtaacggtaccgtaaccggtaaacggtaaaccgtaaaccgtacgtttacccgttttaccgtaacgtaaaccccgttaaccgttaccggttaacccggggtacggggtcccgttaacccggggtaaacggggttaaccgggtaaaaaccggggttacggtaacggggttaacccggtaacgttaccggttaaaacccggtttttaactttaaccggggtttaaacccccggtttaaaccccggttaaccccccgggggtaaacccgttaaaaccccgggtttaacccggggttaaaccctttaaaccccccgggttttaaaacccggtttttccggggttttttaacccggggggttttaccccggggttttaacccgggggggaaaccgggtttaaaacccgggggggtaacccgttaaaccggggtttaaccccggttaccccgggggtttaaaccccccgggtttaaaacggtttaaccccgggtttaaaccccggtaaaacccccggggttttaaccccggggtaaaccccggggttttcccgttttaccccccccccgggggtttaccccccggtttacccgggggtttaaaccccctttacccccggtttttcccccccggggttttaaacccccccccgggg

SEQ ID NO: 9456 - DNA, 515 bp, Homo sapiens
  misc_feature: GYAE6OF01EOFMQ.10.43.D10.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (492)..(492): a, c, t, g, unknown or other
  misc_feature (492)..(492): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcncctacgtagcctggtaccaacagaaacctggccaggctcccaggcccctnatctatggtgcatccaacagggccactggcatcccagccaggttcagtggcagtgggtctgggacagacttcactctcaccatcatcagcctggagcctagaagatgttgctagtttattactgtacaactatcgtacgagtcggccgtccggggcctacgttccggcccgtgggaccaaggtgatatacgaaacgactggngctgcactatctntcttcntccg

SEQ ID NO: 9457 - DNA, 550 bp, Homo sapiens
  misc_feature: GYAE6OF01EVMUT.10.43.D10.1.454.CMB.1.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctagtagcctggtaccaacagaaacctggccaggctcccaggcccctnatctatggtgcatccaacagggcccacgtggcatcccagcctaggttcagtggcaggtgggtctgggacagacttcgactctcaccatcatcagcctggancctagaagntgttgctagtttatactgtcagctagtataatgactcggcccgtgtacggttcggaccgaaggggaccgagggtaggtaaacttacgaaaacggtaacgtggtgggccttacggacctaaccgtagttccgtagttcctttcacgttccccg

SEQ ID NO: 9458 - DNA, 517 bp, Homo sapiens
  misc_feature: GYAE6OF01CFSKP.10.43.D10.1.454.CMB.1.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (482)..(482): a, c, t, g, unknown or other
  misc_feature (482)..(482): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctacgtagcctggtaccaacagaaacctggccaggctcccaggcccctnatctatggtgcatccaacngggccactggcatcccagccaggttcagtggcaggtgggtctgggacagacttcactctcaccatcatcagcctggacgcctagaagatgttgctagtttattactgtacaactatcgtaccgtagtcggccgtccggggtcctacgttccggcccgtgggaccaaggtgatanacgaacgactgaggcngcactntctntctntctcc

SEQ ID NO: 9459 - DNA, 615 bp, Homo sapiens
  misc_feature: GYAE6OF01A85F4.10.43.D10.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaancgccacctctcctgcagggccagtcagagtgtggcncctagnctggaccacagaactggccaggctccaggccctnactctatggtcgcactccaacgcgggccactggcactcccagcctaggttcagtggctaggtgggtctagggacacgtacttcgacttctccaactactacacttcagccgtaggacgtcctaggaagtattacggttgtacgtagtttacttacgtagttacaactagttaccgtaccggtacgtcgggacccggttcccgggggtacctaccggtttccgggtcccgttacgggaccgtaaacggtcggtaacttaacgtaaccgtaaacgtacgttacggtcgggtacctacggaccacccgtagttaccttagttaccttcctagttccccg

SEQ ID NO: 9460 - DNA, 667 bp, Homo sapiens
  misc_feature: GYAE6OF01DTX0N.10.43.D10.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagaccctacaccggagagattgtgttgacacagtctccagccacctgtctttgtctccgaggggaaangaccaccctctcctgcagggccagtcagagtgtgcgcctagagcctggaccaacagaaacctggccaggcctcccgaggcccctgatctatgggtcncatcccaacgagggcccagtcggacctactccccgagcccgaaggttccaggtcggctaggtggggtcctggggaacaggtaccttcaacgttctaccaaccatcataccacggtcctgggacgtcctaggaaacgtgttgttcggtacttaagttttacttaacgttcgtacctaacgtacgttaccggtaaccggtggttaccgggtccccggttacccgggggtacccttaaccggttttcccgggacccgttacggggaacccgtaaagggttacggaacttacgtaaccgaaacggtaacgttgggtacggcgttcggacccaaccgtacgtacgttaggttccttcgtacgttacccccg

SEQ ID NO: 9461 - DNA, 617 bp, Homo sapiens
  misc_feature: GYAE6OF01BBDUA.10.43.D10.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
  modified_base (403)..(403): a, c, t, g, unknown or other
  misc_feature (403)..(403): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgcccaccctctcctgcagggccagtcagagtgttggcncctacgtagcctggtaccaacagaaacctggccaggcctcccaggcccctnatctatggtgcatcccaacgacgggccacgtggcactcccagccaggttcaggtggacaggtgggtctgggacaggtaccttcactctcaaccatcatcagcctggacncctagaagtattgttagcttaagtttacttacttgtacaactacgtaccgtacgagttcggacccgtccggggcctacgtttcccggaccgttacgggaacctaaaggtgggtaacttacgtaaccgtaaaacggtaaccgttaggtacggtccgtacggaccctaaacccgtacgtttcccgtttaggttccctttaccgtacgtttcccccg

SEQ ID NO: 9462 - DNA, 808 bp, Homo sapiens
  misc_feature: GYAE6OF01ADKU2.10.43.D10.1.454.CMB.1.raw
  modified_base (233)..(233): a, c, t, g, unknown or other
  misc_feature (233)..(233): n is a, c, g, or t
  modified_base (297)..(297): a, c, t, g, unknown or other
  misc_feature (297)..(297): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagngtgtggcgcctacgtagcctggtaccaacagaacctcggccaggcctacccgacggccccctanactcctagtcggtcgcactaccgaaacgacggggcccacgtcgggtaccacgttccccgacgtcccgtacgggtttaccagggtcggggtacgtaaggggttcgggggttacgtacgggggaacctacgggtaaccctttaccgaaccgtttccctacccgaacccctattaccacgttaccgaccggtcccttaggcctaacggttcttaacgggtaaagtttcgtttttacggacctttaagtttttaactttacgttcgttacaacggtacgttaagttaacttaagttcggtttaaacggttttggggttttttaactttaccgtttacccgggtttttacccgggaccccgggtttaacggggtaaacccgtttaaagggtttcggttaaaccgttttaaccggaaacgggtttaaacccggttaacgggttcgggtttaccgggtccttacggaccccgttaaccgtttacgttaccgtttacggtttccctttaccgttacccg

SEQ ID NO: 9463 - DNA, 610 bp, Homo sapiens
  misc_feature: GYAE6OF01C4V3W.10.43.D10.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (367)..(367): a, c, t, g, unknown or other
  misc_feature (367)..(367): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagcccacctgtctttgtctccaggggaaanagccaccctctcctgcagggccagtcagactatagtacaaacttggcctggtaccagcataaactggccaggctcccagctcctcatccatggtncatcctccagggccactaatactcccagccaggttcagtgcaggtgggtcggggtcaggtgttcacgtcncacatcagcagcctgcagtctagaagttatttgactagtttattactgtacagtcatagtgtaacgttaccgtcggtacccttccggttaacttaccggtttttaccggggacccgggggtaaccgtaaacgggtccgttaagggaaacgttaccgaaaacgggtccggtaaacttaggggtcggtaccggttcggaaccctaacccgtaacgtttccgttcggttaccctttccgtaacccg

SEQ ID NO: 9464 - DNA, 579 bp, Homo sapiens
  misc_feature: GYAE6OF01E3J1J.10.43.D10.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagatttgtgttgacacagtctccagccaccctgtctttgtctccaggggaaangccaccctctcctgcagggccagtcagagtgttggcgcctacgtagcctggtaccaacagaaacctggccaggcctcccaggcccctnatctatggtgcactccaacgacgggcccacgtggccactccccagcctaggttcaggtcggcaggtcgggtctgggacagtcttcactctcacatcatcacgccgtggacgccgtagaagtattggttgtcgttagtttattacttcgtactaactacgttaccgtacgtcggtcgggtcccggtcccggggtccctaccgtttccggcccgttacgggacctaacggtggactacgtacgaaacgtacgtaggtcggctgccacgtactctagtcttcgtcttcccg

SEQ ID NO: 9465 - DNA, 501 bp, Homo sapiens
  misc_feature: GYAE6OF01ANFBL.10.43.D10.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
  modified_base (421)..(421): a, c, t, g, unknown or other
  misc_feature (421)..(421): n is a, c, g, or t
  modified_base (469)..(469): a, c, t, g, unknown or other
  misc_feature (469)..(469): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (496)..(497): a, c, t, g, unknown or other
  misc_feature (496)..(497): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagagtgttggcgcctacgtagcctggtaccaacagaaacctggccaggctcccaggcccctcatctatggtgcatccaacngggccacgtggcatcccagccaggttcagtggcagtgggtctgggacagtacttcactctcacatcatcagctggagcctagaagtatgtgactagtttattactgtacaactntcgtacgagtcggccgtccgggctacgttcggcctggacaagtgatanacaacgactgngctgcacntctntctnntccg

SEQ ID NO: 9466 - DNA, 602 bp, Homo sapiens
  misc_feature: GYAE6OF01EAJ5F.10.43.D10.1.454.CMB.1.raw
  modified_base (202)..(202): a, c, t, g, unknown or other
  misc_feature (202)..(202): n is a, c, g, or t
tcagcatagtagtgcacgaccggtgctcgattagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagagtgttggcgcctgcgtagcctggtaccaacagaaacctggccaggcctccaggcccctcactctatggtgccatccaacgacgggcccaacgtcggccactcccagacctaggttcaggtcggcagggtcgggcgtgggacagtaccttcactctcacctagtcatcacgtcccggacgcctagaagtagtgttgactagtttacttacttcgtactaactactacggtaaccgacggtcggtcccggtacccgggggccttaccgtttccgggcccgttacgggaaccgaacggtggaacgtacgtaacgaaaccgtacgttaggtcggtctacggaccaacgtacttctagttccttcgtacttccccg

SEQ ID NO: 9467 - DNA, 769 bp, Homo sapiens
  misc_feature: GYAE6OF01DTG9A.10.43.D10.1.454.CMB.1.raw
  modified_base (201)..(201): a, c, t, g, unknown or other
  misc_feature (201)..(201): n is a, c, g, or t
tcagcatagtagtgcacgaccggtgctcgattagactagcagtaagggggaggaactgctcagttaggacccagagggaaccatggaagccccagctcagcttctcttcctcctgctactctggctcccagtttcagataccaccggagagattgtgttgacacagtctccagccacctgttctttgtctcgaggggaaanagccaccctctcctgcagggccagtcagagtgttggcgcctgcgtagcctaggtaaccaacgaacgaaacccgtgggacccacgggtccctacccgacggcccccttacacttccgttaagtcgggtacgactactaccgaaacggacgggccaacggtcggactacctcccgagcccgtagttccgaaggtcggacgtagggtcgggtcgtggggaacacggtacttaccacgttcctaccgaaccttactccgtaactaccgaacggtcccgtagggtaccgtaccgttaagtaaacggtaatttcggttacggttaaccgtttaaggtttttaacctttaacgttaaccgttacccgtaaaacgtaaccggtttacccgtaaccgggtaacggttcccggggtacccgggttaccccgggggtaccctttacccggttcccgggtaccccggttaggggaaacccgttaaagggtcgggtaaactaaccgttaacgtaaaacccggtacgttgggtacggtaccgtacgaccctacttactcgtttaccgtctttaccgtacccg

SEQ ID NO: 9468 - DNA, 678 bp, Homo sapiens
  misc_feature: GYAE6OF01EH9VK.10.43.D10.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (292)..(292): a, c, t, g, unknown or other
  misc_feature (292)..(292): n is a, c, g, or t
  modified_base (402)..(402): a, c, t, g, unknown or other
  misc_feature (402)..(402): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagactaccaccggagagtattgtgttgacacagtctccagccaccctgtctttgctccgaggggaaancgccaccctctcctgcagggccagtcagngtgttggccnctacgtgcctggtaccaacagaacctggaccaggcctaccacggccctnatctagtcgtgctacaccaacgacgggcccacgtcggacactcccgagccgtacggttcaggtcggcagggttcggcgtacgggacacgtcctacgacctcctacacctntaccacttcgacgtccgtaggaccgcgtacgaagtacgttagttacgtactttaagttttaacttacgttcgttaactaactacgtacccgggttacgaaccgggttccgggtccccgggttaccggggtacccgttacccggttttcccgggacccgttaccggggtaaccgttaaaggttacgggtaacttaaccggtaaacgtaaaccggtaccgttagggtacggtcgtcgtaaccaccttacgtcgttacgttcttccgtacgttaccccg

SEQ ID NO: 9469 - DNA, 757 bp, Homo sapiens
  misc_feature: GYAE6OF01DMEGM.10.43.D10.1.454.CMB.1.raw
  modified_base (206)..(206): a, c, t, g, unknown or other
  misc_feature (206)..(206): n is a, c, g, or t
tcagcatagtagtgcacgaccggtgctcgatttagactagcagtaagggggaggaactgctcagttaggacccagagggaaccatggaagccccagctcagcttctcttcctcctgctactctggcctcccagtttcagactaccgaccggagagattgtgttgacacagtctccagccaccctgttctttgtctccgaagggaanacgcccacctctcctgcgagggccagtcagagtgtggctacgccgtcttagccgtaggtaccacgaactaaaaaccgtggacccacgcccctccgacggtcctcccgtaccgtacgttacgtggttcgacctactaccgaacggaaccgggtacctacgtcggtaacctcccgacgacccgtaggtaccgaggtcggcgtaggggtcgggttacgtcggggaactaacgggtaccgtttccggacttcccgtaccgtaaccctagttaccgacggtactaacggtttccacggtaccgtacgttaccgtaagggttaacgtttacgttttcggttacctttaagtttttacgttaacgtaggtacgtaaaggtaagtttacgtaggtaggttccggtacggttccgtacccggtttaccgttaacgtttcgtttaaccgggaccgtaaaccgggtacttagggtacgaaccttaacgtaaccgtaaagtccggttgggtaccggtactaaccggtaccttaacgttacgttcctttagtccctttaacccg

SEQ ID NO: 9470 - DNA, 828 bp, Homo sapiens
  misc_feature: GYAE6OF01C2211.10.43.D10.1.454.CMB.1.raw
  modified_base (190)..(190): a, c, t, g, unknown or other
  misc_feature (190)..(190): n is a, c, g, or t
  modified_base (474)..(474): a, c, t, g, unknown or other
  misc_feature (474)..(474): n is a, c, g, or t
tcagcatagtagtgcacgaccggtgctcgatttagactagcagtaagggggaggaactgctcagttaggacccagagggaaccatggaagccccagctcagcttctcttcctctgctactctgctcccaggtaccacggagagattgtgttgacgctattccgccacgccctacccttgttcctttttcnccgaggggacagacgtccacccttctcctgtacgggcctagtttacgtgggttgttcggccgtactttaagttttaaaaccgtcggttaaaccaaacgaaggtaaaccggtcggaccagggtcctacccgaggtcctcctacatcctaaacggaagccaacgtacccaaccgacgggcccctacgtcggaccgtccccagtcccgtaaggtttccgagttgggctacgggttgggtacgtcggggactaacggtacctttaccgaccttcctacccgaaacctntaccgaacggtccaacggtccgttaagggaccggtaccttagggaaacgttacgttaagttcggttacctttaagttttaagttaagtttcgtacgacgtacgtacggtacggtacggtacgtacgggttccggtttacccttttacggttacccggttttaccggggaaccccgggttaaaccggtaaacgggtttaacgggtaaaccgtaaccggtaaaacgttaccggtacggttaccggtacgttaccgtaccgtaacccgtacgtttcccgttacggttaccctttaccgtaccctttcccgttaccccggtaccttacttaccgttaccgtaacccttacgttaaccg

SEQ ID NO: 9471 - DNA, 841 bp, Homo sapiens
  misc_feature: GYAE6OF01BP60I.10.43.D10.1.454.CMB.1.raw
  modified_base (203)..(203): a, c, t, g, unknown or other
  misc_feature (203)..(203): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaancgccaccctctcctgcagggccagtcagacgtggttcggcgtcctacgtagcctggtaaccaacgacgaaaccctggaccctacggcctacccgacgggtccccctacgactcgttagtcgggtcgccaactacccgaaaccgacggggcccaacgttcgggacctaccgtccccgaacggtacccgtaacgggtttaccgaacgggttcggggaccgaaggggtttcgggggtcgttacgggggaacctaacggtaacctttccgaacccttccgttacccaaccctaagttaccgaaacgttcccgaacggtcccgttaggggaccgtacccgttaagggtaaacggtaagtttcggtttacggaccgtttaagtttttaacgtttaaccgttagttaacctaacgtacgttaccggttaacccggtacgggttcccgggtccccgggttacccgggggtaccccttaacccgggttttcccgggccccgggttaaccggggtaacccgtaaacgggttacggaaaccgtttaactaaccggtaaaaccggtaccggtttaggtaccgggtaccgtacggtacccgaacccgttacgttaccgtttaccgttacctttccgtacgtttacccccgg

SEQ ID NO: 9472 - DNA, 609 bp, Homo sapiens
  misc_feature: GYAE6OF01C3NFI.10.43.D10.1.454.CMB.1.raw
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (410)..(410): a, c, t, g, unknown or other
  misc_feature (410)..(410): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctagtagcctggaccaanagaaacctggccaggctcccgaggcccctnactctatggtgcatcccaacacgggccacgtggcactccccgagccagggttccagtcggcgtaggtgggtctgggacagtacttcacgtctacaccatcatcagcctgacgctagaagtntgttacgctagttttacttacgttgtacctaactacgttaccggtaccgtagggttccggtccccgggttacccgggggaccctttaccggtttcccgggcccggttacggggacccgtaaagggtcgtaaagtacgtaccgaaaaccggacttagggtcgcgtacgaccacctacttcgttatcctcgttcttccccg

SEQ ID NO: 9473 - DNA, 607 bp, Homo sapiens
  misc_feature: GYAE6OF01CZR02.10.43.D10.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
tcagcatagtagtgcacgaccggtgctcgatttagactagcagtaagggggaggaactgctcagttaggacccagagggaaccatggaagcccagctcagcttctcttcctcctgctactctggctccagtttcagactaccaccggagagattgtgttgacacagtctccagccacctgtctttgtctccgaaggggaaanacgccacctctcctgcagggccagtcagagtgttggcncctagtacgcctggaacaacagaaacctggaccacggcctcccacggcccctnactctagtggtcgacctactaccgaacgacgggacctacgtggccactcccgagcctaggttcaggtcgcgtaggtggtacgnggacagtactcactctacacatcatcagcngacncgtagaagtntgtagacttagtttacgtactagtactaactacgtacggtacgaggttaccggtccggtacccgggggtacccttacggtttcccgggccgttaacgggacctaaaggtcggtaactacgtaacgaaacgtaacgtcggtacggtacctcgaacgacctacgttacttattaccgttctacttcccg

SEQ ID NO: 9474 - DNA, 598 bp, Homo sapiens
  misc_feature: GYAE6OF01DHLJZ.10.43.D10.1.454.CMB.1.raw
  modified_base (202)..(202): a, c, t, g, unknown or other
  misc_feature (202)..(202): n is a, c, g, or t
  modified_base (423)..(423): a, c, t, g, unknown or other
  misc_feature (423)..(423): n is a, c, g, or t
  modified_base (554)..(554): a, c, t, g, unknown or other
  misc_feature (554)..(554): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccacggagagattgtgttgacacagtctccagccaccctgtctttgtctccgaggggaaanacgcccaccctctcctgcaggggcctagtcagagtgttggcgcctaggagcctggtaccaacagaaacctggccaaggcctcccgacggcccctcatctagtgggtgccatcccaacgacgggccacgtggccactcccagccagggtttcaggtcggcgtaggtcgggtcgtggggacagtacctcactctcacatcatcagcctggacgcgtagaagtntcgttgacgttatttacttactcgtacaactcgtacgtaccggtaggtcccggtccggtcccggggtcctaccgtttcccggaccgtacgggaccgtaaagtcgggaactacgtacgaaacgtacgttggnggtctcggacaccgtacgttctaggtttcctcgtctttccccgg

SEQ ID NO: 9475 - DNA, 744 bp, Homo sapiens
  misc_feature: GYAE6OF01COYDH.10.43.D10.1.454.CMB.1.raw
  modified_base (202)..(202): a, c, t, g, unknown or other
  misc_feature (202)..(202): n is a, c, g, or t
  modified_base (458)..(458): a, c, t, g, unknown or other
  misc_feature (458)..(458): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagactaccaccggagagattgtgttgacacagtctccagcccacctgtcttgtctccgaggggaanacgccacctctcctgcacgggccagtcaggagtgtcggccgcctacggtagccgtacggtaaccaacgaacgaaacctcgggaccaagggtcctacccgaccgtcccctacgacttcgtagtcggtcgacctacgtccgacggaccgacgggcccaagtcggaccacgtcccaacggactacggttcgaaggtcggccgtagggtcggggtacgtaggggaacctaggtaccttcgaacctcgttaccacccgtanacgacgtacgacgtacgtacggagtacgtaggtaaacgtttagttacgagttaagttacgttaactttacgtagtacgtacgtacgtaacggttcggtccggtcccggtacccggtaccggtaccgttacgggtacgggtttaccggggaacgggtaacggtaaccggttaaggggttacggaaacgtaacggttaaaccggtaaaaggttaaccggttacgggtaccgggtacgtaccggtaaccgttaaccggtttagttaccgtttacgtttacccgttaccg

SEQ ID NO: 9476 - DNA, 765 bp, Homo sapiens
  misc_feature: GYAE6OF01BD6C1.10.43.D10.1.454.CMB.1.raw
  modified_base (205)..(205): a, c, t, g, unknown or other
  misc_feature (205)..(205): n is a, c, g, or t
  modified_base (316)..(316): a, c, t, g, unknown or other
  misc_feature (316)..(316): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagtattgtgttgacacagtctccagccctacctgtctttgtctccgaggggaaancgccacctctcctgcagggccagtcagagtgtggcgctacgtacgcctaggtaccaacgaacgaaacctggaccaggccctcccgacggcccctacacttctatcgggtcnccgtactaccgaacgacgggccacgtcggacctactaccccgagccgtacggtttcgacggtcggacgtagggttcgggtcgtacggggactacggtacttcaccgttcacctaaccatacctactccgaacgtccgtaggtaccgaccgtagtaacggtagttcggttacggtactttaacgttttagttacgtacgtaacttaaccggacgtttacccggtaaccggttaacgggttcccggacccgggttaaccccgggggtcccttaacccgggttttcccgggtaccccggtttacggggaacccttaaacggggtcggtaaccgtttaagtaaacccggtaaaccggtaaacggttccgggtaagggtcccgtttaccggaaacccttaccggtaacgtttacccggttagtttacccttaaccgttcccgttttaacccccg

SEQ ID NO: 9477 - DNA, 906 bp, Homo sapiens
  misc_feature: GYAE6OF01D9UNW.10.43.D10.1.454.CMB.1.raw
  modified_base (203)..(203): a, c, t, g, unknown or other
  misc_feature (203)..(203): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccacggagagtattgtgttgacacagtctccagcccacctgttctttgtctaccgagggaancgccaccctctccgtgcgacgggccagtcaggtagttggttcggccgtccgtacggtacgccgttacggtaacccaaacgaacggaaaccctcgggacccgtaacgggtccccttaccccgaaccggtccccccttacgtactttaccgtaagttcggggtcaccgtaaccgttacccgaaacggccggggtaccctaaccggtcgggacctacgttacccccgaggtaccccgttagggtttacccgaaggtcgggtaccgtagggggttacggggttaccgtacgggggaacctacggttaacccgttaccctaaccgtttaccctacccgtaaacccgtattacccgtaacgttacccgaacggtcccggttacgggaaccgtaccgttaagggtaaacgttacgttacggttacgtaacgtttagttttaaccgttacgttacggttaaccaaccgttacgttacccggtacggtacggttacccgggtaccccgggttacccgggggtacccttacccggggtttaccccgggtaacccggttacgggaaacccggttaaacgggttaccggtaaaacgttaaccgtaaacccgggtaaaaccgttaccgggtttagggtaccggttacccgtaccgtaaccctacccgttaacgtttccgttacccggtttcctttaacccgccgttttaccccccg

SEQ ID NO: 9478 - DNA, 851 bp, Homo sapiens
  misc_feature: GYAE6OF01D2Z2E.10.43.D10.1.454.CMB.1.raw
tcagcatagtagtgcacgaccggtgctcgatttagactagcagtaagggggaggaactgctcagttaggacccagagggaaccatggaagccccagctcagcttctcttcctctgctactctggcctccctagtttcagactaccgaccggagagtagttgtgttgacactagtcctccacgccctacccttgttcttttcgtcctaccggaaggggtaaaacgccgacccctacccttcctccgtggaccgacggggaccctaaggtacgaagggtacggttcggtttaccggggcccgtacccgttaaccgggtacgtacccgttacgggtaaacccaaacgaacgtaaacccgtcggacccgtacggccctacccgaccgtcccctacacgttctaggtcggtacaccgtaacctacccgaacggtacgggaccctaccggtggaccctaaccgtaccccgacgtacccggtaggttccgaggtcgggacgtacggggttcggggtacgtacgggtaactacgttaccttacccgtacttcccgtacctaaaccgtcttaccgtacgtcgaacggtccggacggtacgtacgtaggtaagttcttggtacttagttacttttacgtacgtcgtaactaacgtcgtaccggtacgtacggttcccgggtacccgggttcccgggtaccttacccgggttcccggtacccggtaacgggaaccgtaaagggttacgtaaccgttaaccggtaaaccgaaaccggttacggttagggtaccggtcgttaacggaaccccttccggtaactttcggttaacccttttccgttaccgttaccgtttaccccgg

SEQ ID NO: 9479 - DNA, 939 bp, Homo sapiens
  misc_feature: GYAE6OF01DBGKY.10.43.D10.1.454.CMB.1.raw
  modified_base (206)..(206): a, c, t, g, unknown or other
  misc_feature (206)..(206): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagactaccaccggagagattgtgttgacacagtctccagcccacctgttctttgtctaccgaggggaaancgcccaccctctcctgcgagggccagtcagtggtgttcggccgccttacggacgccgtacggtaaccaaacgaacgtaaacccgtggacccgtacggccctaccccgaaccggtcccccctacgacttccgtagtcgggtacgacctaactacccgaaacggaccgggaccctaacggtcgggacctaccgtaccccgaacggtcccgtaacgggtttacgacgggttcggtacggtacggggttcgggggtaccggttacgggggtaaaccgtaacggttaaccctttaccctaacccgtttaccccttaacccgaaaccccgtacttaacccgaacgtttacccgaacgggttccccggtacgggaaccgttaccccggtaaagggtaaaacgtttcgtttacgggtttacggtaaccgtttttaacggtttttaaccgtttaaccgtttacgtaacccgttaaaccgtttaccggtttaacccggggttaacccgggtacgggtttaccccggggtacccccggggttaccccggggggtttacccccttaccggggttttacccccgggacccgggttaaccgggggtaaccgttaaacgggttaaccgggtaaacgttaaaccgtaacccggtaaaaccggtaacggtttacgggttcgggtaccgttaccgacccgtaacccgttacgtttccgttacgtttacccttacgttccccgtttaccccg

SEQ ID NO: 9480 - DNA, 635 bp, Homo sapiens
  misc_feature: GYAE6OF01BSF49.10.43.D10.1.454.CMB.1.raw
  modified_base (202)..(202): a, c, t, g, unknown or other
  misc_feature (202)..(202): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaancgccaccctctcctgcagggccagtcagagtgttcggcgcctacgtagcctggtaaccaacacgaaacctggaccacggcctcccgacggccccctcactctatcggtgcacgtccaacgacgggcccacgtcggccactccccgagcccgtaggttccgacggtcggcgagggtcgggtcgtgggacacgtacttcactctacaccatcatcacgtcctggacgctaggaagtagttgtacgtcgttagtttacttactcgtactaacgtacgttacggtaccgtcggtccggtcccggtcccggggtacccttccggtttccggcccgtacgggaacctaacggtcggtaactacgtaccgtaaacggtacgttgggtcggtctacgtaccgaccgtacttaccgttcgttaccttccgtacgtttccccg

SEQ ID NO: 9481 - DNA, 567 bp, Homo sapiens
  misc_feature: GYAE6OF01A2NPF.10.43.D10.1.454.CMB.1.raw
  modified_base (554)..(554): a, c, t, g, unknown or other
  misc_feature (554)..(554): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaagagcccaccctctcctgcagggccagtcagagtgttggcgcctacgtagcctggtacccaacacgaaacctggaccaggctcccgaaggcccctcatctatggtgcatccaacgcggccacgtggcactcccagcccaggttccagtcgggcaggtgggtactgggacacgtacgttcactcgtacaaccatcatccgacgtccgtggacgcctagaagtatgttcgactagtttactcttgtacaactactcgtacgtacgtcgtccggtcccgggcctacggtttccgtaccgtcgggaccaagtcggtactacgtaccaaagtaccgtgtggcacgtcacgtactacctntctcgtcttcccg

SEQ ID NO: 9482 - DNA, 881 bp, Homo sapiens
  misc_feature: GYAE6OF01C2JCB.10.43.D10.1.454.CMB.1.raw
  modified_base (117)..(117): a, c, t, g, unknown or other
  misc_feature (117)..(117): n is a, c, g, or t
tcagcatagtagtgcacgaccggtgctcgatttagactagcagtaagggggaggaactgctcagttaggacccagagggaaccatggaagccccagctcagtcttctcttcctcctnctactctcggctccctagtttcagactaccgaccggagagtattgttgttagaccacgtacgttcctaccacgcccctacccttgttcgttttcgtacctaccggaacggggaaacgccgaccctaccctcctccgtgccggacgggacctagtcgaggtaggttcggttcggaccgtaccgttacggtaccgccgttacggtaaccaaacgtaacgaaaccgtcggaccgacggtccctaccccgaccggtccctactactcgtagttcggtacgacctacgtaccgaaccggtacgggcctaacggtcgaccgtacctaccccgacgtaccggttacgtaccggtacggtacggacggtacgggttcggggtacggtacggggaaccttacggttacccttaccgtacccttaccgtacctaaccgtaccgtactaccgtaccggtacggttaccgtacgggtaaccacggttaacggaacgtttagttacgttccggtttaacttttacgttttacgttaccgttacgttaacctacccggtaacgttccccgggtaaggttccgggtcccgggttacccggggtaccccgggttccctttacgggtttaccccgggacccgggttaaccgggtacggttaacgggttaaccgttacgtaaaccgttaaccgaacggtttaccggcgggttaacctcgtaccgttaaccctaccgttaccgtttactacccgttttacccgttcccttcggtttacccccc

SEQ ID NO: 9483 - DNA, 752 bp, Homo sapiens
  misc_feature: GYAE6OF01DZEP9.10.43.D10.1.454.CMB.1.raw
  modified_base (389)..(389): a, c, t, g, unknown or other
  misc_feature (389)..(389): n is a, c, g, or t
  modified_base (731)..(731): a, c, t, g, unknown or other
  misc_feature (731)..(731): n is a, c, g, or t
tcagcatagtagtgcacgaccggtgctcgatttagactagcagtaagggggaggaactgctcagttaggacccagagggaaccatggaagcccagctcagcttctcttcctcctgctactctgctcctagtttcagactaccgaccggagagtatttggtgttgacacgagtcctccacgccaccttgttctttgtctaccggaaggggaacacgcccaccctctcgtgcgacggccagtcagtaggttgttcggccgtaccgtacgtacgccgttacggtaaccaaacgtaacgaaaccgtcggacctacggcccttacccgaccggtccctactactacgttagtcggtcactacgtaccgaacgcgggacccacgtcggactaccncccgaacggccgttaggtacagggtcggacgtagggtttcgggtacgtacgggtaactacggttaccttaccacttacccgtaacctaaccgtactacgaccgtaccgtaccggttcgacggtacgtaaccgtaggttaaacgttgttcgtacgttaacgtttaacgttttataccgttaacggtacttaaaccggtcgtttaaccggcggttcggtccgggtaccccgggttcgggtcctttaccgggttacccggtacgtaaacgggttacgtaagggacgttaacgaccgttaaacgacggtacgttgcggtacccgataaccccgtattagtccgttntaccttccggttacttccccg

SEQ ID NO: 9484 - DNA, 541 bp, Homo sapiens
  misc_feature: GYAE6OF01EZLWI.10.43.D10.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (424)..(424): a, c, t, g, unknown or other
  misc_feature (424)..(424): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccgggagagattgtgttgacacagtctccagcccaccctgtctttgctccaggggaaangccaccctctacctgcagggccagtcagagtgttggcncctacgagcctggtaccaacagaaacctggccacggctcccgaggcccctnactctatcggtgcatccaacacgggacccactggacactcccgagccgtaggtcaggtgacgagtgggtctggacagtactcactctacacatcatcagcctagcncgtgaagntgtgtactagttatcgtntacaatactacgtacgagtcggaccgtccgggcctacgtttccggcctcggacaaggtggtatacgacgtaagactcggtagcgtacgccactacttacgtnttactncgttacccg

SEQ ID NO: 9485 - DNA, 951 bp, Homo sapiens
  misc_feature: GYAE6OF01BEBVF.10.43.D10.1.454.CMB.1.raw
tcagcatagtagtgcacgaccggtgctcgatttagactagcagtaagggggaggaactgctcagttaggacccagagggaaccatggaagccccagctcagcttctcttcctcctgctactctcggcctcccagtttcagactaccaccggagagtattgtgttagaccacacgtcctccgacgcccacccttgttctttcgtccgtaccggaaggggaaacgccgacccctaccctccgtccgtgaccgacggaccgacgtacgaggtacggttcggttcgggccgtaccgttacggtacgtcccgttaacggtaacccaaacggtaacggaaacccgtcggaccgacggtcccgtaccccgaccggtcccctataccgttactaggtcggtacaccgtacctaaccgaaccgaccgggacctacggtaccggcaccgtaccccgacggtacccggtaggtttacgacggttcgggaccggttagggtacggggtaccgggtacgggaaccgtacggtaaccttaccgtaaccctacctaccgaaccctacgtaccctacgtaccgtaccggtacccgtacggaccgtacgtaacggtaacggttacgtttagggttaccgttaacggttttaacgttttaaaccgtttacggtttacgtaaccccgttaacgttaacccggtttacccgggtaaccgggttacccggggttacccgggtaaccccccggggttacccggggtacccccggttttacccgggttaccccggggtaccccgggttaaccggggtaaacccgttaacggggttaaccgtaaccggttaaaccggttaaacccggttaaacgggtaccggttagggtacccgggttacgtaacccgtaaccggttacccgtaacgtttccggtttaacccgtttccgtttacccgttacccgtttaccccccg

SEQ ID NO: 9486 - DNA, 734 bp, Homo sapiens
  misc_feature: GYAE6OF01BJM5B.10.43.D10.1.454.CMB.1.raw
  modified_base (169)..(169): a, c, t, g, unknown or other
  misc_feature (169)..(169): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (329)..(329): a, c, t, g, unknown or other
  misc_feature (329)..(329): n is a, c, g, or t
  modified_base (467)..(467): a, c, t, g, unknown or other
  misc_feature (467)..(467): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
  modified_base (529)..(529): a, c, t, g, unknown or other
  misc_feature (529)..(529): n is a, c, g, or t
  modified_base (555)..(555): a, c, t, g, unknown or other
  misc_feature (555)..(555): n is a, c, g, or t
tcagcatagtagtgcacgaccggtgctcgatttagactagcagtaagggggaggaactgctcagttaggacccagagggaaccatggaagccccagctcagcttctctcctctgctactctgcctccagtttcagataccacggagagattgtgttgaacacagttccnccagccaccttgttctttgcctacgaaggggaanacgcccaacctctccncgcgaacggccaagtcaagtgtgtcggcacctagtagcctaggtaaccaacgacgtaaacgcggaccacggtcctacccgacggacccctctattaccgtagttggtacnctaacgtacccgaaacggacgggacctaagttcgggacctaacgtccccgaaagtcccgtaaagggttcaacggtgggaccgtaaggggttcggtaccggtaagggaacacggtacctttacacttccaacaacctanacgactcgacgtccgtggacgacgtagtaagtnttaacggtnacgtttaattacttaacgtntaaccgaacttaccgtacgtaacggngttaccgggacccggttccggggaccttaccgggttaccggtaccgacgggtaaacgtaacggtgttaactaaacgtaaacccgttaaagggacctttagggttacggaacctacggttaacccacgtaaacccggttttataccccggtttaacttacccgacggttttaaccccccc

SEQ ID NO: 9487 - DNA, 799 bp, Homo sapiens
  misc_feature: GYAE6OF01EPIBM.10.43.D10.1.454.CMB.1.raw
  modified_base (203)..(203): a, c, t, g, unknown or other
  misc_feature (203)..(203): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagagtgttcggcgccgtacgtagccgtggtaaccaacaacgaaaccgtcggaccgacggcctacccgacggccccctagactactagttggtcgacaactaccgaaacggacgggcctaaccgtcgggacctacgtaccccgaaggtaccccgtaagggtttacgacgggttacggacgtaaggggttcggggtacgttacggggaacctacggtaaccgtttccgtaaccttccgtacctaacccgtattacccgtaattacccgacggtcccgttacgggtaaccgtcccggtaaggtaaacgtagtttacggtttacggacctttaaggttttaactttaccgttacgtaacctaaaccgttacgttacccgggtaaccggtacggttcccgggtaccccgggttacccggggtacccctttaccggtttcccgggacccgttacggggaaaccgttaaggtacggaacttaaccgaaccgtaaaaccggtacggttacggtacggtcctaccggtaccctaccgttaacgttccgttaccgtttcttaccgtacccgtttacccccg

SEQ ID NO: 9488 - DNA, 561 bp, Homo sapiens
  misc_feature: GYAE6OF01EJ58N.10.43.D10.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (411)..(411): a, c, t, g, unknown or other
  misc_feature (411)..(411): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccacggagagattgtgttgacacagtctccagccctaccctgtctttgtctccgaggggaaanagccaccctntcctgcagggccagtcagngtgttcggcnctacgtagcctggtaaccaacagaaacctggccaggctcccaggcccctnactctatggtgcatccaanagggccacgtggcatcccagccaggttcagtgacagtgggtctgggacagtactcaacgtctcgaccatcatcagcctaggacgcctagaagtatgttnctagtttattactgtcaactagtacgtaccgtgtcggtacccggtcccgggggcctacgtttcccggcccgttaggggaccctaaaggtcgaattacgacgaaacgtaactggtacgtctacgaccacgtattctagtcttcacttcccg

SEQ ID NO: 9489 - DNA, 746 bp, Homo sapiens
  misc_feature: GYAE6OF01ATNUU.10.43.D10.1.454.CMB.1.raw
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
tcagcatagtagtgcacgaccggtgctcgatttagactagcagtaagggggaggaactgctcagttaggacccagaggaaccatggaagccccagctcagcttctcttcctcctgctactctggctcccagtttcagataccaccggagagattggtgttgacacagtctccagcccaccctgttctttgtctcgaggggaancgccctacctcgtccngcaggccagtcagngtgttggcgtccttactagcctagaaccacgagaacctggaccacggctacccgagtcctacctcatacctacgacgtcatcccgacgacgggccacgtccggccgtcccagaccgtacggttacgagtcggtacgtggtcggggtacgtacgggaccgtaagtaccgtttacgacttacccgttaccacccttaactaccgaaggtaccgtaccgcccggttacgggaacgtacccgtaggtaaaggtactttaagttcgggttaaaccgttagtttttaactttacggttttcggacttacgggaaccttaccgggttcgaacgttcggtaaccggggtttcttacccggttttacgtacccgggttttacccggggaaccccgggtttacgaaacggttaccgtaaaacgtaccgggtaaaaccgtacggtacgggtaccggtacgtaccggtacccaaccgtagtttcgtaacctttcctaccgtacctttccccggtaccccgtaccg

SEQ ID NO: 9490 - DNA, 253 bp, Homo sapiens
  misc_feature: GYAE6OF02GLLDO.10.43.D10.1.454.CMB.1.raw
  modified_base (253)..(253): a, c, t, g, unknown or other
  misc_feature (253)..(253): n is a, c, g, or t
tcagcatagtagtgcacgaccggtgctcgatttagactagcagtaagggggacagacttcactctcaccatcatcagcctggagcctgaagatgttgcagtttattactgtcaacatcgtaccgagtggcctccggggccactttcggccctgggaccaaagtggatatcaaacgaactgtggctgcaccatctgtcttcatcttcccgccatctgacactactatgctgagcgggctggcaaggcgcatagn

SEQ ID NO: 9491 - DNA, 529 bp, Homo sapiens
  misc_feature: GYAE6OF02IGX22.10.43.D10.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaangccacctctcctgcagggccagtcagagtgttggcgcctacgtagcctggtaccaacagaaacctggccaggcctcccaggcccctnatctatggtgcatccaacagggccactggcatcccagccaggttcagtggcaggtgggtctgggacaggacttcactctcaccatcatcagcctggacgcctagaagtatgttgctagtttattacttgtactaactatcgtaccgagtcggtccgtcccggggcctacgttccggcccgtacgggaccaagtcgatacgtacaacggtaactgtggctgcaccatctgtcttcattcc

SEQ ID NO: 9492 - DNA, 520 bp, Homo sapiens
  misc_feature: GYAE6OF02GBF7J.10.43.D10.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaacagaaacctggccaggctcccaggcccctnatctatggtgcatccaacngggccactggcatcccagccaggttcagtggcagtgggtctgggacagacttcactctcaccatcagcagactggagcctagaagtattttgctagtgtattactgtcagcagtatggtcgcccggcggctcgtacgtttcggcggacgggaccgtaagggttgagactacgaaacgtaactggtcggcgtgcaccatctcgttcttctac

SEQ ID NO: 9493 - DNA, 525 bp, Homo sapiens
  misc_feature: GYAE6OF02GHU83.10.43.D10.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctacgtagcctggtaccaacagaaacctggccaggctcccaggcccctnatctatggtgcatccaacagggccactggcatcccagccaggttcagtgcagtgggtctgggacagacttcactctcaccatcatcacgcctggacgctggaagatgttgctagtttattactgtacaacatcgtacgagtcggtccgtccggggtcctacgtttccggcccgttcgggacctaaaggtcgatacgtacgaacgtactaggtgctgcacatctgtcttcattccc

SEQ ID NO: 9494 - DNA, 586 bp, Homo sapiens
  misc_feature: GYAE6OF02F019N.10.43.D10.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcgcctagtagcctggtaccaacagaaacctggccaggcctcccaggcccctnatctatggtgcatccaacgacgggccacgtggaccactccccagccctaggttcaggtggcaggtgggtcngggacagtacttcactctcaccatcatcacgcctggacgcctgaagattgttgactagtttattacgtgttacaactactcgtaccgaggtcggacccggtcccggggtcctacgttccggacccgtacgggaaccgtaaaggtcggaacttacgtacgaaacggtaacgttaggtacggtcgtacgaccgtacctacgttcgttacgttccttactacttcccg

SEQ ID NO: 9495 - DNA, 509 bp, Homo sapiens
  misc_feature: GYAE6OF02FMVGS.10.43.D10.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
  modified_base (508)..(508): a, c, t, g, unknown or other
  misc_feature (508)..(508): n is a, c, g, or t
tcagcatagtagtgcacgaccggtgctcgattagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctntcctgcagggccagtcagagtgttggcgcctgcgtagcctggtaccaacagaaacctggccaggctcccaggccccctcatctatggtgcatccaacagggccactggcatcccagccaggttcagtggcaggtgggtctgggacaggacttcactctcaccatcatcagcctggacncctgaacgatgttgctagttttatacttgtcaacatcgtacgngtcggccgtccggggctacgtttcgcccgtggacctaagtgatagtacgaaacgactgtgctgcacatctgtctcnc

SEQ ID NO: 9496 - DNA, 568 bp, Homo sapiens
  misc_feature: GYAE6OF02GVG5Z.10.43.D10.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttggcgcctacgtagcctggtaccaacagaaacctggccaggctcccaggcccctnatctatggtncactccaacgacgggccacgtggccactccccagcccaggttccaggtggcaggttcgggtcgtggggacagtacctttcactctcaccatcatcacgtcgtgacgcctagaagattgtgtctagtttactacttgtacaactatcgtacgtagtcggcccgtccggggtcctacgtttccggccgttacgggaaccgtaaggtcggtaatacgtacgaacgtactggtcggctcggaccacgtgtcttcgttacttcactttccgtcccgtcc

SEQ ID NO: 9497 - DNA, 518 bp, Homo sapiens
  misc_feature: GYAE6OF02GXWIA.10.43.D10.1.454.CMB.1.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (513)..(513): a, c, t, g, unknown or other
  misc_feature (513)..(513): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagagtgttggcgcctagtagcctggtaccaacagaaacctggccaggctcccaggcccctnatctatggtgcatccaacagggccactggcatcccagccaggttcagtggcagtgggtctgggacagacttcatctcaccatcatcacgctggacgctgaagatgttgctagtttattactgtacaactatcgtacgagtcggccgtccggggcctacgttccggccgtcgggaccaaagtcgatagtacaacgaactgtaggctcgcacgtactctcgtcttcnttccc

SEQ ID NO: 9498 - DNA, 607 bp, Homo sapiens
  misc_feature: GYAE6OF02JQXG3.10.43.D10.1.454.CMB.1.raw
  modified_base (206)..(206): a, c, t, g, unknown or other
  misc_feature (206)..(206): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (395)..(395): a, c, t, g, unknown or other
  misc_feature (395)..(395): n is a, c, g, or t
  modified_base (438)..(438): a, c, t, g, unknown or other
  misc_feature (438)..(438): n is a, c, g, or t
tcagcatagtagtgcacgaccggtgctcgatttagactagcagtaaggggaggaactgctcagttaggacccagagggaaccatggaagccccagctcagcttctcttcctcctgctactctggctcccagtttcagataccaccggagagattcggtgttcgactacagtctccagccaccctgtctttgtctccgaggggaaancgccaccctctcctgctacgggccagtccagtagtgttcggccgaccttaggtagccttgggtaacccaagacgaaaccctggccaggcctaccccgaggccccctntactctatggtcnccgactcccaacgacgggcccacgtcggcactccccagcccgaaggttccaggtcggcagtgggtaccnggggacagtcttcgactctacaccgatcatcacgtcgtggacnccgtgacgatgttagcgtagttatacgtacgtactactacgtacgtacgtgtacggtcgtaccgggtcctacgttaccgccgtacggacgtaacgtagtacgtactacgaacgtaactacgtacggtacctacgactaccgtacgtccgtacgtacttctacgttcccg

SEQ ID NO: 9499 - DNA, 602 bp, Homo sapiens
  misc_feature: GYAE6OF02HRYXC.10.43.D10.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngccacctctcctgcagggccagtcagagtgttggcgctacgtgcctggtaccaacagaaacctggaccaggctccaggcccctcatctatcggtcnctactccaaacgacgggccacgtacgggaactcccgaacgccgtaggttccaggtcggctaggtggggtctagggacaggtacttcgactcgtcaccgtatccatcgaacgtccgtaggacgtccctagaacgtattggttcgacgttaagttttattacgttaggttacaacgtattacgtaccgagttcggtccgtccggggtcctacgttccggcccgttacgggaaccgtaaaggtcgactacgtacgaacgtacgtgtcgacgtcgacacacttcgtcgttctactacttcctacccg

SEQ ID NO: 9500 - DNA, 657 bp, Homo sapiens
  misc_feature: GYAE6OF02JMGIP.10.43.D10.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (304)..(304): a, c, t, g, unknown or other
  misc_feature (304)..(304): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctcagccaccctgtctttgtctccaggggaanagccacctctcctgcagggccagtcagagtgttggcncctacgtagcctggtaccaacacgaaacctggaccagggcctcccgacggcccctcatctagtggtncagtccaacgcgggcccagtcggcactcccagccagggttcaggtcggactaggtcgggtctagggacaggtacttcacttcctacaccattcaactcgacgtccgtaggacgtcccgtaggtaacgtagtaggttcgacgttagtttaacttaacgttacgttacaaaccgttacgttccggtaaccgggtacggtccggggtccccggttacccgggggacccttaccgggtttccgggcccggttacgggtaaccgtaacggttacgtaacgttacgtaaccgtaacggtaaccgttggtacggacttacggacctacgtacgtccgttacgttcttactacgttccccg

SEQ ID NO: 9501 - DNA, 617 bp, Homo sapiens
  misc_feature: GYAE6OF02FE634.10.43.D10.1.454.CMB.1.raw
  modified_base (201)..(201): a, c, t, g, unknown or other
  misc_feature (201)..(201): n is a, c, g, or t
  modified_base (321)..(321): a, c, t, g, unknown or other
  misc_feature (321)..(321): n is a, c, g, or t
  modified_base (416)..(416): a, c, t, g, unknown or other
  misc_feature (416)..(416): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagagtgttggcgcctacgtagcctggtaacccaacagaaacctggacccaggccttccccgaggccccctcactcctatcggtgcactccaacgnggccacgtggccatcccagccaggttcaggtgctaggtgggtctggggacagacttcactcgtcaccatcatccgagccgtgacgcgtagaacgnttgttacgactagttttattacgtgttacaactacgttccgtaaccgtacggtcggacccggttcccgggggaccttaccggtttcccgggacccgtacgggtaaacccgaaggttacggtaattacgaccgtaaacggtacgtaggtacggtccgtacgaccgtaaccgtacgtaccttggttaccttacgtacttcccg

SEQ ID NO: 9502 - DNA, 660 bp, Homo sapiens
  misc_feature: GYAE6OF02FTKGH.10.43.D10.1.454.CMB.1.raw
tcagcatagtagtgcacgaccggtgctcgatttagactagcagtaagggggaggaactgctcagttaggacccagagggaaccatggaagccccagctcagcttctcttcctcctgctactctggctcccagtttcagatacccaccggagaggattgtgttgacacagtcctccacgcccaccctgttctttgtcctccgaggggaaagacgcccaccctctcctgcgacgggccagtcagagtgttggccgcctacgtacgcctcggtaccaacagaaacctggccgaggcctcccgacggcccctcactctatggtgcatcaacagggccacgtggcactacccgagccgtaggttcaggtcggcgaggtggggtcgtgggacagtacttcactctccaccatcatcacgcctagggacgcctaggaacgtagttcgttcgacgttagttttaacttacgtcgtaccaactacgttaccgtaccggtaggttccggcccgggttaccggggtacccttaccggtttcccggacccggttacggaaaccggtaaggtacggtaacttacgtaaccgaaacgtaacgttcgggtacggtaccgtacgacccgtacccgttacgttaccgttacgttaccttacctaccgtttacccccg

SEQ ID NO: 9503 - DNA, 555 bp, Homo sapiens
  misc_feature: GYAE6OF02IYSER.10.43.D10.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (373)..(373): a, c, t, g, unknown or other
  misc_feature (373)..(373): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagagtgttggcncctagtagcctaggtaccaacacgaaacctggccaggcctcccaggccccctcatctatggtgcatccaacgagggccacgtggcatcccagccaggttcagtggcaggtgggtctgggacagacttcactcncacatccatcagcctaggcgccgtgaagtatgttacgtacgtagtttaattactgtactaacactacgtacgagtcggtaccggtccggggccacgtcgtccggtccgtcggaaccgaagtcggactacgtacgaaacgtacgtacggaggtactgaccacgtacttctcgttcctactacg

SEQ ID NO: 9504 - DNA, 632 bp, Homo sapiens
  misc_feature: GYAE6OF02F9LU6.10.43.D10.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagatacccaccggagagattgtgttgacacagtctccagccaccctgtctttgtctccaggggaaanagccaccctctcctgcagggccagtcagagtgttggcgcctacgtagcctggtaccaacagaaacctggccaggcctcccaggccccctnactctatggtgcactccaacgagggccacgtcggcactcccagccaggttcagtggcaggtggtctgggacagacttcactcncaccatcatcacgtcctggacgcctgaagagtgttgactagtttatttacgtgttacaacgtacttacggtaccgtaggtcggtacccggtcccgggggtaccttaccggtttcccgggccccgttacgggtaacccgtaaacggtcgggtaacgttacgtaacgtaaaccggtaacgtacggtacgggtccgttacggacccgtacccgtacgttaccgtacgtttacccgtttaccgttaccgttttacccccg

SEQ ID NO: 9505 - DNA, 649 bp, Homo sapiens
  misc_feature: GYAE6OF02ILS1W.10.43.D10.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangcccaccctctcctgcagggccagtcagagtgttggcgcctacgtagcctggtaccaacagaaacctggccaggctcccaggccccctnatctatggtgcatccaacngggccactggcactcccagccaggttcagtggcagtgggtctgggacagacttcactctcaccatcatcagcctaggacgctaggaagtattggttagacttaggttttacttacgttgtacaatcgttaccgtaaccgtaggttccgggtacccggtcccgggggtaccttacccggtttccggggccccgttaacgggggtaacccgtaaaagggttcggtaacgttaaccgtaacccgtaaaaaccggttccggttaagggtcgggtaccgtaccggtaaccctaacccgttaacgttccgttacggtttacccgtttacctaaccgtttcccccg

SEQ ID NO: 9506 - DNA, 260 bp, Homo sapiens
  misc_feature: GYAE6OF02H76SQ.10.43.D10.1.454.CMB.1.raw
  modified_base (255)..(260): a, c, t, g, unknown or other
  misc_feature (255)..(260): n is a, c, g, or t
tcagcatagtagtgcacgaccggtgctcgatttagactagcagtaaggggggacagacttcactctcaccatcatcagcctggagcctgaagatgttgcagtttattactgtcaacatcgtaccgagtggcctccggggccactttcggccctgggaccaagtggatatcaaacgaactgtggctgcaccatctgtcttcatccttccgctatctgaccactactatgctgagcgggctggcaaggcgcaatagnnnnnn

SEQ ID NO: 9507 - DNA, 576 bp, Homo sapiens
  misc_feature: GYAE6OF02GPUG1.10.43.D10.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (316)..(316): a, c, t, g, unknown or other
  misc_feature (316)..(316): n is a, c, g, or t
  modified_base (456)..(456): a, c, t, g, unknown or other
  misc_feature (456)..(456): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccacctgtctttgctcaggggaangccaccctntcctgcagggccagtcagagtgttggcncctacgtagcctggtaccaacagtaaacctggcccaggcctcccgaggccccctcgaatctaatggtgcattcccaaacgngggcccaacgtggacactccccagcccaggttcagtcggcaggtcgggtctgggacaggtacttcactctcacctatcaatcacgccgtgacgctagaagtatgtgctagtttattacgtgtacaacgtatccggtacgngtcggccgtccggggcctacggtttccggccgtacgggaaccaaaggtcgaactacgtacgaaacggtacttggtacggtcgtacgaccgtacgtactcgttcggtcttaccgattcccg

SEQ ID NO: 9508 - DNA, 752 bp, Homo sapiens
  misc_feature: GYAE6OF02GY2HS.10.43.D10.1.454.CMB.1.raw
  modified_base (202)..(202): a, c, t, g, unknown or other
  misc_feature (202)..(202): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccacctgttctttgtctccgaggggaanacgccaccctctcctgcgacgggccagtcagtagtggttcggccgtcctacgtacgccgttaggtaacccaaacgaacgtaaaccgtcgggacccgacgggccctcccccgaacgggtcccccttaccgtacttaccgtaacgttcgggtacgacctaacgtacccggaaacggaccggggaccctaacggtccgggacctaccgtacccgaacgtcccgtaaggttccgaggtcgggtcgtagggtcgggtcggtacggacgtacgtaccttcgactacctacctaacctactacacgtacgacgtccgtaggaacctcgtaacggtaagttgtgttacgtactttaagttttactacgtaccgttactaaactcggttaccggtaacgggtcggtcccgggtacccggttaccggggttacctttccgggttcccgggtaaccgggtacggtaaaccgtaaggtaccggtaacttaacgtaaccgtaaggtcgtaggtccgactaccgaccgttactcgtttcgtaccgttcttaccgtccgttcccc

SEQ ID NO: 9509 - DNA, 623 bp, Homo sapiens
  misc_feature: GYAE6OF02HCXM9.10.43.D10.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (289)..(289): a, c, t, g, unknown or other
  misc_feature (289)..(289): n is a, c, g, or t
  modified_base (413)..(413): a, c, t, g, unknown or other
  misc_feature (413)..(413): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctntcctgcagggccagtcagagtgttggcgcctacgtagcctggtaccaacagaaacctggccaggctcccaggcccctnactctatggtgcatccaacgagggccacgtggcactcccagcctaggttcagtggcaggtgggtctggggacagacttcacgtcctcaccatcaatcgacgcctggacgctagaagagttgttnacgtagtttacttacttagtacaactacgtaccgtaccgtagtcgggtcccggtcccggggtaccttaccggtttcccgggcccgttacgggtaacccgtaaaggttacggtaacgttaccgttaaccgaaaaccggttaacgtcggttacggaccgttacggacctaaccgtacgttccttacggttcctttaccgtacgtttaccccg

SEQ ID NO: 9510 - DNA, 540 bp, Homo sapiens
  misc_feature: GYAE6OF02GPA4I.10.43.D10.1.454.CMB.1.raw
  modified_base (202)..(202): a, c, t, g, unknown or other
  misc_feature (202)..(202): n is a, c, g, or t
  modified_base (427)..(427): a, c, t, g, unknown or other
  misc_feature (427)..(427): n is a, c, g, or t
  modified_base (525)..(525): a, c, t, g, unknown or other
  misc_feature (525)..(525): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccacctctcctgcagggccagtcagagtgttggcgcctagtagcctggtaccaacagaaacctggccaggcctacccaggcctcctcattcatgatgcactccaggacggccagtggacatcccagccaggttcagtggctaggtggtctgggacagtacttcactctcacctatccaccgcctacgaccctaggaatctttgacttagtttactctgtcagcngctagcagcctcgcccctctcccgtctccgttcggcggacggtaccagggtcgacgacgtacaaacggtaccgtggttacgcttacgacctaaccgtntacgttctacgttcc

SEQ ID NO: 9511 - DNA, 681 bp, Homo sapiens
  misc_feature: GYAE6OF02I4NUR.10.43.D10.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngccaccctctcctgcagggccagtcagagtgttggcgcctagtagcctggtaccaacgacgaaacctggccaggcctcccgaggcccctnatctatggtncactcccgaaacgacgggcccagtcggacctaactccccaaggtcccagggtttccaagggttcggcctaacggggttgggggttcctagggggaaccaggtaaccgtttcaccgttctaccgacccagttcccaattccgacgtccgtgggacgtccgtagaacgtagttcgttgtactagttttattacgtcgttactaactacgttaccgtaaccgtcggttacgggtcccggtcccggggtcccttaccggtttccgggtaccccggttacgggaaccggtaaaggttacgtaacgttacgtaacggtaaaccgtaacggtggttacggtctacgacctacctacgttccgttacgttcccttactacttcccg

SEQ ID NO: 9512 - DNA, 651 bp, Homo sapiens
  misc_feature: GYAE6OF02H2VGJ.10.43.D10.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (324)..(324): a, c, t, g, unknown or other
  misc_feature (324)..(324): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagactaccaccggagagattgtgttgacacagtctccagccacctgtcttgtcctcgagggaanacgccaccctntcctgcaggccagtcagtgtgtgcnctagtgcctaggaccaanacggtaaacctcggaccaggtcctcccgacggtccccctacatcctagcggcgtaccacgtaccaacggnggccacgtcgacactcccgagccgtaggtcgaggtcgcgtaggtcgggtgaggaactcgtactcgaacttcaccgaactacgtcaacgtcgacgtcgtacggtacgtcgtacggtaaacgtagttacggttacgtcgttaacgtttaacgttaccgttacgtaccgtaactaacgtaccgtaaccgtacgggtcccgggtaccggtcccggggtacctaccggtttccgtacccggtaccggtaacgtaacggtagtacgtaacgtacgtaaccgtacgtacggtcgtcgtacgtacgactacgtcgtacgttcgttacgtatcccg

SEQ ID NO: 9513 - DNA, 755 bp, Homo sapiens
  misc_feature: GYAE6OF02H3ZWK.10.43.D10.1.454.CMB.1.raw
  modified_base (199)..(199): a, c, t, g, unknown or other
  misc_feature (199)..(199): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagtataccaccggagagattggtgttgacacagtctccagccacctgtctttgctcagggaanacgccacctctcctgacaggccagtcagagtgttcggacgccttacggacgctggtaccaacgtacgaacctggccacgggtcctcccgacggccccctacacttcgtaacgttggtcgtcactaccgaacgtacgggaccacgtcggacactacccgacgccgtaggtttccgaagtcgggtacgagggttcggggtaccgtaggggtaactaaggtaccttttaccgaccgtttacctaccctaaccccgttaagtacctaacgtaccacggtcccgttagggaccgttacccgtaagtaaagttacgttgtacggtcgtttaacgttttactaacgtttactacgtaaccttacgttaccggtaaccggtacggttacccgggtacccgggttacccggggtacccttaaccgggtttcccgggtacccggttacggggaaaccgttaaagggtcgtaactacgtaacccggaaacgtaacgttggaccggtcgtaaccgtaccgttaacctacgttaccgttacgtttaccccgtattaccgtttacccccg

SEQ ID NO: 9514 - DNA, 725 bp, Homo sapiens
  misc_feature: GYAE6OF02JYY5B.10.43.D10.1.454.CMB.1.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (323)..(323): a, c, t, g, unknown or other
  misc_feature (323)..(323): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagactaccaccggagagtattggtgttgactacagtcctcagccacctgtctttgtctccgaggggaanagccaccctctacctgcgacgggccagtcagngtgttcggctcctaggtacgcctggtaaccaacgacgaaacctggaccgacggcctcccgacggccccctgactctagtcggtacncgacttaccaacgacgggtcccactcggaccactcccgacgccgtacggttactacggtacggcctaggtcgggttctcggggactagtaccgttactaccgtccttacccgaaccgtactaccaacgttaccgacggtcccgtacgggaccgttacccgtacggtaaagtacggtttcgtttacgggaccttaaacgttttcgttaacttacggtaaccttaaccggtaacgttccggtaaccgtgggttaccgggtacccggttacccgggtaccgttaacgttcccgggtaccgtaccgggtaaacctaggtacgtacgtacgtacgtaacccgtagtacggtcgtaccgttacgaccgtacttaccgtcttacggttacctttacgcctttaaccccg

SEQ ID NO: 9515 - DNA, 744 bp, Homo sapiens
  misc_feature: GYAE6OF02GQP03.10.43.D10.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctntcctgcagggccagtcagagtgttggcgcctacgagcctggtaccaacagaacctggccaggctcccaggccccctcactctatggtgcactaccaacgcgggccacgtggacactcccagcctaggttcaggtggcgaggtcgggtcgtgggacgagtacttcacttcctacacctacgtaccatccgaacgtcccgtagggaccgcccgtacggtaaggtacgttcggttagaaccgttaaggttttaacttaacgttacgttaaccgtaaaccgtacgttaccggtaaccgggtacggttaccggggtaccccgggttcccggggggtacccctttaaccgggttttccccgggaccccggtttaaccggggtaaacccggttaaagggttacgggtaaccttaccggttaaccgaaaaccgggttaaccggttacgggttacgggtaacccggtttacggtaccccgtaaccgtttacggttaccgttacggtttacccgttttacccgtaccggttttaccccccg

SEQ ID NO: 9516 - DNA, 774 bp, Homo sapiens
  misc_feature: GYAE6OF02GWT94.10.43.D10.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaancgccaccctctcctgcagggccagtcagngtgttggcncctagtagcctggaccaanagaacctggccaggcctaccacggcccctnactctagtggtgcactacccaacgacggggccaacgtcggacactccccgagtccccgtaagggtttccaggtcggacgagggttaggggtcgtacgggaacaggtaccttacaccttcctaccacctaacgtcctaacttccgacgtacccgtagggaacgtcccgtaggtaaacggtagtttacggttacggtacgtttaacgttttaacgttacgttagttaaccgtaaataccgtttaccgggtacccgggtaacggttcccggggtaccccgggttacccggggggtaccctttaacccgggttttcccgggggaaccccgtttaccgggggtaaaccccgtaaaaggggttacgttaacgtaacgttaacccgaaaaaccggggtttaacgttaacgggttaccgggtaccgttacgggaaccctaacccgttacgtttcccgttaacggtttccctttaccggtacctttacccccgg

SEQ ID NO: 9517 - DNA, 896 bp, Homo sapiens
  misc_feature: GYAE6OF02JIBOO.10.43.D10.1.454.CMB.1.raw
  modified_base (193)..(193): a, c, t, g, unknown or other
  misc_feature (193)..(193): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacgcagtcgccacgccacctgttcctttttcnccgagggacctagacgtccaccctcgtccgtggtacgggcctaggttagtgggttgttggccgtaccttaacgttttaaacgtcggttaaacccaaacgtaacggtaaaccggtcggacccgaacgggtcccttaccccgaaggggtccccttacccgtacctaaccgttccgttaaacgggaaaccgtccctaaaccgttaccccgaaacccggtaaccgggggacccctaaccgttacccggggtccccgttacccccgaacggaccccggttaaacgggtttcccgtaagggttccgggaccggtaagggggtttccgggccgggttacgggaaccgtaacggtttaccgtttacccacccgtttaccctaacctaccgacgttaaccgaaccggccgtaccggtcccggttagggaccgtacccgtaagtaaaggtactttacgtcggttactttaagttttacgttagttcgtacgtacgtacgtacggtagtcggtacgtagggttaccgttccggttttaactaccggggtttccccgggtaacccggggtaaacgttaacgggtaaacgttaacgtaaacgttaaaaccgggacgttaccggtaggttaccgacggtaccctaacgttaccgttcgttccggtttacctacgtttcggttacccctttccccggacgttacccttcggttaaccc

SEQ ID NO: 9518 - DNA, 823 bp, Homo sapiens
  misc_feature: GYAE6OF02JK9NH.10.43.D10.1.454.CMB.1.raw
  modified_base (324)..(324): a, c, t, g, unknown or other
  misc_feature (324)..(324): n is a, c, g, or t
tcagcatagtagtgcacgaccggtgctcgatttagactagcagtaagggggaggaactgctcagttaggacccagagggaaccatggaagccccagctcagcttctcttcctcctgcctactctggctcccagtttcagactaccaccggagagattgtgttgacacagtcctccagcccaccctgtctttgtctccgaggggaacgacgccctaccctctcctgccagggcccagtccaggagttcgttcggccgcctacggtacgccgttcggtaacccaacgacgaaacccgtggaccgaggcctcccgacggccccctanacgtcctagttcggtcgacctactaccgaaaccggtacgggccctacggtccggtccgtaacccgtcccgaacggtccccgtaagggtttaccgagggttccgggacgtaacggggttcggggtacgtaccgggggaaccgtaagtacccgtttacgacccgtttaccctaccgaaccctacgtccgtaacctccggtaaccggtcccggtaggtacccggttaccgtaacggaacggtacgtttcggttaaccgtcgttaacggtttttaacttaccgtacgttacccgtaaccgggtacgtacggttacccgactaacccgggttccgtaccccggttaccgggttaccgggttcccggaaccggggttaaccggggacccgggttaaaggtcggtaaacctcggttaaccggacgggtaaaccccgttaggtccggggtacgaccgttacggaccgtaaccttccgttacggttccgtacgttacccgtttaaccg

SEQ ID NO: 9519 - DNA, 680 bp, Homo sapiens
  misc_feature: GYAE6OF02GKA7J.10.43.D10.1.454.CMB.1.raw
  modified_base (203)..(203): a, c, t, g, unknown or other
  misc_feature (203)..(203): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaanagcccaccctctcctgcagggccagtcagagtgtggcgcctacgtagcctggtaccaacagaaacctggccaggcctcccgacggcccctcatctatggtcgcagtcccaaacggacgggcccaacgtcggacctacgtccccgagtcccgtaagggttccgtaaggtggggacctaggggttcggggtacttggggaacctaggtacctttcgaccttcgtacaccgtaactcaacgtaccgacgccgtaggacgtccgtagaagtagtgttacgtacgttagtttacgttacgttgtactaacgtacgtaccgttaaccgtacgggtccggtacccgggttaccgggggtacccttccgggtttaccggcccggttaacgggtaaccgtaaaggtacggtatacgtaacgtaaaccgtaagtcggtacggtcgtacgaactaccgtattaccgtagtccgttacctacttacccg

SEQ ID NO: 9520 - DNA, 748 bp, Homo sapiens
  misc_feature: GYAE6OF02IQ88S.10.43.D10.1.454.CMB.1.raw
  modified_base (210)..(210): a, c, t, g, unknown or other
  misc_feature (210)..(210): n is a, c, g, or t
  modified_base (260)..(260): a, c, t, g, unknown or other
  misc_feature (260)..(260): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagaaaccactggagaaatcgtgatgacgcagtctccagccaccctgtctgcgtctccgagggccaaacacgccacccctntcctgcgtgggccagtccgagttcgttggcagccgctacgcctggaaccngaccaaaaaccgtcggaccacgcccctccgacggcctccgtcgtcctagtcggtcgctactaccgaacgaacgggcccaacgtcggtacttaccccgagtaccctagggttccaggttacggcgacgggttacgggttcgtaggggaactacggtacggtttcgtaccgtacctacacccgtaattccgaacgtcgaacgtttccgtacggtcgtacgttacgtagttaacgtttacgttttagaccgtttaagtttttaacgttacgttacgtacgtaaggttaattaaggttcggtaaggttaccgggtcttaccgggttacccgtttacccgttaacgttttaccgtttacgggaaacccggttaagggtaaacccgttagggtttaaccggtacaaccggtttaaccgaaacggttaccggttcggttaacggtccgtagtacccgtaacgttaccgttcttaccggttactaccgtttacccg

SEQ ID NO: 9521 - DNA, 670 bp, Homo sapiens
  misc_feature: GYAE6OF02JJRLG.10.43.D10.1.454.CMB.1.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (292)..(292): a, c, t, g, unknown or other
  misc_feature (292)..(292): n is a, c, g, or t
  modified_base (660)..(660): a, c, t, g, unknown or other
  misc_feature (660)..(660): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtcctcagccacctgtctttgtctccaggggaaanacgccaccctctcctgcagggccagtcagaatgttggcnccttgtaagctggtaccaacacaaaccgtggccaggcctcccgaggcccctnatctatcggtgacctataccgaacgacggggccaacgttcggactacgtccccaagcccgtaggttccaaggtggccgaaggttggggtaatggggaacaggtaccttcaaccgtctaccaacctagtccaagtccgacgccgttgggaaccgtcctaggtaacgagttcgttacgacgtagttttaacgttacgtcgttaacaacgtactttaccggtaaccgtagggtcccggtacccggtttcccggggacctttaacggtttcccggaccgttagggaacccgttaaaggtcgggtaacgtacgtaaccgaaaggtaaccttcgggtagccgtacgaccctacgtacgttcgtagttcccttanaccgttcccg

SEQ ID NO: 9522 - DNA, 689 bp, Homo sapiens
  misc_feature: GYAE6OF02JWQHA.10.43.D10.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (308)..(308): a, c, t, g, unknown or other
  misc_feature (308)..(308): n is a, c, g, or t
  modified_base (441)..(441): a, c, t, g, unknown or other
  misc_feature (441)..(441): n is a, c, g, or t
tcagcatagtagtgcacgaccggtgctcgatttagactagcagtaaggggaggaactgctcagttaggacccagaggaaccatggaagccccagctcagcttctcttcctcctgctactctggctcccagtttcagataccaccggagagattgtgttgacacagtctccagccaccctgtctttgtctccgagggaaancgccctaccctntccgtgccgacgggccagtacgagtagttggtcggctccgtcgtacgcctaggtaccaacacgaaccgtggaccgaggcctcccgacggtcccctntactcgtgtacggtcgcctacgtacccaacggcggaccaccgtggaccctactcccgacgtaccgtacggttacgcgggtaccgacgtaggttcgggtctcgggacgtagtaccttacgacctcgtaccaccnttacgactcacgtcgtagcgtccgtagtagtagtcgttacgtacgtttggttaaccttacgtcgttaacgtacgttaaccgttacgtaccgggtaacggtccggtcccgggtaacccgggttccttaaccggttcccgggtaccttaccggggtaaccctaaagggtcgtacctacgacccgtaacgtccggtaggttacgtcgatacccggtattaccggtcgtaccgtttctaccgtcgttacccg

SEQ ID NO: 9523 - DNA, 621 bp, Homo sapiens
  misc_feature: GYAE6OF02ID96U.10.43.D10.1.454.CMB.1.raw
  modified_base (168)..(168): a, c, t, g, unknown or other
  misc_feature (168)..(168): n is a, c, g, or t
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (312)..(312): a, c, t, g, unknown or other
  misc_feature (312)..(312): n is a, c, g, or t
  modified_base (423)..(423): a, c, t, g, unknown or other
  misc_feature (423)..(423): n is a, c, g, or t
  modified_base (480)..(480): a, c, t, g, unknown or other
  misc_feature (480)..(480): n is a, c, g, or t
tcagcatagtagtgcacgaccggtgctcgatttagactagcagtaagggggaggaactgctcagttaggacccagagggaaccatggaagccccagctcagcttctcttcctctgctactctggctcccagtttcagactaccgaccggagagattgtgttgaacacngtcctccagccacctgtctttgcctcgaggggaaancgccctacctctccgngaccgaggccagtcagaggttcggtgccgccttaacgcgccttaggaccaacgacgaaacctcggccaaggcctccccgacgtcccccgtanactcgtagtggagtcactcccaagacggctacgtggacactccagtccgagttcaggtgctacggtgggtacgtcggaccaagtcctttcacgtctacccgaatacacgtntacctagcccgtaggacgtcctaggtacgtaagtcgttacggttaacgttatacgtntacgaactagtcgcggtactcggccgttaccggggccttcgttaccgccgtaacgtacgacgtagtctacgtacgtaacctaggcgttcgggacttacggacttaacccgtagtcgttcgtttacctagtaccctttccgg

SEQ ID NO: 9524 - DNA, 936 bp, Homo sapiens
  misc_feature: GYAE6OF02GRCKC.10.43.D10.1.454.CMB.1.raw
  modified_base (217)..(217): a, c, t, g, unknown or other
  misc_feature (217)..(217): n is a, c, g, or t
tcagcatagtagtgcacgaccggtgctcgatttagactagcagtaagggggaggaactgctcagttaggacccagagggaaccatggaagccccagctcagtcttctcttcctctgctactctggcctcctagttcagactaccgaccggagagtattgttgtgactacagtcctccgacgccctacctgttcctttgtcctaccggaaggggaaancgccctaccctctcctgacgacgggcctagcgaggtaggttcggttcggccgtacctacggtacgtaccgttacggtaacccaaacgtaacgaaaccgtcggaccgacggtccctacccggaccggtccccctacacttccgtagtacgggtcgtaccactaacccgaacggaccgggacctacggtccggacctaaccgtaccccgaacggtacccggtacgggtttaccgacgggtaccggtacggtacggggttacggggttaccgggttaaggggaacccgttaacggttaaacccgtttccgaacccgtttaccctaacccgtaacccggtacttacctaaccgttacccgtaccggtacccggttagggaacccgttcccgtaagggtaaacgtggtttacgttacgtaccgtttaagtttttacgttaacgttacgttaacccgtaaacgttacccgttccgggtaaccgttcggggttcccgggttaccccggggttaccccgggggttaccctttacccggggttttacccggggacccccggttaaacggggtaaacccggttaaaaggggttccgttaaaccgttaccggttaaacccggaaaaccggttcggttaccgggttacggtaccggttacccgtaacccggttaacttaccggtttaccggttttaacttcccgttttaacccgtccttttaaccccccgg

SEQ ID NO: 9525 - DNA, 965 bp, Homo sapiens
  misc_feature: GYAE6OF02ISNKN.10.43.D10.1.454.CMB.1.raw
tcagcatagtagtgcacgaccggtgctcgatttagactagcagtaagggggaggaactgctcagttaggacccagagggaaccatggaagccccagctcagcttctcttcctcctgctactcgtggcctccctagtttcagataccaccggagagtattgtgttgacacagtctcagcccacctgttctttgtctaccgaggggaaacacgccctaccctctccgtgcgacggccagtacaggtagttggttcggccgtacccgtacggtacgtccgtacggtaacccaaccgaacgtaaacccgtcggacccgaacggtccctaccccgaacggccccccttacgtaacgttcctaaggttcgggtacgaccgtaccgttaacccgaaccggaccggggaccctaaccggtcggtacctaccgtaccccgtacgtacccgtaaggttccgtaacggtcgggtaccgtaaggggttcggggtttaccggtagggggaacctaacggttacccgtttacctaacccgttacccgtaccggtaacctacgttaccgaacccgtttaccgaccgtttaccccgggtaaggggtacccgtaccgttaaacgggaaacgttacggtttcggttaccggttaaccggttttaaacgtttttacgtttaaaccgttccggttaaaccgttaaaccttaacccggggtttaccggttaacccggggtacgggtttacccgggttacccccgggggtttaccccgggggttacccttttacccggggttttcccggggtacccccgggtttaacggggaaacccgtttaaaacggggttaccggtaaacctttaacgggtaaacccgttaaaccgggttaacggttaccgggttaaccggtaccctaacgggtaacccttaaccgtacgtttcccggttacgtttacccggtttacccttacccgttcccccgg

SEQ ID NO: 9526 - DNA, 794 bp, Homo sapiens
  misc_feature: GYAE6OF02JQMA1.10.43.D10.1.454.CMB.1.raw
  modified_base (180)..(180): a, c, t, g, unknown or other
  misc_feature (180)..(180): n is a, c, g, or t
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (280)..(280): a, c, t, g, unknown or other
  misc_feature (280)..(280): n is a, c, g, or t
tcagcatagtagtgcacgaccggtgctcgattagactagcagtaaggggaggaactgctcagttaggaccagaggaaccatgaagcccagctcagcttctctcctctgctactcgtgctacccagtttcagactaccaccggagaagtgttgtagttggaacactacgttcctaccgaanccccgtaacccttggttcctttnttacccgtacccgaaggggaaaacncgcccctaaccctcgtcccgtagcgaacgggtaccctagggttaccaacggngttcggttacgccgccgtaacggttacgccgtcggtaaaccgaacctaacgaaaccgttacggaccgacgtacccgtccgaccggacccctccgtactccgtaagttacggtacgctaccgtaccgtaaccgacgggtacccgacttccgggaacctaaccgtcccacggacccctaggttaccggacggttacggaccgtaacggtacggggttcggtacggggtaaactcgtaaccgttctaaaccggtccttaccaccgtaactcgaaactcgtaccgtacgtacgacggtaccgtaggtaacgtacttccggttaaggtccttaaggttaaccttagttaccgtacgtactaacgttccgtaacggtcgggtaccgtccggtcccgggtaccgttaccgttcgtaccgtacggtacccgtaagtcggtactacgtacgtaaccggtaacgttacgtagggtacctacggtacctacgtactacggttcctacgtttacctacgttccccg

SEQ ID NO: 9527 - DNA, 778 bp, Homo sapiens
  misc_feature: GYAE6OF02HFGOB.10.43.D10.1.454.CMB.1.raw
  modified_base (139)..(139): a, c, t, g, unknown or other
  misc_feature (139)..(139): n is a, c, g, or t
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
tcagcatagtagtgcacgaccggtgctcgatttagactagcagtaagggggaggaactgctcagttaggacccagagggaaccatggaacgccccagcgcagcttctcttcctcctgctactcaggctcccagaaaccnctggaagaatcggtgatggacgcaggtctccgagccctaccctgtctgcgttcctccgaggacaaaccgngcccctaccctctccgtgccgtgggaccngtccgagttggtcgacacgccgtacttacgccttaggtaccagaaccgtaaaaccgcggaccaccggcccttaccgacggtcccttcctccgtctacgttggtcgcgtactaccgaacgacgggcctacgtcggactcccgacgtccgtacgtcgacggtgtcggtaggtcgggtccgtagggtaccgtaaggttccggttactcgttccgtacccgtaccgtacgtacgtacggtcccgtaggtcccgttaggtacccgttacggtacggtaacgttaaaggtttccgttttacggtaccgttttaacgtttaccgtttaccgggttaacggttaccgtaaagggttttaacccgttaaggtaccggtaacgttcgggtaacccgttccgggttacccgttacgttacccgtttacgggttaccgtaccgggttaaaccggttacgttacggtacgtacgttaccgtaacggtaaccgtacggttacgccgtaccggtatacccggttacgtcttaccggtattacccgtacgttcccg

SEQ ID NO: 9528 - DNA, 806 bp, Homo sapiens
  misc_feature: GYAE6OF02G8G4P.10.43.D10.1.454.CMB.1.raw
  modified_base (204)..(204): a, c, t, g, unknown or other
  misc_feature (204)..(204): n is a, c, g, or t
  modified_base (500)..(500): a, c, t, g, unknown or other
  misc_feature (500)..(500): n is a, c, g, or t
  modified_base (518)..(518): a, c, t, g, unknown or other
  misc_feature (518)..(518): n is a, c, g, or t
tcagcatagtagtgcacgaccggtgctcgatttagactagcagtaagggggaggaactgctcagttaggacccagagggaaccatggaagccccagctcagcttctcttcctcctgctactctggctcccagtttcagactaccacggagagattgtgttgacacagtctccagccacccttgtctttgtctccgaaggggaanacgcccaccctctccctgcgacgggccagtcgaagtggttgttcgggcgcccgttacggtacgtccgtacggtaacccaacgaacgtaaaacccgtgggacccaacgggcccttacccccggacggtaccccccgtcgaacttaccgtacgttcgggtactacctaaccttacccgaaacggaccggggcctacgtacggcctaaacctccccggaggtaccgttagggttaccacggtcggacgtagggtcggggttccgaggggaactaggttaacccttccgaccgtttaccnccgaaaccgtacccttanaactcggaacgtccggtacgggaccgtaccgtaggaaagttgttacggttacacgtttaacgttttagttaccgtcggttacgaaacggtcgtaaccggtacggtacgtaacccggtacggttccgggtaccggttacccggggttacggttacccgggaaaccgggttaaaaccgggaccgttaaaggggccgtaacgtaccgtaaccgggtaactaaccggggtaccttagggtaccgtaccgttaacgacctaccttacccgggttctttacggttccccttacg

SEQ ID NO: 9529 - DNA, 903 bp, Homo sapiens
  misc_feature: GYAE6OF02GODEN.10.43.D10.1.454.CMB.1.raw
tcagcatagtagtgcacgaccggtgctcgatttagactagcagtaagggggaggaactgctcagttaggacccagagggaaccatggaagccccagctcagcttctcttcctcctgtctactctggctcccagtttcagataccaccggagagattgtgttgacacagtctccagcccaccctgttctttgtctccgaggggaaacagcccaccctctcctgcgagggccagtcagtagtgtggcgtccgtacggtacgccgtaggtaaccaaacgtaacgtaaacccgtgggtaccccgaacgggtccctacccccggtaaacggcccccctacgtaacttccgttaaagttcgggttacgaaccctaccgttaacccgaaaccgaacgggggtcccctaaccggttacgggcccaaccctccccggaagtaccccggttacgggtttaccggaacgggttaccggggtaccgtacggggttacgggggtaccgttaacgggggaaaccctacgggttaccccgtttcgaaccccgtttacctacccggaacccttaaggtaacccctagtttaaccccggaccgttcccggtaacgggaacccgttccggtaaaggtaaaccggttggttaacccgtttaggtaacccgttttaaggttttaaaccgttaccgttacgttaaacgtaacctacggttacccgttaacggggtaccggttccggggtacccgggtaacccggggttaccccgttaccgtttcccgggtaacccggttacgggaaacccgttaacggtcggttaaacttacgtaaccgtaaacggtaacggttacgggtacggtccggttaccgacccgttaacggtaccttaccgttaccgtaccttacgtcccttaccccg

SEQ ID NO: 9530 - DNA, 110 bp, Homo sapiens
  misc_feature: GYAE6OF01C7HQA.53.73.G07.1.454.CMB.1.raw
  modified_base (109)..(110): a, c, t, g, unknown or other
  misc_feature (109)..(110): n is a, c, g, or t
tcagcgcgtatacacacgaccggtgctcgatttagctctacgctcagggcacgaccggtgctcgatttagtgacatctcgcagttcttgagcggctgcaagcgcatagnn

SEQ ID NO: 9531 - DNA, 124 bp, Homo sapiens
  misc_feature: GYAE6OF01C6VRM.53.73.G07.1.454.CMB.1.raw
  modified_base (124)..(124): a, c, t, g, unknown or other
  misc_feature (124)..(124): n is a, c, g, or t
tcagcgcgtatacacacgaccggtgctcgattagctctacgctcagggcacgaccggtgctcgatttagtacgtcatcagggaagggtctacagtgctctgagcgggctggcaaggcgcatagn

SEQ ID NO: 9532 - DNA, 149 bp, Homo sapiens
  misc_feature: GYAE6OF01CQYSW.53.73.G07.1.454.CMB.1.raw
  modified_base (123)..(123): a, c, t, g, unknown or other
  misc_feature (123)..(123): n is a, c, g, or t
  modified_base (146)..(149): a, c, t, g, unknown or other
  misc_feature (146)..(149): n is a, c, g, or t
tcagcgcgtatacacacgaccggtgctcgatttagctctacgctcagggcacgaccggtgctcgatttagctctacgctcagggcacgaccggtgctcgatttagtatctgatagttgggttnagcggcgtgcgaagacgcatagnnnn

SEQ ID NO: 9533 - DNA, 140 bp, Homo sapiens
  misc_feature: GYAE6OF01BMPHV.53.73.G07.1.454.CMB.1.raw
  modified_base (140)..(140): a, c, t, g, unknown or other
  misc_feature (140)..(140): n is a, c, g, or t
tcagcgcgtatacacacgaccggtgctcgatttagctctacgctcagggcacgaccggtgctcgatttagtagtgtagattcgcggggatggcctccctcgagtctacagtgctctgagcgggctggcaaggcgcatagn

SEQ ID NO: 9534 - DNA, 139 bp, Homo sapiens
  misc_feature: GYAE6OF01CSRS8.53.73.G07.1.454.CMB.1.raw
  modified_base (139)..(139): a, c, t, g, unknown or other
  misc_feature (139)..(139): n is a, c, g, or t
tcagcgcgtatacacacgaccggtgctcgatttagctctacgctcagggcacgaccggtgctcgatttagagctcacgtattgggtttgggacgacacgcagtcgtgtctgatctgagcgggctggcaaggcgcatagn

SEQ ID NO: 9535 - DNA, 261 bp, Homo sapiens
  misc_feature: GYAE6OF01A22U1.53.73.G07.1.454.CMB.1.raw
  modified_base (251)..(261): a, c, t, g, unknown or other
  misc_feature (251)..(261): n is a, c, g, or t
tcagcgcgtatacacacgaccggtgctcgatttagctctacgctcagggcacgaccggtgctcgatttagcgagacgcgcagggcacgaccggtgctcggatttagctctacgctcagggcacgaccggtgctcggatttagctctacgctcagggcaagaccggtgctcgatttagatcgtctgtgttgggttggttagctaggactccggggtacgcactcgtctgagcgggctggcaaggcgcatagnnnnnnnnnnn

SEQ ID NO: 9536 - DNA, 112 bp, Homo sapiens
  misc_feature: GYAE6OF01CY2ZS.53.73.G07.1.454.CMB.1.raw
  modified_base (71)..(71): a, c, t, g, unknown or other
  misc_feature (71)..(71): n is a, c, g, or t
  modified_base (109)..(112): a, c, t, g, unknown or other
  misc_feature (109)..(112): n is a, c, g, or t
tcagcgcgtatacacacgaccggtgctcgatttagctctacgctcagggcacgaccggtgctcgatttagngacatctcgcagttcttgagcggctgcaagcgcatagnnnn

SEQ ID NO: 9537 - DNA, 113 bp, Homo sapiens
  misc_feature: GYAE6OF01EV9M2.53.73.G07.1.454.CMB.1.raw
  modified_base (113)..(113): a, c, t, g, unknown or other
  misc_feature (113)..(113): n is a, c, g, or t
tcagcgcgtatacacacgaccggtgctcgatttagctctacgctcagggcacgaccggtgctcgatttagtgacatctcgcagttctttgagcgggctggcaaggcgcatagn

SEQ ID NO: 9538 - DNA, 113 bp, Homo sapiens
  misc_feature: GYAE6OF01CX0TN.53.73.G07.1.454.CMB.1.raw
  modified_base (112)..(113): a, c, t, g, unknown or other
  misc_feature (112)..(113): n is a, c, g, or t
tcagcgcgtatacacacgaccggtgctcgatttagctctacgctcagggcacgaccggtgctcgatttagtgacatctcgcagttcttgagcggcgtgcgaagacgcatagnn

SEQ ID NO: 9539 - DNA, 184 bp, Homo sapiens
  misc_feature: GYAE6OF01CGS2Y.53.73.G07.1.454.CMB.1.raw
  modified_base (162)..(184): a, c, t, g, unknown or other
  misc_feature (162)..(184): n is a, c, g, or t
tcagcgcgtatacacacgaccggtgctcgatttagctctacgctcagggcacgaccggtgctcgatttagcagacgtctgtcgcgggctggcaaggcgcatagctgcctggtcaaggactacttcctcgtactgcgctgagcgggctggcaaggcgcatagnnnnnnnnnnnnnnnnnnnnnnn

SEQ ID NO: 9540 - DNA, 140 bp, Homo sapiens; identical to SEQ ID NO: 9533
  misc_feature: GYAE6OF01A0N4V.53.73.G07.1.454.CMB.1.raw
  modified_base (140)..(140): a, c, t, g, unknown or other
  misc_feature (140)..(140): n is a, c, g, or t

SEQ ID NO: 9541 - DNA, 169 bp, Homo sapiens
  misc_feature: GYAE6OF01ASNMK.53.73.G07.1.454.CMB.1.raw
  modified_base (107)..(107): a, c, t, g, unknown or other
  misc_feature (107)..(107): n is a, c, g, or t
  modified_base (149)..(169): a, c, t, g, unknown or other
  misc_feature (149)..(169): n is a, c, g, or t
tcagcgcgtatacacacgaccggtgctcgatttagctctacgctcagggcacgaccggtgctcgatttagctcgtacgctcagggcacgaccggtgctcgatttagngacatctcgcacgttcttgagcgggctggcaaggcgcatagnnnnnnnnnnnnnnnnnnnnn

SEQ ID NO: 9542 - DNA, 497 bp, Homo sapiens
  misc_feature: GYAE6OF01DI9GN.53.73.G07.1.454.CMB.1.raw
  modified_base (473)..(473): a, c, t, g, unknown or other
  misc_feature (473)..(473): n is a, c, g, or t
  modified_base (494)..(494): a, c, t, g, unknown or other
  misc_feature (494)..(494): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgattttgctaacttattactgccaacagtacaatactttgtggacgttcggccaagggaccaaggtgaaatcaaagaactgtggctgcncatctgtcttacatcttccgntac

SEQ ID NO: 9543 - DNA, 140 bp, Homo sapiens
  misc_feature: GYAE6OF01EWL5E.53.73.G07.1.454.CMB.1.raw
  modified_base (140)..(140): a, c, t, g, unknown or other
  misc_feature (140)..(140): n is a, c, g, or t
tcagcgcgtatacacacgaccggtgctcgatttagctctacgctcagggcacgaccggtgctcgatttagtagtgtagattcgcgggggatggcctccctcgagtctacagtgctctgagcggctggcaaggcgcatagn

SEQ ID NO: 9544 - DNA, 141 bp, Homo sapiens
  misc_feature: GYAE6OF01BQ3I9.53.73.G07.1.454.CMB.1.raw
  modified_base (141)..(141): a, c, t, g, unknown or other
  misc_feature (141)..(141): n is a, c, g, or t
tcagcgcgtatacacacgaccggtgctcgatttagctctacgctcagggcacgaccggtgctcgatttagtagtgtagattcgcgggggatggcctccctcgagtctacagtgctctgagcgggctggcaaggcgcatagn

SEQ ID NO: 9545 - DNA, 506 bp, Homo sapiens
  misc_feature: GYAE6OF01CD9FM.53.73.G07.1.454.CMB.1.raw
  modified_base (342)..(342): a, c, t, g, unknown or other
  misc_feature (342)..(342): n is a, c, g, or t
  modified_base (411)..(411): a, c, t, g, unknown or other
  misc_feature (411)..(411): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtgggtcccatcaaggttcagcggcagtggatcgngggacagagttcactctcaccattagcagcctgcagcctgatgattttgctaacttattactgaccaanagtacaattactttgtaggtacgttcggccgaagggaccaaggtaggaaatcaaacgatgtggctgcacatctgtcttacatccttccgcctacg

SEQ ID NO: 9546 - DNA, 110 bp, Homo sapiens
  misc_feature: GYAE6OF01BNDQ4.53.73.G07.1.454.CMB.1.raw
tcagcgcgtatacacacgaccggtgctcgatttagctctacgctcagggcacgaccggtgctcgatttagtgacatctcgcagttcttgagcggctggcaaggcgcatag

SEQ ID NO: 9547 - DNA, 150 bp, Homo sapiens
  misc_feature: GYAE6OF01EI8NF.53.73.G07.1.454.CMB.1.raw
  modified_base (147)..(150): a, c, t, g, unknown or other
  misc_feature (147)..(150): n is a, c, g, or t
tcagcgcgtatacacacgaccggtgctcgatttagctctacgctcagggcacgaccggtgctcgatttagctctacgctcagggcacgaccggtgctcgatttagtgacatctcgcagttcttgagcgggctggcaaggcgcatagnnnn

SEQ ID NO: 9548 - DNA, 501 bp, Homo sapiens
  misc_feature: GYAE6OF01BB4DI.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgattttgactaacttattactgccaacagtacaattactttgtggacgttcggaccaagggaccaaggtggaaatcaacgactgtggctgcaccatctgtcttcatcttcccgctac

SEQ ID NO: 9549 - DNA, 497 bp, Homo sapiens
  misc_feature: GYAE6OF01EX37R.53.73.G07.1.454.CMB.1.raw
  modified_base (406)..(406): a, c, t, g, unknown or other
  misc_feature (406)..(406): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttgcctggtatcagcagaaaccagggaaagcccctagactcctgatctataagacgtctactttagacagtgggtcccatcaaggttcagcggcagtggatctgggacagagttcactctcaccattagcagcctgcagcctgatgatttgcaacttattactgccaanagtacaatactttgtggacgttcggccaagggaccaaggtaggaaatcgaaacgactgtggctgcaccatctgtcttcatcttcccgctac

SEQ ID NO: 9550 - DNA, 553 bp, Homo sapiens
  misc_feature: GYAE6OF01D00BO.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgtattttgactaactttattactcgacccaactacgttaactaatttacgttttggtacgggtaccggtttccgggaccgaaaggggaacccgtaagggtaggaaaactacgaaaacggtaacgtaggtggctgacaccatctcgttcttcattcccttcccgcctacg

SEQ ID NO: 9551 - DNA, 146 bp, Homo sapiens
  misc_feature: GYAE6OF01A4C0M.53.73.G07.1.454.CMB.1.raw
tcagcgcgtatacacacgaccggtgctcgatttagctctacgctcagggcacgaccggtgctcgatttagctctacgctcagggcacgaccggtgctcgatttagtgacatctcgcagttcttgagcgggctggcaaggcgcatag

SEQ ID NO: 9552 - DNA, 135 bp, Homo sapiens
  misc_feature: GYAE6OF01BJ3XZ.53.73.G07.1.454.CMB.1.raw
  modified_base (135)..(135): a, c, t, g, unknown or other
  misc_feature (135)..(135): n is a, c, g, or t
tcagcgcgtatacacacgaccggtgctcgatttagctctacgctcaggggaccggtgctcgatttagacgacagctcagggcacgaccggtgctcgatttagcagacgtctgagcgggctggcaaggcgcatagn

SEQ ID NO: 9553 - DNA, 510 bp, Homo sapiens
  misc_feature: GYAE6OF01EC0IY.53.73.G07.1.454.CMB.1.raw
  modified_base (489)..(489): a, c, t, g, unknown or other
  misc_feature (489)..(489): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtataagacctggttggcctggtatcagcagaaaccagggaaagcccctagactcctgatctataagacgtctactttagacagtggggtcccatcaaggttcagcggcagtggatcgtgggacagagttcactctcaccattagcagcctgcagcctgatgattttgactaactttattactgaccaactagtacaattactttgtggtacgttcggaccaagggaccaaggtggaaatcaaacgtactgtggctagcaccatcngtcttacatcttcccgctacg

SEQ ID NO: 9554 - DNA, 510 bp, Homo sapiens
  misc_feature: GYAE6OF01EJ22X.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtataagacctggttggcctggtatcagcagaaaccagggaaagcccctagactcctgatctataagacgtctactttagacagtgggtcccatcaaggttcagcggcagtggatctgggacaggagttcactctcaccattagcagcctgcagcctgattgattttgctaacttattactgaccaacagtaacaatactttgtggacgttcggaccaagggaccaaggtaggaaatcaaacgaacgtgtaggctgcaccatctgttcttacattccttcccgctac

SEQ ID NO: 9555 - DNA, 160 bp, Homo sapiens
  misc_feature: GYAE6OF01BPXN1.53.73.G07.1.454.CMB.1.raw
  modified_base (140)..(160): a, c, t, g, unknown or other
  misc_feature (140)..(160): n is a, c, g, or t
tcagcgcgtatacacacgaccggtgctcgatttagctctacgctcagggcgacgaccggtgctcgatttagctctacgctcagggcacgaccggtgctcgagtttagcagacgtctgagcgggctggcaaggcgcatagnnnnnnnnnnnnnnnnnnnnn

SEQ ID NO: 9556 - DNA, 138 bp, Homo sapiens
  misc_feature: GYAE6OF01BFTLK.53.73.G07.1.454.CMB.1.raw
  modified_base (138)..(138): a, c, t, g, unknown or other
  misc_feature (138)..(138): n is a, c, g, or t
tcagcgcgtatacacacgaccggtgctcgatttagctctacgctcagggcacgaccggtgctcgatttagcgagacgcgcagggcacgaccggtgctcgatttatcagacgtctgagcgggctggcaaggcgcatagn

SEQ ID NO: 9557 - DNA, 139 bp, Homo sapiens
  misc_feature: GYAE6OF01CSQF4.53.73.G07.1.454.CMB.1.raw
  modified_base (138)..(139): a, c, t, g, unknown or other
  misc_feature (138)..(139): n is a, c, g, or t
tcagcgcgtatacacacgaccggtgctcgatttagctctacgctcagggcacgaccggtgctcgatttagcgagacgcgcagggcacgaccggtgctcgatttagcagacgtctgagcgggctggcaaggcgcatagnn

SEQ ID NO: 9558 - DNA, 114 bp, Homo sapiens
  misc_feature: GYAE6OF01AR6T9.53.73.G07.1.454.CMB.1.raw
  modified_base (110)..(114): a, c, t, g, unknown or other
  misc_feature (110)..(114): n is a, c, g, or t
tcagcgcgtatacacacgaccggtgctcgatttagctctacgctcagggcacgaccggtgctcgatttagtgacatctcgcagttctgagcggctggcaaggcgcatagnnnnn

SEQ ID NO: 9559 - DNA, 154 bp, Homo sapiens
  misc_feature: GYAE6OF01DLXVN.53.73.G07.1.454.CMB.1.raw
  modified_base (153)..(154): a, c, t, g, unknown or other
  misc_feature (153)..(154): n is a, c, g, or t
tcagcgcgtatacacacgaccggtgctcgatttagctctacgctcagggcacgaccggtgctcgatttagtctagcgacttccgcgggctggcaaggcgcatcttcccgccatctgatcgtactgcgctgagcgggctggcaaggcgcatagnn

SEQ ID NO: 9560 - DNA, 605 bp, Homo sapiens
  misc_feature: GYAE6OF01BT4L1.53.73.G07.1.454.CMB.1.raw
  modified_base (226)..(226): a, c, t, g, unknown or other
  misc_feature (226)..(226): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtnttaagacctggttggcctggtatcagcagaaaccgagggaaacgccctagactcctgatctataagacgtctactttagacaggtcgggtccatcgaaggttcagcggcagtggatcgtgggacagagttcactctacacctattagcagcctgcagcctgatgtattttgactaactttattactcgacctaagtaacgttactaaacttacgtttcggtagggtaccgttacgggaccgtaaacggggtacctaagggttacggaaaactaccgaaaaccgggtaacgtagggttacgggaccgttaggacctaacccgtagtttacccgttcggttaccctttactaacccgttcccgtttacccccgccttaacg

SEQ ID NO: 9561 - DNA, 147 bp, Homo sapiens
  misc_feature: GYAE6OF01BXCOO.53.73.G07.1.454.CMB.1.raw
  modified_base (147)..(147): a, c, t, g, unknown or other
  misc_feature (147)..(147): n is a, c, g, or t
tcagcgcgtatacacacgaccggtgctcgatttagctctacgctcagggcacgaccggtgctcgatttagctctacgctcagggcacgaccggtgctcgatttagtgacatctcgcagttcttgagcgggctggcaaggcgcatagn

SEQ ID NO: 9562 - DNA, 140 bp, Homo sapiens
  misc_feature: GYAE6OF01AWR5A.53.73.G07.1.454.CMB.1.raw
  modified_base (138)..(140): a, c, t, g, unknown or other
  misc_feature (138)..(140): n is a, c, g, or t
tcagcgcgtatacacacgaccggtgctcgatttagctctacgctcagggcacgaccggtgctcgatttagctctacgctcagggcacgaccggtgctcgatttagcagacgtctgagcgggctggcaaggcgcatagnnn

SEQ ID NO: 9563 - DNA, 505 bp, Homo sapiens
  misc_feature: GYAE6OF01BA77F.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgtattttgctaacttattactgccaacagtacaattactttgtaggtacgttcggaccaagggaccaaggtagaaatcgaaacgactgtggctgcaccatctgtcttacatctccgctacg

SEQ ID NO: 9564 - DNA, 147 bp, Homo sapiens; identical to SEQ ID NO: 9561
  misc_feature: GYAE6OF01B190M.53.73.G07.1.454.CMB.1.raw
  modified_base (147)..(147): a, c, t, g, unknown or other
  misc_feature (147)..(147): n is a, c, g, or t

SEQ ID NO: 9565 - DNA, 550 bp, Homo sapiens
  misc_feature: GYAE6OF01DPH0F.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacgttgccgggccagaccaaagtattaagacctggttggcctggtatcagcaagaaaccagggaaacgccctagactcctgatctataagacgtctactttagactagtggggtcccatcaaggtcagcgcagtggatcgtgggacagtagttcactctcactattagcagcctgcagcctgattgtattttgactaactttattaccgtgacctaactagtaactaagttactttgtcggtaccggtttacgggaccgaaagggacccaagggtaggaaaactacgaaaacgagttggtacggtctagaccactattctgttaccttcatttcctccccgctacg

SEQ ID NO: 9566 - DNA, 499 bp, Homo sapiens
  misc_feature: GYAE6OF01CEHDH.53.73.G07.1.454.CMB.1.raw
  modified_base (475)..(475): a, c, t, g, unknown or other
  misc_feature (475)..(475): n is a, c, g, or t
tcagcgcgtatacacacgaccggtgctcgatttagctctacgctcagggggagtcagacccagtcaggacacagcatggacatgagggtccccgctcagctcctggggctcctgctgctctgactcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgattttgctaacttattactgccaacagtacaatactttgtagtacgttcggccaagggaccaaggtggaaatcaaacgactgtggctgcncatctgtcttcatcttcccgctac

SEQ ID NO: 9567 - DNA, 781 bp, Homo sapiens
  misc_feature: GYAE6OF01CAXX5.53.73.G07.1.454.CMB.1.raw
  modified_base (192)..(192): a, c, t, g, unknown or other
  misc_feature (192)..(192): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcactctggtcgganacgagtacgtcctaccgtactacgttcggcccggaccgacgaaccgtaaagttaagtaaccgtaccggttgggttcggtccgttaggtactcgacgacaaacgaaaccggaagggaaccgtccccgtaagtacccttccgtagactactaagtaacgtccgtactttaacgttagacgtagggttccgggtaccctaagtacggtaacggttccgaacgggtccggacgtaggtacggtacttacgggtacgggaactaaggttacgttacctaccttcctacccaaccttaagttacgacgtaaccgtcccgtaggaccgtaccgtccgtagtagttacgtttacgtttcgaacctttaactttaactttacgtacccgaacctaacgtaacgttaaactaaacgttttacgttttagggaaccgggtttaacccggtcccgggtaaaccggtaaacgggtaacccgtaaggggtaacgaaactaacccggtaaaacgtacggttacgggacgtccgtagaccctaaccgtacgttccgttacgtttccttaacgttaccgtttcccccgttaccccgacgttaaccg

SEQ ID NO: 9568 - DNA, 140 bp, Homo sapiens
  misc_feature: GYAE6OF01EVTNB.53.73.G07.1.454.CMB.1.raw
  modified_base (70)..(70): a, c, t, g, unknown or other
  misc_feature (70)..(70): n is a, c, g, or t
  modified_base (104)..(104): a, c, t, g, unknown or other
  misc_feature (104)..(104): n is a, c, g, or t
  modified_base (108)..(109): a, c, t, g, unknown or other
  misc_feature (108)..(109): n is a, c, g, or t
  modified_base (111)..(111): a, c, t, g, unknown or other
  misc_feature (111)..(111): n is a, c, g, or t
  modified_base (113)..(140): a, c, t, g, unknown or other
  misc_feature (113)..(140): n is a, c, g, or t
tcagcgcgtatacacacgaccggtgctcgatttagctctacgctcagggcacgaccgtgctcgatttagngacatctcgcagttcttgagcggctgcaagcgcntagnncngnnnnnnnnnnnnnnnnnnnnnnnnnnnn

SEQ ID NO: 9569 - DNA, 514 bp, Homo sapiens
  misc_feature: GYAE6OF01C7TX6.53.73.G07.1.454.CMB.1.raw
  modified_base (391)..(391): a, c, t, g, unknown or other
  misc_feature (391)..(391): n is a, c, g, or t
  modified_base (477)..(477): a, c, t, g, unknown or other
  misc_feature (477)..(477): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtgggtcccatcaaggttcagcggcagtggatctgggacagagttcactctcaccattagctagcctgcagcctgatgatttgntaacttattactgaccaactagtaacaattactttagtggtaccgttcggaccaagggaccaaggtaggaaatcaaaagacctagnggactgacaccgatctgtcttacatcctcccgctacg

SEQ ID NO: 9570 - DNA, 113 bp, Homo sapiens; identical to SEQ ID NO: 9538
  misc_feature: GYAE6OF01BAHQN.53.73.G07.1.454.CMB.1.raw
  modified_base (112)..(113): a, c, t, g, unknown or other
  misc_feature (112)..(113): n is a, c, g, or t

SEQ ID NO: 9571 - DNA, 191 bp, Homo sapiens
  misc_feature: GYAE6OF01DRN9Z.53.73.G07.1.454.CMB.1.raw
  modified_base (141)..(141): a, c, t, g, unknown or other
  misc_feature (141)..(141): n is a, c, g, or t
  modified_base (182)..(191): a, c, t, g, unknown or other
  misc_feature (182)..(191): n is a, c, g, or t
tcagcgcgtatacacacgaccggtgctcgatttagctctacgctcagggcacgaccggtgctcgatttagctctacgctcagggcacgaccggtgctcgatttagctctacgctcagggcacgaccggtgctcgatttagngacatctcgcagttcttgagcggcgtgcgaaggcgcatagnnnnnnnnnn

SEQ ID NO: 9572 - DNA, 178 bp, Homo sapiens
  misc_feature: GYAE6OF01C4VS0.53.73.G07.1.454.CMB.1.raw
  modified_base (175)..(178): a, c, t, g, unknown or other
  misc_feature (175)..(178): n is a, c, g, or t
tcagcgcgtatacacacgaccggtgctcgatttagctctacgctcagggcacgaccggtgctcgatttagctctacgctcagggcacgaccggtgctcgatttagtagtgtagattcgcgggggatggcctcctcgagtctacagtgctctgagcgggctggcaaggcgcatagnnnn

SEQ ID NO: 9573 - DNA, 163 bp, Homo sapiens
  misc_feature: GYAE6OF01E2RNL.53.73.G07.1.454.CMB.1.raw
  modified_base (163)..(163): a, c, t, g, unknown or other
  misc_feature (163)..(163): n is a, c, g, or t
tcagcgcgtatacacacgaccggtgctcgatttagctctacgctcagggcacgaccggtgctcgatttagctctacgctcagggcacgaccggtgctcgatttagtacacgtgattagggattgggtacgcactcgtctgagcgggctggcaaggcgcatagn

SEQ ID NO: 9574 - DNA, 149 bp, Homo sapiens
  misc_feature: GYAE6OF01CIEZN.53.73.G07.1.454.CMB.1.raw
  modified_base (106)..(106): a, c, t, g, unknown or other
  misc_feature (106)..(106): n is a, c, g, or t
  modified_base (146)..(149): a, c, t, g, unknown or other
  misc_feature (146)..(149): n is a, c, g, or t
tcagcgcgtatacacacgaccggtgctcgatttagctctacgctcagggcacgaccggtgctcgatttagctctacgctcagggcacgaccggtgctcgatttagngacatctcgcagttcttgagcggctggcaaggcgcatagnnnn

SEQ ID NO: 9575 - DNA, 109 bp, Homo sapiens
  misc_feature: GYAE6OF01A39QR.53.73.G07.1.454.CMB.1.raw
tcagcgcgtatacacacgaccggtgctcgatttagctctacgctcagggcacgaccggtgctcgatttagtgacatctcgcagttctgagcggctggcaaggcgcatag

SEQ ID NO: 9576 - DNA, 136 bp, Homo sapiens
  misc_feature: GYAE6OF01CY9DM.53.73.G07.1.454.CMB.1.raw
  modified_base (136)..(136): a, c, t, g, unknown or other
  misc_feature (136)..(136): n is a, c, g, or t
tcagcgcgtatacacacgaccggtgctcgatttagctctacgctcagggcacgaccggtgctcgatttagtacacgtgattagggattgggtgatagggtaggcactcgtctgagcgggctggcaaggcgcatagn

SEQ ID NO: 9577 - DNA, 505 bp, Homo sapiens
  misc_feature: GYAE6OF01EZEU4.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacaggcccctggacaggggcttgagtggatgggtctaatcaaccctagtggtggatctacaagttactcacagagaatgcagggccgaattaccatgaccagagacacgtccacgagtacagtctacatggaggtgagcagcctgagatcgtgaggacacggccagtgtattactgtgcgtattcttagtggtaattacgaacttactaattattttgtcagtacccg

SEQ ID NO: 9578 - DNA, 554 bp, Homo sapiens
  misc_feature: GYAE6OF01CTO7C.53.73.G07.1.454.CMB.1.raw
  modified_base (355)..(355): a, c, t, g, unknown or other
  misc_feature (355)..(355): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccggccagccaaagtattaagacctggttcggcctggtatcagcaagaaaccagggaaagcccctagactcctgatactataagacgtctactttagacagtgggtacccatcaaggttcaagcggcagtggatcgtgggacaagngttcactctacacctattagcagcctgcagcctgatgtattttgactaactttattactcgacctaactagtaactaatttacgtttgtacgggtacgttccggaccgaagggaacctaagggtacgaaactacgaaacgtacgtagtacggtacgtagacctaccatcttagtccttacacttccgtcccgtcctacg

SEQ ID NO: 9579 - DNA, 507 bp, Homo sapiens
  misc_feature: GYAE6OF01BHMKG.53.73.G07.1.454.CMB.1.raw
  modified_base (500)..(500): a, c, t, g, unknown or other
  misc_feature (500)..(500): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacaggcccctggacaggggcttggagtggatgggtctaatcaaccctagtggtggatctacaagttactcacagagaatgcagggccaattaccatgaccagagacacgtccacgagtacagtctacatggaggtgagcagcctgagatagtgaggacacggccatgtattacgtgtgcgtattgttaggtggtaattacgaactaactaattattttgtcgngtacccg

SEQ ID NO: 9580 - DNA, 631 bp, Homo sapiens
  misc_feature: GYAE6OF01BY7RR.53.73.G07.1.454.CMB.1.raw
  modified_base (230)..(230): a, c, t, g, unknown or other
  misc_feature (230)..(230): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagccgtggggcctgagtgatgtatttccngcacgacatcgtggaactaccaccttccaccgtaccttcccttatactagttcgggtaaccgacgaccggccccgtggacgaggggtcttaggaggtaggtagtgggtactaacgtaccgtaacccgtaggtggtaggtactaccgtaacgtaaagtttacctacgaagaaggaagaacgtgacgacgggacctaaattaccgaagtacgaaccaaggacgaccgtaccgtaccaacgaacgtaacgagtacaacgtagtagggagtagacgcgagccgtagagatcgaggaacggaccgacgacctagttagttattacgtgtacgtacgtagttacgttaggtagtaacgtttaactaacgttaacttaagtttagtttacgtccggtaacgtacccgg

SEQ ID NO: 9581 - DNA, 140 bp, Homo sapiens; identical to SEQ ID NO: 9562
  misc_feature: GYAE6OF01EBAXA.53.73.G07.1.454.CMB.1.raw
  modified_base (138)..(140): a, c, t, g, unknown or other
  misc_feature (138)..(140): n is a, c, g, or t

SEQ ID NO: 9582 - DNA, 162 bp, Homo sapiens
  misc_feature: GYAE6OF01AYH76.53.73.G07.1.454.CMB.1.raw
  modified_base (124)..(124): a, c, t, g, unknown or other
  misc_feature (124)..(124): n is a, c, g, or t
  modified_base (152)..(162): a, c, t, g, unknown or other
  misc_feature (152)..(162): n is a, c, g, or t
tcagcgcgtatacacacgaccggtgctcgatttagctctacgctcagggcacgaccggtgctcgatttagctctacgctcagggcacgaccggtgctcgatttagcagtactgcgttgggttcngaggcggcgtggacgaggcgacagtagnnnnnnnnnnn

SEQ ID NO: 9583 - DNA, 582 bp, Homo sapiens
  misc_feature: GYAE6OF01A56PV.53.73.G07.1.454.CMB.1.raw
  modified_base (266)..(266): a, c, t, g, unknown or other
  misc_feature (266)..(266): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtataagacctggttgcctggtatcagcagaaaccagggaaancccctagactcctgatctataagacgtctactttagacagtcgggtccatcaaggttcagcggcagtggatcgtgggacagagttcactctcacattagcagcctgcagcctagatgtatttgacctaactttattacctgacccaatagtaactaattacgttttgtacggtaccggtttcgggaacctaaaggggacctaagggtacgaaactacgaaaaccggtacgtacggtacgggaccttacgaccgtaaccctacgttaccgttacggttcctttacctaactttccccgttacccccgcctttaaccg

SEQ ID NO: 9584 - DNA, 504 bp, Homo sapiens
  misc_feature: GYAE6OF01BDNOK.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattggtacgacaggcccctggacaggggcttgagtggatgggtctaatcaaccctagtggtggatctacaagttactcacagagaatgcgagggccgaattaccatgacagagacacgtccacgagtacagtctacatggaggtagagcacgcctgagatcgtgaggacacggccatgtattactgtgacgtattgttagtggattacgactactaattattttcgtgcgtacccg

SEQ ID NO: 9585 - DNA, 501 bp, Homo sapiens
  misc_feature: GYAE6OF01CDZOP.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttgcctggtatcagcagaaaccagggaaagcccctagactcctgatctataagacgtctactttagacagtggggtcccatcaaggttcagcggcagtggatctgggacagagttcactctcacattagcagcctgcagcctgatgattttgctaacttattactcgaccaacagtactaatactttgtggtacgttcgaccgtaaggaccaaggtgaaatcgaaacgactagtggctagcacatctgtctcatcctccgctac

SEQ ID NO: 9586 - DNA, 140 bp, Homo sapiens; identical to SEQ ID NO: 9562
  misc_feature: GYAE6OF01AV6YW.53.73.G07.1.454.CMB.1.raw
  modified_base (138)..(140): a, c, t, g, unknown or other
  misc_feature (138)..(140): n is a, c, g, or t

SEQ ID NO: 9587 - DNA, 502 bp, Homo sapiens
  misc_feature: GYAE6OF01A6M7J.53.73.G07.1.454.CMB.1.raw
  modified_base (347)..(347): a, c, t, g, unknown or other
  misc_feature (347)..(347): n is a, c, g, or t
  modified_base (495)..(495): a, c, t, g, unknown or other
  misc_feature (495)..(495): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacacggcccctggacaggggcttgagtggatgggtctaatcaaccctagtggtggatctacaagttacncacagagaatgcagggccgaattaccatcgaccagagacacgtccacgagtacagtcacatggagtgagcagcctgagatcgtgaggacacggcatgtattactgtgcgtatcttaggtggtattacgaactactaattatttgtcgngtacccg

SEQ ID NO: 9588 - DNA, 507 bp, Homo sapiens
  misc_feature: GYAE6OF01CBKRV.53.73.G07.1.454.CMB.1.raw
  modified_base (474)..(474): a, c, t, g, unknown or other
  misc_feature (474)..(474): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatcgtgggacagagttcactctcacattagcagcctgcagcctgatgattttgactaactttattactgacctaacagtaactaattactttgtggtacgttcggaccaagggaccaaggtagaaatcaaacgacngtgctgctacatctgtcttcatcttcccgctac

SEQ ID NO: 9589 - DNA, 542 bp, Homo sapiens
  misc_feature: GYAE6OF01BOTEJ.53.73.G07.1.454.CMB.1.raw
  modified_base (230)..(230): a, c, t, g, unknown or other
  misc_feature (230)..(230): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttccngcacgacatctggatacaccttcaccgactcccttatacattgggtacacacggcccctggacaggggcttggagtggatgggtctaatcaaccctagtggtggatctacaagttactcacagagaatgcgagggccgaattaccatcgacagagacacgtccacgagtacagtctacagtggaggtgagcagccgtgagatcgtagacggacgacggcctatcgttattactgtacgtacgtagttacgttaaggtggtaacttaaccggaacttaacgtaatttagtttttcgtacgtacggtaacccgg

SEQ ID NO: 9590 - DNA, 553 bp, Homo sapiens
  misc_feature: GYAE6OF01EMPUG.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctggtcggagacagagtcaccgtcacttgccgggccagccaaagtattaagacctggttggcctggtatcagcaagaaaccaggggaaacgccctagactcctgatctataagacgttctactttagacaggtgggtcccatacaaggttcagcggcaggtgatctgggacagagttcactctacacctattagcagcctgcagcctagatgtatttgactaactttattactgacctaatagtaactaagttactttggtacggtacgttcgggaccgtaaagggaccgtaaggtacggtaaactacgaaaacgtacgtaggtggtacgtagactaccactctcgtaccttacacttccttccccgctacg

SEQ ID NO: 9591 - DNA, 556 bp, Homo sapiens
  misc_feature: GYAE6OF01BC01M.53.73.G07.1.454.CMB.1.raw
  modified_base (267)..(267): a, c, t, g, unknown or other
  misc_feature (267)..(267): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctatctgcatctgtcggagacagagtcaccgtcacttgccgggccagccaaagtattaagacctggttggcctggtatcagcagaaaccaggaaanccctagactcctgatctataagacgtctactttagacagtgggtcccatcaaggttcagcggcagtggatcgtgggcagagttcactctcaccattagcagcctgcagcctagatcgtattttgactaactttattactgacctaacagttacaattacgtttgtacggtacgttacggaccgaaagggacctaagggtagaaaacgtacgaaaaccggtactcggtaggccttaggaccctaaccgacgttcctacgttccgttctaacttcccttccccgccttaac

SEQ ID NO: 9592 - DNA, 570 bp, Homo sapiens
  misc_feature: GYAE6OF01CQX3U.53.73.G07.1.454.CMB.1.raw
  modified_base (342)..(342): a, c, t, g, unknown or other
  misc_feature (342)..(342): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtgggtcccatcaaggttcagcggcagtggatcgngggacagagttcactctcaccattagcagcctgcagcctgattgattttgactaacttattaactgaccaatagtaactaagttacttttggacggtaccgtttccgggaccgtaaaggggtaccctaaagggtggaaaacttaccgaaaacgtaacgttggtacggcctaggacctacccgtattccgttcgttacctttactactttcccttcccggcccttaacg

SEQ ID NO: 9593 - DNA, 111 bp, Homo sapiens
  misc_feature: GYAE6OF01BCKXK.53.73.G07.1.454.CMB.1.raw
  modified_base (111)..(111): a, c, t, g, unknown or other
  misc_feature (111)..(111): n is a, c, g, or t
tcagcgcgtatacacacgaccggtgctcgatttagctctacgctcagggcacgaccggtgctcgatttagtatctgatagttgggtctgagcggctggcaaggcgcatagn

SEQ ID NO: 9594 - DNA, 532 bp, Homo sapiens
  misc_feature: GYAE6OF01ENBP8.53.73.G07.1.454.CMB.1.raw
  modified_base (226)..(226): a, c, t, g, unknown or other
  misc_feature (226)..(226): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtnttaagacctggttggcctggtatcagcagaaaccagggaaagcccctagacctcctgatctataagacgtctactttagacaggtgggtcccatcaaggttcagcggcagtggatcgtgggacagagttcactctcaccattacgcagcctgcagcctgatgtattttgactaactttattactgacctaacagttaacaattactttggtacggtacgttcgggaccgaagggaccctaaagggtgaaaatcaaaacgtacgtagtggactgcctaccatctcgttcttcattccttcccgctac

SEQ ID NO: 9595 - DNA, 570 bp, Homo sapiens
  misc_feature: GYAE6OF01DGP4C.53.73.G07.1.454.CMB.1.raw
  modified_base (269)..(269): a, c, t, g, unknown or other
  misc_feature (269)..(269): n is a, c, g, or t
  modified_base (414)..(414): a, c, t, g, unknown or other
  misc_feature (414)..(414): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaacnccctagactcctgatctataagacgtctactttagacagtgggtcccatcaaggttcagcggcagtggatctgggacagagttcactctcacctattacgctagcctgcagcctgatgtatttgactaacttattactgaccaanacgttaactaattactttgtaggtaccgttcgggaccgaagggacctaagggtagaaactaccgaaaacgtaaacgttggtacggtccgtagacctaacccgtattccgttacggttacctttacctaactttccccgttacccggtcccttaacg

SEQ ID NO: 9596 - DNA, 700 bp, Homo sapiens
  misc_feature: GYAE6OF01CXT76.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgtatttcctgcacgacatctggactacaccttcaccgtactcccttatacagttggtacgacacggccccgtggacgaggggcttggaggtggagtgggtactaactaccgaaccgtaggtgggtaggacttccgtaactaaagtttactacaacgtaaggaagaagtcggacgtaacggggaaccgtaaatttaccccgaagttacggaaccgaacggacgtaaccgaaccgttacccgaacggtaacgttaacgaacgtacctaacgaaggttcgggaggtacggaaggtccgacggtacccgtaggaacgtacgttacggtagggaacgggaacccgaaccgggtacctaagttacggttaactttaacgtggttacggtacgttaagtttaccggtttaaggttacgggttaaccgtttaaacgtacgttaaacttaagttttaacgtttttacgaccgtacggtaaccccgg

SEQ ID NO: 9597 - DNA, 533 bp, Homo sapiens
  misc_feature: GYAE6OF01A8ARB.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgactcccttatacattggtacgacacggcccctggacaggggcttggagtggatgggtctaatccaaccgtagtggtagatactacgtaagttactcacagagaatgacgagggacctaattaccagtcgaccagacgacacgtacgacgagtacacgtctacagtggagtgagcagctagagatcgtaggacgacacggccagtgtattacgtgtgcgtatcgttaggtcggtattaacgacttaactaatttagtttcgtacgtacggtaaccg

SEQ ID NO: 9598 - DNA, 505 bp, Homo sapiens
  misc_feature: GYAE6OF01AYQRJ.53.73.G07.1.454.CMB.1.raw
  modified_base (479)..(479): a, c, t, g, unknown or other
  misc_feature (479)..(479): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagccctagactcctgatctataagacgtctactttagacagtgggtccatcaaggttcagcggcagtggatctgggacagagttcactctcacattagcagcctgcagcctgatgattttgctaacttattactgaccaacagtaacaattactttgtaggtacgttcgggccaaagggaccaaggtagaaatcaaacgactgtaggctgacnccatctgtcttcatccttcccgctac

SEQ ID NO: 9599 - DNA, 190 bp, Homo sapiens
  misc_feature: GYAE6OF01D32L1.53.73.G07.1.454.CMB.1.raw
  modified_base (184)..(190): a, c, t, g, unknown or other
  misc_feature (184)..(190): n is a, c, g, or t
tcagcgcgtatacacacgaccggtgctcgatttagctctacgctcagggcacgaccggtgctcgatttagctctacgctcagggcacgaccggtgctcgatttagctctacgctcaggctacgtaccggtgcgtcgatttagtgacatctcgcagttcttgagcgggctggcaaggcgcatagnnnnnnn

SEQ ID NO: 9600 - DNA, 140 bp, Homo sapiens; identical to SEQ ID NO: 9562
  misc_feature: GYAE6OF01AIYVW.53.73.G07.1.454.CMB.1.raw
  modified_base (138)..(140): a, c, t, g, unknown or other
  misc_feature (138)..(140): n is a, c, g, or t

SEQ ID NO: 9601 - DNA, 508 bp, Homo sapiens
  misc_feature: GYAE6OF01A5PH3.53.73.G07.1.454.CMB.1.raw
  modified_base (346)..(346): a, c, t, g, unknown or other
  misc_feature (346)..(346): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttacncacagagaatgcagggccaattaccatacgacagacgacacgtccacgagtacagtctacagtggaggtgagcagcctgagatcgagaggacacggaccatgtattacgtgtgcgtatcttaggtggtaattacgacttaactaattattttgcacgacccg

SEQ ID NO: 9602 - DNA, 507 bp, Homo sapiens
  misc_feature: GYAE6OF01EPL6D.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgtatttgactaacttattactgaccaacagtaacaatactttgtaggtacgttcggaccgaagggacaaggtagaaatacgaaacgactgtggctgcacatctgtcttacatcttcccgctac

SEQ ID NO: 9603 - DNA, 547 bp, Homo sapiens
  misc_feature: GYAE6OF01ECOFH.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagaccaaagtattaagacctggttgcctggtatcagcagaaaccagggaaagcccctagactcctgatctaataagacgtctactttagacagtgggtcccatcaggttcagcggcagtggatcgtgggacaggtagttcacgtctcacctattagcacgcctgcacgcctgtatgtattttgactaactttattactgtaccaacagtacaattactttgtcggtacggtttcggaccgtaaggggacctaagggtaggaaactacgaaaacggtacgtggtaggcctagactacctatcctgttccttactattcccttcccgcctacg

SEQ ID NO: 9604 - DNA, 139 bp, Homo sapiens
  misc_feature: GYAE6OF01CTY16.53.73.G07.1.454.CMB.1.raw
  modified_base (138)..(139): a, c, t, g, unknown or other
  misc_feature (138)..(139): n is a, c, g, or t
tcagcgcgtatacacacgaccggtgctcgatttagctctacgctcagggcacgaccggtgctcgattagctctacgctcagggcacgaccggtgctcgatttagcagacgtctgtcgcgggctggcaaggcgcatagnn

SEQ ID NO: 9605 - DNA, 508 bp, Homo sapiens
  misc_feature: GYAE6OF01DZ0TK.53.73.G07.1.454.CMB.1.raw
  modified_base (500)..(500): a, c, t, g, unknown or other
  misc_feature (500)..(500): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcagggccgaattaccatgacagagacacgtcacgagtacagtctacatggagtgagcagcctgagatctagacggacacggaccattagtattacgtgtagcgtatcttaaggtggtattacgactaactaattattttcgcngtaccccg

SEQ ID NO: 9606 - DNA, 515 bp, Homo sapiens
  misc_feature: GYAE6OF01A3TOC.53.73.G07.1.454.CMB.1.raw
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaacgcccctagactcctgatctataagacgtctactttagacagtcggggtcccatcaaggttcagcggcagtggatcgtggacagagttcactctcacattagcagcctgcagcctgatgtatttgactaacttattactcgaccaactagtaactaattacgtttgtacggtacgttacggaccgaagggaccaaggtacgaaatacgaaagacgtgtgcgtncacntctgtctcatcctccgctacg

SEQ ID NO: 9607 - DNA, 537 bp, Homo sapiens
  misc_feature: GYAE6OF01D4UHI.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaacgcccctagactcctgatctataagacgtctactttagacagtgggtcccatcaaggttcagcggcagtggatcgtgggacagagttcactctcaccattacgcagcctgcagcctgatgtattttgactaacttattactgaccaacagtaactaattactttggtaggtacgttcggaccgtaacgggaccgtaaggtagaaacgtacgaaacgtaacgtaggtacggctgactaccatcttcgtcttacattcccttcccgcctacg

SEQ ID NO: 9608 - DNA, 559 bp, Homo sapiens
  misc_feature: GYAE6OF01ERB74.53.73.G07.1.454.CMB.1.raw
  modified_base (232)..(232): a, c, t, g, unknown or other
  misc_feature (232)..(232): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcccgctcccaggtgcagctggtacaagtcggggctgagatgaagaagccgtggggcctcagtgatgatttccngcacgacatctgatacaccttcaccgtactcccttatactagttcgggtacgacgacggccccgtggacgaggggtcttggaggtggagtgggtactaatcaacccgtagtggtgatctataagttactcacagagaatgcgagggaccaatacatacgacagttttagacacgtaccacgagtacacgtactacagtaggaggtagagacgacgccgtgagatcgtagacggacgacgaccgagtgttagttacgttgtagtacgtacgttagttaggtggtacgttacgtaacttaactaattattttagttcgtacggtacccg

SEQ ID NO: 9609 - DNA, 565 bp, Homo sapiens
  misc_feature: GYAE6OF01BS4VX.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgatcgctcccaggtgcagctggtacaagtcgggggctgagatgaagaagccgtggggcctcagtgatgatttctgcacgacatctggatacaccttcaccgactcccttatacattgggtacacgacggcccctggacgaggggcttggaggtggagtgggtctaatcaacccgtagtggtggatctaagaagttactcgacagagaagtgcgagggcctaattaccagtacgacgagacgaacgacgtaccgacgtaacgtacacgtactacgagtggaggtgacgcacgtccgtgagtatccgtaggaacggacacggacctagtagtagttacgtggtagtaccgtattcgttaggtcggtaattaaccgaacttactaatttattttacgtcgacggtaccccgg

SEQ ID NO: 9610 - DNA, 539 bp, Homo sapiens
  misc_feature: GYAE6OF01DVDH2.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagaccaaagtattaagacctggttggcctggtatcagcagaaaccagggaaacgccctagactcctgatctataagacgtctactttagacagtgggtcccatcaaggttcagcggcagtggatcgtgggacagacgttcactctcacattagcagcctgcagcctgatgatttgactaactttattactgaccaactacgtaactaacttactttcggtaggtaccgtttcgggaccgaaaggggacccaagggtaggaaaatccgaaacgtaacgtggtaggctgacacctatctacgttcttacattccttcccgctacg

SEQ ID NO: 9611 - DNA, 529 bp, Homo sapiens
  misc_feature: GYAE6OF01CMKU0.53.73.G07.1.454.CMB.1.raw
  modified_base (236)..(236): a, c, t, g, unknown or other
  misc_feature (236)..(236): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagcctggggcctcagtgatgatttcctgcacganatctggatacaccttcaccgactccctatacattgggtacacacggcccctggacaggggcttgagtggatgggtactaatcaacctagtggtggatctacaagttactcacagagaatgcagggacaattaccatgaccagagacacgtaccacgagtacagtctacagtggagtgagcagcctgagatcgtaggacgacacggaccagtagttacttacgtggtcgacgtacttagttaggtggtaacttaacgtactaactaagtttattttcgacgtacggtaacccgg

SEQ ID NO: 9612 - DNA, 616 bp, Homo sapiens
  misc_feature: GYAE6OF01CL5LC.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccacctgtctgcatctgtcggagacagagtcaccgtcacttgccggccagccaaagtattaagacctggttgcctggtatcagcaagaaaccagggaacgccctaagacctcctgatactataagacgtactactttagacgtagtcgggtaccctagtacaaggttcagcggacagtggatcgtagggacagtagtcactctacactattagctagctagcaacgtcctagattgtatttcgacttaactttattaaccgtgaaccctaacgtaagttaactaaatttacgttttacggtagggttaaccgtttccgggaaccgtaaagggtaaccgtaaaggggttacggaaaacttacgaaaacggtaaactggtacggtactcggaacctaaccgtacgttcgtacgtttacctttacacgttttcccctccccggtacttaaccg

SEQ ID NO: 9613 - DNA, 720 bp, Homo sapiens
  misc_feature: GYAE6OF01DGR8M.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatcgtgtcggagacagacgtcaccgtcaccgttcggccgggccagacctaaagttattaagaccgttgggttcggccttggtatcgagacaagaaaccgaggaacgtcccctagaccttcctagactctaagtaacgtacgttactaacgtttacgacgtacggtcgggtaccctagtacgtaaggttcacgtcggactaggtaggacgtcgtagggactagtacgttaccgacgttacctacctactagttacgactacggtcctcgaccgtaacggtccgttaggtacttacggttacttttacggaccttaaacctttagttaaccctacggtaaccctaaacgtaacgtttaactaacgtttacgtttacggtaacgggttaccggttacgggtaacccgtaaaggggtacccgtaaaggggttacggaaaacttaccggaaaaccggtacgttacggtacggttccgtaggaccctaccgttacttaccggttaccgttccttacgtaacccttcccgttacccggacttaccgg

SEQ ID NO: 9614 - DNA, 547 bp, Homo sapiens
  misc_feature: GYAE6OF01DP40X.53.73.G07.1.454.CMB.1.raw
  modified_base (354)..(354): a, c, t, g, unknown or other
  misc_feature (354)..(354): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagccgtggggcctcagtgatgatttcctgcacgacatctgatacaccttcaccgacttccttatactattgggtacgacacggcccctggacgaggggcttggagtggagtgggtactaatcaaccgtagtggtgatctaactaagttactnacagagaatgcaggaccgaattacagtcgacaagacgaacacgtaccacgagtaacagtctacgatggaggtgagacgacgtccgtagaagatacgtaggacgacgacggaccagttagttacttacgtgtgacgtattacgttagtggtaacttacgacttaactaattagttttacgtcgtcgtaacccgg

SEQ ID NO: 9615 - DNA, 516 bp, Homo sapiens
  misc_feature: GYAE6OF01C0W72.53.73.G07.1.454.CMB.1.raw
  modified_base (414)..(414): a, c, t, g, unknown or other
  misc_feature (414)..(414): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcaagaaaccagggaaagccctagactcctgatctataagacgtctactttagacagtggggtcccatcaaggttcagcggcagtggatcgtgggacagagttcactctcacctattagcagcctgcagcctgatgtattttgctaactttatactgaccaanagtacaattactttgtgacgttcggaccgaagggaccaagggtgaaatcgaaaacgactggtagctggacaccgatctgtaccttacattcctcccgctacg

SEQ ID NO: 9616 - DNA, 517 bp, Homo sapiens
  misc_feature: GYAE6OF01DRP7K.53.73.G07.1.454.CMB.1.raw
  modified_base (268)..(268): a, c, t, g, unknown or other
  misc_feature (268)..(268): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggcagccaaagtattaagacctggttggcctggtatcagcagaaaccagggaaacnccctagactcctgatctataagacgtctactttagacaggtgggtccatcaaggttcagcggcagtggatcgtgggacagtagttcactctcaccattacgcagcctgcagcctgatgtatttgactaacttattactgaccaacataactaattacgtttgtcggtacgttcggaccgaaggggacctaagggtagaaactacgaaacgacgtgtggctgcaccatctgtcttcatcttcccgctacg

SEQ ID NO: 9617 - DNA, 524 bp, Homo sapiens
  misc_feature: GYAE6OF01B0OFK.53.73.G07.1.454.CMB.1.raw
  modified_base (347)..(347): a, c, t, g, unknown or other
  misc_feature (347)..(347): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacacggcccctggacaggggcttgagtggatgggtctaatcaacctagtggtggatctaacagttactnacagagaatgcagggcctaattaccatagaccagacgacacgtccaacgagtaacagtctacagtaggaggtgagcaggcctgagtatcgtaggacggacgacggacctagtcgtattacgtagtgcgtattcgttaggtgacttacgactaactaattattttcgtagcgtacccg

SEQ ID NO: 9618 - DNA, 575 bp, Homo sapiens
  misc_feature: GYAE6OF01DVZ93.53.73.G07.1.454.CMB.1.raw
tcagcgcgtatacacacgaccggtgctcgatttagctctacgctcaggggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtgggtcccatcaaggttcagcggcagtggatcgtgggacagtagtcactctcaccattagcagcctgcagcctgatgtatttgactaactttattaacctcgacctaactacgtaactaattacgtttagtacgggtaccgttacgggtacccgaaaggggtacccgaagggtacggaaaataccgaaaacgtaacgttggtaggctaggacctaaccacgttcttacggttcctttaccgtactttcccttccccgtcctaaccg

SEQ ID NO: 9619 - DNA, 596 bp, Homo sapiens
  misc_feature: GYAE6OF01BCKNY.53.73.G07.1.454.CMB.1.raw
  modified_base (217)..(217): a, c, t, g, unknown or other
  misc_feature (217)..(217): n is a, c, g, or t
  modified_base (542)..(542): a, c, t, g, unknown or other
  misc_feature (542)..(542): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctccaggtgcagctggtacaagtcggggctgagatagaagaagccgtggggcctnagtgatgtatttcctgcacgacatcgtaggactacacccttcaccgtaccttacccttatactagttagggtacgaccgacggcccccgtggaccgaggggtcttggaggtggtagtcgggtactaagtccaacccgttggtaggtaggactactaacgtaagttacacaacagaagagtcgacgaggacgtaataccagtacgaccgagacgaccgacgtaccgaacgtagtacacgttactacgtagtagggaggtagacgacgaggtacctagacgattacgaggtacgacgacggacgtagtattagtacgtgtgtacgtnttagttaggtgtaacttacgaacttactaagtttattttcgacgtcgtaaccgg

SEQ ID NO: 9620 - DNA, 208 bp, Homo sapiens
  misc_feature: GYAE6OF01A49NA.53.73.G07.1.454.CMB.1.raw
  modified_base (141)..(141): a, c, t, g, unknown or other
  misc_feature (141)..(141): n is a, c, g, or t
  modified_base (165)..(166): a, c, t, g, unknown or other
  misc_feature (165)..(166): n is a, c, g, or t
  modified_base (172)..(174): a, c, t, g, unknown or other
  misc_feature (172)..(174): n is a, c, g, or t
  modified_base (176)..(176): a, c, t, g, unknown or other
  misc_feature (176)..(176): n is a, c, g, or t
  modified_base (178)..(181): a, c, t, g, unknown or other
  misc_feature (178)..(181): n is a, c, g, or t
  modified_base (183)..(208): a, c, t, g, unknown or other
  misc_feature (183)..(208): n is a, c, g, or t
tcagcgcgtatacacacgaccggtgctcgatttagctctacgctcagggcacgaccggtgctcgatttagcagacgtctgtcgcgggctggcaaggcgcatagcgggctggcaaggcgcatagcgggctggcaaggcgcanagcgggctggcaaggcgcatgcgnngcagcnnngngnnnngnnnnnnnnnnnnnnnnnnnnnnnnnn

SEQ ID NO: 9621 - DNA, 142 bp, Homo sapiens
  misc_feature: GYAE6OF01BB0VT.53.73.G07.1.454.CMB.1.raw
  modified_base (141)..(142): a, c, t, g, unknown or other
  misc_feature (141)..(142): n is a, c, g, or t
tcagcgcgtatacacacgaccggtgctcgatttagctctacgctcagggcacgaccggtgctcgatttagtagtgtagattcgcgggggatggcctccctcgagtctacagtgctctgagcgggctggcaaggcgcatagnn

SEQ ID NO: 9622 - DNA, 521 bp, Homo sapiens
  misc_feature: GYAE6OF01AKJ33.53.73.G07.1.454.CMB.1.raw
  modified_base (378)..(378): a, c, t, g, unknown or other
  misc_feature (378)..(378): n is a, c, g, or t
  modified_base (405)..(405): a, c, t, g, unknown or other
  misc_feature (405)..(405): n is a, c, g, or t
  modified_base (425)..(425): a, c, t, g, unknown or other
  misc_feature (425)..(425): n is a, c, g, or t
  modified_base (513)..(513): a, c, t, g, unknown or other
  misc_feature (513)..(513): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagagcctggggcctcagtgatgatttcctgcacgacatcgtggatacaccttcaccgatccccttatacattgggtacgacaggccccctggacagggcttgagtggatgggtctaatcaaccctaggtggtggatctacaagttactcacagagatgcagggccgaataccatgaccngagacacgtcgacgagtacagtctacngtggaggtgagcagcctagngatcgtgaggaccacggacctagtcgttaattacgtagtcggacgtagttcttagtaggtattaacggacttacaatttatttcgtcncgtacccg

SEQ ID NO: 9623 - DNA, 611 bp, Homo sapiens
  misc_feature: GYAE6OF01B6V5Q.53.73.G07.1.454.CMB.1.raw
  modified_base (336)..(336): a, c, t, g, unknown or other
  misc_feature (336)..(336): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagaccaaagtattaagacctggttggcctggtatcagcagaaaccagggaaacgccctagactcctgatctataagacgtctactttagacaggtcgggtcccatacaaggttcaggcgnagtggatcgtaggacagacgttcactctacactattacgcacgcctgcacgtcctagtatgtattttcgacttaactttattactacgaccctaataacgttacaaatttacgtttcggtacggtaccggtttcgggaacccgtaaaggggaacccgtaaagggttacgtaaaacgtaccgaaaaacgtacgtaggttacggtacgtacgacctaacccgtacgttacccttacggtttccttacctaacttcccgtttccccggaccttaaccg

SEQ ID NO: 9624 - DNA, 785 bp, Homo sapiens
  misc_feature: GYAE6OF01CXZIR.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctccaggtgccaaatgtgacatccagatgacccagtcctccttccaccctgtctgcatctgtcggagacagacgtcaccgtcacgttcggccgggacagacctaaaagttattaaacgccgtggttcggccttggtatcgagacaacggaaaccgagggaaacgccctaagacctcctagaatactaagtaagaccgttcttaactttagacgtacggtacgggtccctaagtacgtaaaggttcgaacggcggtacctaaggttcggaacttacggtagggtaacctaaggtacgtttcaaccgttaccttaccgaaccgtaagtttacggaccgtaacggccgttacggacctaacggtccctttaagggtaacgtttaggttaaccgtttttacgggaaccttaaacctttttaacgtttaaccgaccggtaaacccctaaacgttaaacggttaaccttaaaacgtttaccgttttcgggtaaccgggttacccggtttaaccgggaacccggaaacggggttacccgtaaaaggggtacgggtaaaaccttaaccgtaaaaacggtacccggttaggtaccgggtacttacggacctaaccgttacgttaccgttacggttaccttacgtaaccgtttcccgttacccgccttaacg

SEQ ID NO: 9625 - DNA, 619 bp, Homo sapiens
  misc_feature: GYAE6OF01C72FP.53.73.G07.1.454.CMB.1.raw
  modified_base (403)..(403): a, c, t, g, unknown or other
  misc_feature (403)..(403): n is a, c, g, or t
  modified_base (546)..(546): a, c, t, g, unknown or other
  misc_feature (546)..(546): n is a, c, g, or t
tcagcgcgtatacacacgaccggtgctcgatttagctctacgctctaggggtagtcatccgaacaaccacatcccttctctacgagaagcctcgtcgagaggaaagttcttcaccgatggactggacctggagggtcttctgcttgctgtcagtagctccaggtgctccgctcccaggtgccagctggtacaagtccgggggctgagatgaagaacgccgtggggccttcgacggtgagtggaactttcctggaccaacgtactatcgtaggactaaccaccttcacccgaccgttacccgttaatacacgttacgggtacacctacggcccctggacgagggtcttggagtggagtgggtactaactacgaaccgtaggtggtgactcgtaagtacgttacncgacgagagaatcgcgtaggccgtaacttaccatacgaaccagacgaaccacgtaccaacgtagtacgacgtactactagtggagtagagactacgtcgtgtacgtacgtacgtagacgaccacgacctagtagttattacgngtcgacgtagtagttaggtggtaacttaccgaacttaaccgttaactttattttacgtcgtacggtaacccgg

SEQ ID NO: 9626 - DNA, 722 bp, Homo sapiens
  misc_feature: GYAE6OF01D3ITN.53.73.G07.1.454.CMB.1.raw
  modified_base (237)..(237): a, c, t, g, unknown or other
  misc_feature (237)..(237): n is a, c, g, or t
  modified_base (711)..(711): a, c, t, g, unknown or other
  misc_feature (711)..(711): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtacaagtcgggggctgagataggaagaagccgtggggcctcgagtgatgtactttccngcacgacatcgtggatacaccgttcaccgtacctcccttatactagttcgggtaacgacgtacggccccgtagggaccgtagggggtcctttaggacggttgggaacggttacggggttaccttaaaacgttccgtaaaccccggttaggttgggtacggtaacttaccgttaacgtaaaggtttacctacgaacgaggaaacgtaagtcggaccggtaacggggaaccgttaaacgtttaacccgaagttaccggaaccgtaaggaaccgaaccgaccgtaccgaacgtaacgtaacgtaacgtaccgtaagtacggtgggtaacggtggaacggaccgacggtccggtaggaacggtacttacggaagggacggaacccgaccgtacctagttacttaagttacgtggtacgtcgtatttaggttacggttagtaacgttaacgtacttaaagttactttagtttcgtaccnccggtaaccgg

SEQ ID NO: 9627 - DNA, 517 bp, Homo sapiens
  misc_feature: GYAE6OF01A9C74.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtgggtccatcaaggttcagcggcagtgatctgggacagagtcactctcacctattagcacgtcctgcagcctgactgtatttgctaactttattactgtaccaactagtaacaattacttgtaggtacgttcgggacaacgggaccaaggtaggaaacttacgaaacgactggtggctgacacatctcgtacttcattcttcccgctac

SEQ ID NO: 9628 - DNA, 620 bp, Homo sapiens
  misc_feature: GYAE6OF01C14FD.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtcctccttccaccctgtctgcatctgtacggagacagacgtcaccgtcacttggccgggcagaccaaagtattaacgaccttgggttcggccttggtatcagacaacggaaaccgagggaaaccgcccctagacctcctagactacgtaataagacgtacttactttagacgtaggtcgggtacctagtacaacggttcaggcggacaggtggatcgagggactagtacgttcactcacctactattacgcacgcctagcagtcctagacttgtactttcgactaactttatactcgtaacctaatacgttaactaagtttacgtttggtacggtaccggtttaccgggaaccgtaaaggggtacctaagggtacggtaaaactacgtaaaaccgtacgttggtacggtctacgactacctagttcttcgtcctttacaccgttcccttcccgcgttacg

SEQ ID NO: 9629 - DNA, 149 bp, Homo sapiens
  misc_feature: GYAE6OF01DXHQS.53.73.G07.1.454.CMB.1.raw
  modified_base (148)..(149): a, c, t, g, unknown or other
  misc_feature (148)..(149): n is a, c, g, or t
tcagcgcgtatacacacgaccggtgctcgatttagctctacgctcagggcacgaccggtgctcgatttagcgagacgcgcagggcacgaccggtgctcgatttagtgacatctcgcagttctttgagcgggctggcaaggcgcatagnn

SEQ ID NO: 9630 - DNA, 511 bp, Homo sapiens
  misc_feature: GYAE6OF01A2LNV.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttggagtggatgggtctaatcaacctagtggtggatctacaagttactcacagagaatgacgagggccgaattaccatgaccagagacacgtccacgagtacagtcacatggagtgagcagcctagagatcgtaggacggacgacggccattgtattacgtgtgcgtatcgttaggtgtattacgactaactaattattttgtcgagtacccg

SEQ ID NO: 9631 - DNA, 722 bp, Homo sapiens
  misc_feature: GYAE6OF01CYYG2.53.73.G07.1.454.CMB.1.raw
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgctcgctccaggtgcagctggtacagtcggggctgagatagaagagccgtggggcctcgagtgatgtatttcctgcacgacatcgtggactaccaccttcaccgtacttcccttatacctagttcgggtaccacgaccgggtccccgtaggacgtacgggggtcttaggaggtgggtagtgggtacctaactccgtaaccgttagggtagggttacggaacttacgtaaacgtaaaggtttacctcgaaacgtaaggaacgtaacgttcgggaaccgtaacggggtaacccgtaaatttaaccccaagttaccggaaccgaacggaacgaacccgaaccggttacccgaaacggttaaacgtaaccgtaacggttaacctaacggtaaggtacgggtaaggtacggacggaccgtaacggccgtaggtacgtaacgttcgagggtaccggacgaccgggtacctagttacgttacttacgtcggtacggtacgtacgttagttacggtaggtaacgttaacaaccgttaacgttaagtttagttttacgaccggtacgtaacccggg

SEQ ID NO: 9632 - DNA, 715 bp, Homo sapiens
  misc_feature: GYAE6OF01AKIDR.53.73.G07.1.454.CMB.1.raw
  modified_base (230)..(230): a, c, t, g, unknown or other
  misc_feature (230)..(230): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcagtgatgatttccngcacgacatctggactacaccttcaccgtactcccttatactagttgggtacgacgacgggcccccgtggaccgaggggtctttggaggtggagttggggtactaagtccgtaaacccgttaggttggtacggtacttaccgtaacgtaaacgtttacctacgaacgaaggaagtaagtcggacgaacgggtacccgtaaacttacccgaagttacggaaccgaaggtaacgaccgtaacccgtacccgaacggtaacgtacgaacgttacctaacgaaggttacgggacggtagacggaccgtacgtccgtaggaacgtaacgttcggtacgggtaacggaaccgtaccgggtacctagttacgtaacgtttacggtaggttacggtaccggtacgtttacggtttagggtacggttaacgtttaaccggtaaaccgttaacgtaaagttttaagttttcggtaccgtaacgggtaaccccggg

SEQ ID NO: 9633 - DNA, 521 bp, Homo sapiens
  misc_feature: GYAE6OF01ELSZU.53.73.G07.1.454.CMB.1.raw
  modified_base (267)..(267): a, c, t, g, unknown or other
  misc_feature (267)..(267): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggcagccaaagtataagacctggttggcctggtatcagcagaaaccagggaaacnccctagactctgatctataagacgtctactttagacaggtgggtcccatcaaggttcagcggcagtggatcgtggacagagttcactctcaccattagcagcctgcagcctgatgtatttgactaactttattactgaccaactagtaacaattacgtttggtaggtacgttcgggaccgtaaagggaccaagggtacggaaatacgaaaacgactggtcggctgacaccatctgtctacactccttccgctac

SEQ ID NO: 9634 - DNA, 556 bp, Homo sapiens
  misc_feature: GYAE6OF01CL29T.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacaggcccctggacaggggcttgagtggatgggtctaatcaaccctagtggtggatctacaagttactcacagagaatgcagggccgaattaccatgaccagacgacacgtccacgagtacagtctacagtggaggtgagcagccgtgagatcgtagacggacacggacctatagttaagttactggtagtcgtaagtttccgttaaggttaggtaaacgtttaaccggaaaccttaacgttaaaatttagtttttacgttccgtaacggtaaccccgg

SEQ ID NO: 9635 - DNA, 624 bp, Homo sapiens
  misc_feature: GYAE6OF01B6QF2.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttcggccgggccagaccaaagtataagacctggttggcctggtatcagcaagaaaccagggaaacgaccctagactcctgatactataacgacgtacttacttagacgtaggtgggtacccatcgaaggttcaggcggactagtggagtcgtaggacagtagtcactctacactattacgctagcctgaccagcctagattgtatttgacttaacgttaattaccgtagtacccaaataacgttaacaagtttacgtttggtacgggttaccggttaccggtaacccggaaagggaaccgtaaagggtacgtaaaacttacgaaaacgtaacgttaggtacggtcctaaggaccctaaccgtacttccgttacgttaccctttacgtaaccttttccccgtacccccgtcttaaaccg

SEQ ID NO: 9636 - DNA, 622 bp, Homo sapiens
  misc_feature: GYAE6OF01EGUAP.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctggtcggagacagagtcaccgtcacttgccggccagccaaagtattaagaccgttggttcgcctggtatcagcaagaaaccgagggaacgcccctagacctcctgactctaataacgacgttactaacgtttagacgtaggtcgggtaccccagtacgtaaggaccaaggtcggcgtaaggtggaattcggtagggaactaggtacttcacttcctacaacctattacgcacgcctagcacgtcctgtattgttactttgaacttacttatactacgaccaatactaactaatttacgtttaggtacggttaccggttaccgggaaccgtaaacgggaaccgtaagggtaacgaaactacgaaaacgtacgtaggtacgtcgtagacctaccgtacgtaccgttgttcccgttactacctttcccttaccccgcttacg

SEQ ID NO: 9637 - DNA, 532 bp, Homo sapiens
  misc_feature: GYAE6OF01EIW55.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagccctagactcctgatctataagacgtctactttagacagtggggtcccatcaaggttcagcggcagtggatctgggacagagttcactctcaccattagcacgcctgcagcctgatgtattttgactaacttattactgaccaactagtaactaattactttgtacggtacgttcggaccgaagggaccaagggtacggaaactacgaaaacgtacgtaggtaggcttagactaccatctgttcttacattccttcccgctacg

SEQ ID NO: 9638 - DNA, 530 bp, Homo sapiens
  misc_feature: GYAE6OF01CFR4Z.53.73.G07.1.454.CMB.1.raw
  modified_base (354)..(354): a, c, t, g, unknown or other
  misc_feature (354)..(354): n is a, c, g, or t
  modified_base (442)..(442): a, c, t, g, unknown or other
  misc_feature (442)..(442): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgactccctatacattggtacgacaggcccctggaccgaggggcttggagtggagtgggtactaatcgaacccgtaggtggtgatcgtacaagttacncacagagaagtgacgacgggaccgaattacatcgaccagacgacacgtccacgagtacagtctacgagtggagtgagcgagcctgagntacagaggacacgctatgtattcgtgtgacgtattcgttaggtgtacttaacgtaacgtaacttaatttattttcgtctaggtacccg

SEQ ID NO: 9639 - DNA, 534 bp, Homo sapiens
  misc_feature: GYAE6OF01D6AOT.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacacggcccctggacgaggggcttggagtggagtgggtctaatcaaccctagtggtggatctacaagttactcacagagaatgcgagggaccgaattaccatcgaccagagacacgtaccacgagtacagtactacagtggaggtgagcgacgcctagagatcgtagaggacacggcagtgtaattacgtgtgcgtattcgttaggttcggtaacttaacgacttaactaaatttattttacgtcacgtaacccgg

SEQ ID NO: 9640 - DNA, 539 bp, Homo sapiens
  misc_feature: GYAE6OF01BT2FA.53.73.G07.1.454.CMB.1.raw
  modified_base (176)..(176): a, c, t, g, unknown or other
  misc_feature (176)..(176): n is a, c, g, or t
  modified_base (234)..(234): a, c, t, g, unknown or other
  misc_feature (234)..(234): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccagggggggtncagctggtacaagtcggggctgagatgaagagccgtggggcctcagtgatgatttccngcacgacatctggatacaccttcaccgactcccttatacattgggtacacacggcccctggacaggggcttggagtggatgggtctaatcaaccgtgtggtggatctanaagttacncanagagaatgcgagggccaattaccatcgacagacgacacgtccgacgagtacagtactacagtggaggtgagcacgccgtagagactcgtaggacggaccacggcctagtagtacttacgtgtagtacgtattcgttaggtggtattaacgtacttaactaatttagttttcgtcgtaggtacccg

SEQ ID NO: 9641 - DNA, 534 bp, Homo sapiens
  misc_feature: GYAE6OF01COMDF.53.73.G07.1.454.CMB.1.raw
  modified_base (330)..(330): a, c, t, g, unknown or other
  misc_feature (330)..(330): n is a, c, g, or t
tcagcgcgtatacacacgaccggtgctcgatttagctctacgctcagggggagtcagacccagtcaggacacagcatggacatgagggtcccccgctcagctcctggggctcctgctgctctggctcccaggtgccaaatgtgacatccagatgacccagtctccttccaccctgtctgcatctgtcggagacagagtcaccgtcacttgccgggcagccaaagtattagactggttgctggtatcagcagaaaccaggaaagccccgtaagactcctgatctataagacgtactactttagacagtggggtcccatcaagttcagcggnagtgatcgtggacagagtcactctcacctattacgcagcctgcagcctgattgatttgactaacttattactgaccaatagtactaatactttgtcggtaccggttcggaccaagggacctaagggtagaaactaccgaaaacgattaggtaggtcgtagacctaccgtagtccttagttccttacattcccttcccgctaacg

SEQ ID NO: 9642 - DNA, 697 bp, Homo sapiens
  misc_feature: GYAE6OF01EFDG8.53.73.G07.1.454.CMB.1.raw
  modified_base (285)..(285): a, c, t, g, unknown or other
  misc_feature (285)..(285): n is a, c, g, or t
  modified_base (657)..(657): a, c, t, g, unknown or other
  misc_feature (657)..(657): n is a, c, g, or t
tcagcgcgtatacacacgaccggtgctcgatttagctctacgctcagggggagtcagacccagtcaggacacagcatggacatgagggtccccgctcagctcctggggctcctgctgctctggcctcccaggtgaccaaatgtgacatccagatcgacccagtcctccttccaccctgtctgcatctggtcggagacagacgtccaccgtcacgttcggccgggaccagaccaaagttacttaagaccgttggtgccgtggtatcgagcaagaaaccgaggaacnccccgtagacctcctaggatctaagtaagtacgttacttaacgtttacgactcggtacggggtacccagtaccgtaaggttcgaacggtcggacgtaggtcggacttcgtacgggacgaacggtacggttaccaccgtccgtacctaaccgtaagtttacgaccctacggccgttacgaccacgtacccgttagtaacgttggtaacttttcggaacctttaactttacttaccgtaccgaaccctaacgtaacgttaactaacgttacgtttcggtacggttaccggttacggggtaacctaaacggggtaaccgtaagggtacggaaactaaccgaaacgtaccgttaggtacggactcgaccgtaaccngttacgtacgttacttcgtaacctccgttcccgcttaacg

SEQ ID NO: 9643 - DNA, 601 bp, Homo sapiens
  misc_feature: GYAE6OF01DVOCA.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccggccagaccaaagtattaagacctggttggcctggtatcagcaagaaaccagggaaacgcccctagactcctgatctaataagacgtcttactttagacgtaggtcggggtcccatacgaaggttcaggcggcaggtggatcgtgggacagtagttcactctacacctattagcagcctgcagcctgattgtattttgaccttaacgtttattactcgacctaacgtaactaactaatttacgtttggtacgggttaccggtttaccgggtaccgaaacggggtacctaaaggggtaggaaaacgtaaccgaaaacgtacgttggtacggtcgtagacctaacctattaccgttcgttcctttactaccttcccttccccgccttaaccg

SEQ ID NO: 9644 - DNA, 605 bp, Homo sapiens
  misc_feature: GYAE6OF01EA2J4.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgtactttcctgcacgacatcgtaggactaccaccttcaccgtacttcccttatactagttcgggtacacgacggcccctggaccgaggggtcttggagtggatgggtactaatccgaacctaggtggtaggtatctaacaagttacacacagagaagtgacgacgggacctaattaccatcgaccaagacgacacgtaccaacgtagtaacgtagtactacgagtaggaggtgacggctacgccgtagacgagtcgtaggaacggtacgaccggacctagtacgttacttacgtcgtgtacgtagttacgttaggtcggttaaacgttaccggaaacgtttaaccttaaagttttagttttacgtccgaacggtaaccccgg

SEQ ID NO: 9645 - DNA, 684 bp, Homo sapiens
  misc_feature: GYAE6OF01BNPWQ.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctcaggtgctcgctcccaggtgcagctggtacaagtcgggggctggagatgaagaagccgtggggcctcgaggtgatgtatttcctgcacgacatctggactactaccttcaccgtacttcccttaatacctagttcggggtaccacgacggcccccgtagggaccgagggggtccttggacgtgggtacttaggggtactaaacgtccaaacccgttaggtcgggttggaacttaccgtaaacgaacggttttacactaacgaaggtaaggaactggaccgaacggggtaccctaaaacgtttaccaaagttacgaacccgaaggaacggaaccgtaaccggtacccgtaaacggtaacgtaaccgtagttaaccgtaacgaaggttgggaacgggttaggaacggaccggtacggtacccgtaggaagtacgtttaccgaggaaccgggtaacgacccggactagtacgttatacgtgtacgcgtattcgtaggtcgtacttaacgtataacgtattagtttcgcgtacgtacg

SEQ ID NO: 9646 - DNA, 584 bp, Homo sapiens
  misc_feature: GYAE6OF01DCX5L.53.73.G07.1.454.CMB.1.raw
  modified_base (283)..(283): a, c, t, g, unknown or other
  misc_feature (283)..(283): n is a, c, g, or t
  modified_base (338)..(338): a, c, t, g, unknown or other
  misc_feature (338)..(338): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgaccatccagatgacccagtctccttccaccctgtctgcatctgtcggagacagagtcaccgtcacttgccggccagccaaagtattaagacctggttggcctggtatcagcaagaaaccagggaaacgccctagacctccngatctaataagtacgttactactttagactaggtgggtacccatcaaggttcagnggcagtggatcgtggacagagtcactctacactattacgcagcctgacagtcctagattggtaatttcgactaactttattactcgaacctaagtacgttaactaattacgtttgtacggtacgttacgggaccgaaagggaccgaagggtacgaaaacttacgaaacgaacgttggtacgggtacctaggacctaaccgtacttcgtacgttcttacgtcctttacccgtccccgtccgttaacg

SEQ ID NO: 9647 - DNA, 565 bp, Homo sapiens
  misc_feature: GYAE6OF01B6P36.53.73.G07.1.454.CMB.1.raw
  modified_base (231)..(231): a, c, t, g, unknown or other
  misc_feature (231)..(231): n is a, c, g, or t
  modified_base (481)..(481): a, c, t, g, unknown or other
  misc_feature (481)..(481): n is a, c, g, or t
  modified_base (514)..(514): a, c, t, g, unknown or other
  misc_feature (514)..(514): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttccngcacgacatctggatacaccttcaccgactcccttatacagttggtacgcgacggcccctggacgaggggtcttggagtggagtgggtactaatccgtaaccctaggtcggtggtatactaacgtaagttactacacgagagaagtgacgacgggaccgtaattaaccagtacgaccagacgaccgtacgtaccgaacgtaacgtacagtacctacgagtagggaggtgagcgacgtccgagagactcgngaacggacacggaccagttgtattacgtgtcgngtattgtaggttgtaacgttacgacttactaatttatttgtcgtcgtaccg

SEQ ID NO: 9648 - DNA, 564 bp, Homo sapiens
  misc_feature: GYAE6OF01D36GA.53.73.G07.1.454.CMB.1.raw
  modified_base (270)..(270): a, c, t, g, unknown or other
  misc_feature (270)..(270): n is a, c, g, or t
  modified_base (327)..(327): a, c, t, g, unknown or other
  misc_feature (327)..(327): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgtacttcccttanactagttcgggtacgacacggcccctggacgaggggtctggagtggatgggtctaancaacctagtggtgatcgtactaagttactcacagaagaatgacgaggccgtaaattacatcgaacagacgacacgtaccgacgagtacagtctacagtggagtgagcacgcgtagagtactacgtaggacggaccgacggacctagttacgttactttacgtggtacgacgtagttacgttaggtacggtaacttaacgaacgttaacttaatttagttttcgtacgcgtaacccgg

SEQ ID NO: 9649 - DNA, 534 bp, Homo sapiens
  misc_feature: GYAE6OF01ELEI3.53.73.G07.1.454.CMB.1.raw
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatacattgggtacacaggcccctggacagggggtcttggaggtggagtgggtctaatcaaccctagtggtgatctacaagttactcacagagaatgcgagggcgaaataccatacaccgagacgacacgtaccgaacgtagtaacagtactaacagtggaggtgagcagccnganatcgtgaacgacgacggcagttgtattactgtcgcgtattgttaaggtggtaacttacgaactaacgttaattagttttacgcgacgtacccgg

SEQ ID NO: 9650 - DNA, 532 bp, Homo sapiens
  misc_feature: GYAE6OF01AYHAP.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagatcaccgtcacttgccgggccagccaaagtataagacctggttggcctggtatcagcagaaaccagggaaagccctagactcctgatctataagcgtctactttagacagtggggtcccatcaaggttcagcggcaggtggatcgtggacagagttcactctcacattagcagcctgcagcctgatgtattttcgactaacttattacctgaccaactagttacaattacgtttgtacggtacggttcggaccgtaaggggaccaagggtaggaaactcgaaacgtaatggtaggctaggacaccagttctgttaccttctactcctttcccgcttac

SEQ ID NO: 9651 - DNA, 694 bp, Homo sapiens
  misc_feature: GYAE6OF01BW1FF.53.73.G07.1.454.CMB.1.raw
  modified_base (299)..(299): a, c, t, g, unknown or other
  misc_feature (299)..(299): n is a, c, g, or t
tcagcgcgtatacacacgaccggtgctcgatttagctctacgctcagggggagtcagacccagtcaggacacagcatggacatgagggtccccgctcagctcctggggctcctgctgctctggctccaggtgccaaatgtgacatccagatcgacccagtcctccttccaccctgtctgcatctgtcggagacagacgtcaccgtctacgttcggcccgggaccaacgacctaaaagttattaacggaccgttgggttcggccttgggtactcgaagacaaggaaaaccgagggaaacnccctaagacctccgtagtactctaagtaacgtacgttactaacgtttagacgtaggtcgggtaccctagtacgtaaggttcaaggtcggacgtaggtcggtaactcggtagggactacgtacgttacacttcctacactagttacgcaacgtccgtcgacgacgtcgtagtactgttatttacgaacttaactttacttacgtcgaacctaatacgttaactaacgtttcgtttaggtacggtaccggttaccggaaccggtaaacgggtaaccgtaaagggtaacgtaaacgttaacgaaaaccggttagtacgggtcgtacctacggtaccctaaccgtacgttccgttacgtttaccttacgtaaccctttcccgttaaccccgcttaacgg

SEQ ID NO: 9652 - DNA, 556 bp, Homo sapiens
  misc_feature: GYAE6OF01DM2EH.53.73.G07.1.454.CMB.1.raw
  modified_base (377)..(377): a, c, t, g, unknown or other
  misc_feature (377)..(377): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcggagacagagtcaccgtcacttgccggccagccaaagtattaagacctggttgcctggtatcagcaagaaaccagggaaacgcccctaagactcctgatctaataagacgtctactttagacaggtgggtcccatcaaggttcagcggcagtggatcgtgggacagtagttcactctacacctattacgnacgcctgccaacgcctagattgtattttgaccttaacttattactcgaccaactaagtactaattcgtttaggtggtaccggtttacgggaccgaacgggacctaagggtaggaaactaccgaaaacgtactggtacgtcgtagcacctattctcgttcttacactttcctcccgctac

SEQ ID NO: 9653 - DNA, 528 bp, Homo sapiens
  misc_feature: GYAE6OF01DV90U.53.73.G07.1.454.CMB.1.raw
  modified_base (269)..(269): a, c, t, g, unknown or other
  misc_feature (269)..(269): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaacnccctagactcctgatctaataagacgtctactttagactaggtcggggtcccatcgaaggttcagcggcaggtggatcgtgggacagagttcactctcaccattagcagcctgcagcctgattgtattttgactaactttattactgaccaatagtaactaattactttggtggtacgttcgggaccgaagggacctaaggtacgaaatacgaaagacgtgtggctagcctacatctagtcttcacttcctcccgctac

SEQ ID NO: 9654 - DNA, 549 bp, Homo sapiens
  misc_feature: GYAE6OF01AEZRL.53.73.G07.1.454.CMB.1.raw
  modified_base (453)..(453): a, c, t, g, unknown or other
  misc_feature (453)..(453): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatggaagagccgtggggcctgagtgatgactttcctgcacgacatctggatacaccttcacccgactcccttatacagttgggtacgacaggcccctggacaggggcttggagtggatgggtctaatcaacccgtgtggtggatctacaagttactcacagagaatgacgagggacctaaagttacccagtacgaccgaaggacgaccgaccgtcccaacgagtaacacgtactacagtcgggaggtgagcgagtccngagatcgaggaacggacacggccagtgtacttactgtgtacgtattcgttaggtggtacttacgaacttactaatttatttcgtcgacgtacccgg

SEQ ID NO: 9655 - DNA, 564 bp, Homo sapiens
  misc_feature: GYAE6OF01CD4EI.53.73.G07.1.454.CMB.1.raw
  modified_base (424)..(424): a, c, t, g, unknown or other
  misc_feature (424)..(424): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagccgtggggcctgagtgatgatttcctgcacgacatctggatacaccttcaccgactcccttatacagttcgggtacgacacggcccctggacgaggggcttggaggtggagtcgggtactaatccgaacccgtagtgggtgatctacaagttacacacagagaatcgacagggaccgaattaccatgaccagacgacacgtccaacgagtacagtactanagtggaggtgagcagcctagacgtatacgaggacggacgaacggcctagtagttaacttacgtagtgacggtacttacgttaaggtcggtaattaaccggtactaacttaacgtttagttttacgtcgtaggtaacccgg

SEQ ID NO: 9656 - DNA, 584 bp, Homo sapiens
  misc_feature: GYAE6OF01DFL3O.53.73.G07.1.454.CMB.1.raw
  modified_base (372)..(372): a, c, t, g, unknown or other
  misc_feature (372)..(372): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagccgtgggcctcagtgatgtatttcctgcacgacatcgtggactacctacccttacacccgtaccttcccttatactagttgggtacgacacggccccgtaggacgaggggtcttggagtggatgggtactaagtccaaccgtaggtggtgactctacaagttactcanagagagtgcgagggacctaaattaccgatcgaaccagacgaacgacgtaccgaacgtacgtaacagtcctacgagtgggagtagagtacgagtacctgacgatgtacggaggaccgaccggtaccagttcgttaattacgtgtggacgtattagttaggttaggtaacgtttaacgaacttaactaaatttagtttcgtcgtacggtacccg

SEQ ID NO: 9657 - DNA, 617 bp, Homo sapiens
  misc_feature: GYAE6OF01D14AB.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacgttgccgggccagccaaagtattaagaccgtggttggcctggtatcagacaagaaaccgagggaacgccctagactcctagactctaataacgtacgttactacgtttacgactaggtacggggtaccagttacgaaggttccgaggtccggcgaaggtcggatcggtagggacagtaacgttcacgtcctcaacctattacgcagcctagacacgtctagtatgtatttcgactaacgtttatacgtacgacctaacgtagtaactaagtttacgtttggtacggtaccgttaccgggtaccgaaacgggtaccgtaaggtacgaaacgtaccgaaacggtacgtggtacggcctacgacctacctattacgtcgttaccttacgaactttccccttcccggcttaaccg

SEQ ID NO: 9658 - DNA, 644 bp, Homo sapiens
  misc_feature: GYAE6OF01DLT8O.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctggtcggagacagagtcaccgtcacttcgccgggcagaccaaagtattaagaccgtggttcgcctggtatcagcaagaaaccgagggaaacgcccctagactcctgtatactaataaacgacgtacttacgtttaagcgtaggtcgggtaccctagtacgaaggttacgaggtcggactaggtggagtcgtagggactaagtaacgttacacttcgtactaactaaacgtttacgacgtacgacccgtagccgaacgtccgtagtattgtaagttttagacttaacgtttattaccgtacgacctaacgtaacgtaactaacttacgttgtacggttacgttacggtaccgaacgggtaaccgtaaggtacggaaagtaaccgaaaacggtacgtacggtacggtacgtacgtacgaacctagttcttacggttccttactaccttccctcccgtcctacg

SEQ ID NO: 9659 - DNA, 552 bp, Homo sapiens
  misc_feature: GYAE6OF01AUPTW.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgacttcccttatacattcgggtacacacggcccctggacgaggggcttgagtggatgggtctaatccaacccgtagtggtagtatctaactaagttactcacagagaatgcgagggccaattaccatacgacagacgacacgtccaacgagtacagtcacgagtggagtgagcgacgcctagagagtcgtagaggaccacggaccagttacgtacttagtcggtgacgtattacgttaggtacggttaacttaacgaacttaacttaatttagttttacgtccgacgtacccggg

SEQ ID NO: 9660 - DNA, 571 bp, Homo sapiens
  misc_feature: GYAE6OF01BTA85.53.73.G07.1.454.CMB.1.raw
  modified_base (232)..(232): a, c, t, g, unknown or other
  misc_feature (232)..(232): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgtatttccngcacgacatcgtggatacaccttcaccgactcccttatacattgggtacacacggcccctggacaggggcttggagtggatgggtctaatcaacctagtggtggatctacaagttactcacagagaatgacgagggccaaattaccatacgacagagacacgtccacgagtacagtacacagtggaggtgacgcgagccgtaggacgtacgtcgtaggacggtaccgaacgggcctagttacggtaacttacgttggtacggtacgtagttaccgtttaagggtcgggtaactttaccgtaacttaacttaatttagttttcgtacgtacgtaacccgg

SEQ ID NO: 9661 - DNA, 753 bp, Homo sapiens
  misc_feature: GYAE6OF01D2WDT.53.73.G07.1.454.CMB.1.raw
  modified_base (234)..(234): a, c, t, g, unknown or other
  misc_feature (234)..(234): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagacgccgtggggcctcgagtgagtgtactttccngcacgactatcgtaggaactaccgtaccttacacccgtaccttacccttataacctagttcgggtacgaccgacggccccgtaggacgaggggtcttggaaggtggtagtcgggtactaactacctaaccgttggtcggtaggacttaccgtaaacgtaagtttacctacgaacgaaggtaaggtaactcgggaacgaacggggtaaccttaaacgtttaacccgaaggttaaccgaaacccgtaaggaaaccgtaaccgtaacccggttaacccgaaacgggttaaacgtaaccgtaaggttaacccgtaagtaacgggttagggaacgggttagaaccggacgtaacggtccggtaagaacgtagttccggaaggaaccggaaccgtaccggtacctaagtttacgtacgtttaacggtggtacgtacggttagtttacggttaacggtacgttaaacgttaaccgtaaacttaaacttacgttttaggttttcaacggtaaccggttaaacccggg

SEQ ID NO: 9662 - DNA, 535 bp, Homo sapiens
  misc_feature: GYAE6OF01BQDWT.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcggggctgagatgaagaagccgtggggcctcagtgatgatttcctgcacgacatctggatacaccttcaccgacttcccttatactattggtacgacacggcccctggacgaggggcttggaggtggatgggtctaatccaacctgtggtgatctaacaagttactcactagagtaatgacacgggaccgtaaattaccatcgaccagacacacgtaccacgagtacagtactacgagtggaggtgagcgagcctagagatcgtggacggacgacggccagtgttattacgtgtgcgtattcgtaagtggtacttaacgtacttactaatttattttacgtcgacgtaccg

SEQ ID NO: 9663 - DNA, 682 bp, Homo sapiens
  misc_feature: GYAE6OF01EO0RU.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcgggggctgagatggaagacgccgtggggcctgagtgatgtactttcgngcacgactatcgtaggactacctaccgttccacccgtaccttacccttaatacgtaggtttacgggaccaccgaccggtccccgtagggacggtaggggtcttaggacggttggacgttcgggtaactaacgtacccgtaaaccgttggtggtacgacttactaacgtaagttacctacgaagagtaagtacgtcgacggacggtactaacttacgagtacgacagtacaccgacgtaccgagtacgtacagttaccagtaggtagggacgtgacgtcgtacgtacgtggaacgtacgtacggacggtaacgaccgtaccggtacttaggttacgttaacgtttccgtaggtaccgttacgttacgtttacgtttagggtacgttaaaccgttaaccgtaacgtttaaacttaacgttttacgtttacggacgtaccccgggtaacggg

SEQ ID NO: 9664 - DNA, 891 bp, Homo sapiens
  misc_feature: GYAE6OF01C6VHD.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgtatttcctgcacgacatctaggactaccacccttcaacccgtaccttcccttaataccgtagtttacggggtaaccgaccgaacgggtccccccgtagggaaccgtacgggggtcctttgggagggttcgggtaagttcggggttaccttaaaacgttacccgaaaccccgtttagggttacggggttacgggtaacttaccgtttaaaaccgtaaaacggtttttaaccctaccgtaaacgtaaacgggtaaacggtaaatttcgggggaacccggtaaaccggggggtaaacccccggttaaaaacgtttttaaacccccgaagtttaacccgggtaaaaccccggtaacggaaaaccggtaaacccccggtaaaccccgggttaaccccaaaacccgggttaaaccggttaaaccgtaaccgggttttaaccttaaccgggtaagttacgggggaaacggggtttacggaacgggtacccgaacggtcccgttaagggaacgtaacgttaccggttagggtaacggaccgtaaccgggtacctagttacgtttaacgttacgttcggttaacgtcgttaagtttacgtttaagggttacggtaacgtttaaccgaaacgtttaaccttaaagtttacgtttttacgacgtacggtaaccccgg

SEQ ID NO: 9665 - DNA, 520 bp, Homo sapiens
  misc_feature: GYAE6OF01BHC88.53.73.G07.1.454.CMB.1.raw
  modified_base (409)..(409): a, c, t, g, unknown or other
  misc_feature (409)..(409): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatacattgggtacgacacggcccctggacaggggcttggagtggatgggtctaatcaaccctagtggtgatctacagttactcacagagaatgcgagggccgaattaccatcgaccagacgacacgtccacgagtacagtacanatggagtgagcgagccgtgagatcgtagacggaccacggccagtgtattcgtagtgcgtattacgttaggtgtacgttacgaactactaattattttcgtcgacgtacccg

SEQ ID NO: 9666 - DNA, 141 bp, Homo sapiens; identical to SEQ ID NO: 9544
  misc_feature: GYAE6OF01E4EI4.53.73.G07.1.454.CMB.1.raw
  modified_base (141)..(141): a, c, t, g, unknown or other
  misc_feature (141)..(141): n is a, c, g, or t

SEQ ID NO: 9667 - DNA, 872 bp, Homo sapiens
  misc_feature: GYAE6OF01C9HJX.53.73.G07.1.454.CMB.1.raw
  modified_base (232)..(232): a, c, t, g, unknown or other
  misc_feature (232)..(232): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgctcgctccaggtgcagctggtacaagtcggggctgagatggaagacgccgtggggcctcgagtgatgtatttccgngcacgacatcgtggactaccaccttcaccgtaccttacccttataacgtagttcgggtacgaaccgtaccggcccccgtaggaccggtaggggtctttaggacggtagggaacgtttcggggtacttaaacgtacccgtaaacccgttagggtacgggtacggtacttaccgttaacaaacgtttactacgaacgtaaggtaaggtaaactcggaccgtaacggggtaacccgttaaaactttaaccgagtaccggaacccgaagggtaaccgtaaccgtaacccggtaacccgtaaacgggtaaccgttaaaccgacggttaacccttaacggaaggttacgggggtaaacggggttacggaaccgggtaccggtaacgggtacccgttaacgggtaaacgggtaacgtttaccgggaaacgggtaaccgggaaccccgggtaaccgggtacccctaaggttttaacggttaacgttttaaccgtaccggggttagttacccgggttaaaccttttacggggtttaaacgggtttacgggttaaaccgttttaaaaccccggtaaaccgtttaaaaccgtttaaagtttttaaccgggttttttaaccgaccggttaaaccccggtaaacccccggggg

SEQ ID NO: 9668 - DNA, 624 bp, Homo sapiens
  misc_feature: GYAE6OF01C9XI3.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagagtgaagaagccgtggggcctcagtgatgtatttctgcacgacattcgtggactaccacccttccaccgtaccttcccttatacagttggtaccacgacggcccctaggacgaggggtcttggagtggagttgggtactaaactccgtaaccgtagggtcggtaggtaatacctaactaaacgtttacacaacgaagagaagtggaccgagggacctaattaccagtacgacagagaccacgtaccacgaagtacacgtacaacgagtgggacggtgacgcgagtccgtagacgtatcgtaggaacggaccacggacctagttaggttaacttacgtggttagtacggtacttacgttaaggttacggtaacgtttaaccgtaactttaaacttaatttacgttttacggtaaccgacggtaacccggg

SEQ ID NO: 9669 - DNA, 544 bp, Homo sapiens
  misc_feature: GYAE6OF01ELTQP.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacgttgccgggcagccaaagtattaagacctggtgcctggtatcagcagaaaccagggaaacgcccctagactcctgatctataagacgtctactttagactaggtggggtcccatcaaggttcagcggcagtggatcgtgggacagtagtcactctcaccattagcagcctgcagcctgatgtatttgactaacttattactcgaccaacagtaactaattactttggtaggaccgtttcgggcctaaggggacctaagggtagaaacgtcgaaaacgtacgtaggtacggtctaggctaaccacgtcttcgttcttacctacttccttcccgcctacg

SEQ ID NO: 9670 - DNA, 698 bp, Homo sapiens
  misc_feature: GYAE6OF01BZ60L.53.73.G07.1.454.CMB.1.raw
tcagcgcgtatacacacgaccggtgctcgatttagctctacgctcagggatcatccaacaaccacatcccttctctacagaagcctctgagaggaaagttcttcaccatggactggacctggagggtcttctgcttgctgtcagtagctccaggtgctcgctcccaggtgcagctaggtacaagtcggggctgagatgaagagccgtggggcctgagtgatgtactttccgtgacacgactatcgtaggactaccgtaccttaccaccgtaccttcccttaatacgtagttacgggtaaccgacgtccggtaccccgtaggaccgtaggggtcttaggaaggtggtagtcgggttactaacgtacctaaccgttaggtcggtaggacttaccgtaactaacggtttactacgaacgtaagtaacggtaactacggaccgtaacgggtaaccgtaaacttaccgaagtacggaaccgaggtaaccgaaccgtaccgttaacccgaacggtaacgtaacgtaccgtacgtaaccgtaggtagggtacggtacgacgtcaacggtccgtaggaaccgtagttccgaggaccgacgaaccgctagtagttacgttacgtcgtaggaccgtttataggttacgtacggtaacttaacgaacgtttaacgttaacgtttagttttacgccgtacggtaaccggg

SEQ ID NO: 9671 - DNA, 625 bp, Homo sapiens
  misc_feature: GYAE6OF01CZYFM.53.73.G07.1.454.CMB.1.raw
  modified_base (308)..(308): a, c, t, g, unknown or other
  misc_feature (308)..(308): n is a, c, g, or t
tcagcgcgtatacacacgaccggtgctcgatttagctctacgctcaggggatcatccaacaaccacatcccttctctacagaagcctctgagaaggaaagttcttcaccatggactggacctggagggtcttctgcttgctgtcagtagctccaggtgctcgctcccaggtgcagctggtacaagtcggggctgagatgaagagccgtggggcctgagtgatgtactttcctgcacgacatcgtaggactacaccttcacccgacttacccttatacagttgggtacgacgacggccccgtaggacgngggcttgaggtggatcgggtactaagtaccaacccgtgtggtgacttctaagaacgttactcacgaagagaatggacgacgggaccgtaacttacgatacgaacaagtacgaacctacgtaccaacgtacgtaactaacgtactaacgagtacgggtaggtacgaggtaccgaacggtccgtaggaagtacgttacgttaagggacggaaccgacgggtacctagttacgttaacttagtcgtagtacgtagttacgttaggtagttaacgttaactaacttaacgttaaagtttcttttagccgtacgtaacccgg

SEQ ID NO: 9672 - DNA, 653 bp, Homo sapiens
  misc_feature: GYAE6OF01DKTBM.53.73.G07.1.454.CMB.1.raw
  modified_base (216)..(216): a, c, t, g, unknown or other
  misc_feature (216)..(216): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctnagtgatgatttcctgccacgactatcgtggataccacctttacacccgtaccttaccccttatacctagttcggggtaccgacgacggcccccgtggaccgtaggggtcttggagtggtagtcgggtactaaacgtccgtaacccgtaggtcggtaggtacttacgttaacgaaagtttacaccgtaactaaggaacgaagttccggacgaacggggtaccgtaaagttacccgatacggaaccgaagaacgaaccgaccgtaccaacggaagtactagtacctacgagtagggagtgagcgagcgtagacgtagtcgtagggacgtaccgacggacctagttacgttaacttcgtagtacggacgttagttgttaaggttggtaacgtttaacgtaaccttaacgtaattttagttttcgaccgtcggtaacccgg

SEQ ID NO: 9673 - DNA, 934 bp, Homo sapiens
  misc_feature: GYAE6OF01E4QNN.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgcctcccaggtgcagctggtacaagtcggggctgagatagaagacgccgtggggcctcgagtgatgtactttcctgaccacgactagttcgtaggaacttaaccctaccgtttacccaacccgtacccttacccttaataaccgtagtttacggggtaaccgaaccgacccgggtccccccgtaggggaaccggtaacgggggttcctttagggaacgggttagggtaacggtttacggggttaaccctttaaacgttacccgtaaaacccccggtttagggttcgggttacggtaacgtttaaccgttaaaccgttaaaacggttttaacccgtaccgaaacgtaaggtaaacgtaaacgttcgggaaccggaaaccggggtaaccccgtaaaacgttttaaccccgaaggttaaccggaaacccgaacggaaaccggtaacccgtaaccccggttaacccgtaaacccggtaaacgttaaacccgtaacggtttaacccgttaacggtaacgggttaacggggtaagggttacggaccggtaaccgtaccggtacccgttaagggaacgtaaccggttcggtaacgggtaacgggaacccgtaacccgggtacctaacggtttacggttaacgtttaccggttacgggttacgtaccggttaacgtttaacgggtttaacgggttacggttaaaccgtttaaaccgttaaaccgtttaaacctttaaagttttaacgtttttacggacccgtaaccgggttaaaccccggg

SEQ ID NO: 9674 - DNA, 524 bp, Homo sapiens
  misc_feature: GYAE6OF01ATE56.53.73.G07.1.454.CMB.1.raw
  modified_base (483)..(483): a, c, t, g, unknown or other
  misc_feature (483)..(483): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatacattgggtacgacaggcccctggacaggggcttgagtggatgggtctaatcaaccctgtggtggatctacaagttactcacagagaatgcgagggaccgaattaccatcgaccagagacacgtaccacgagtacagtctacagtgggaggtgacgcgagccgtgagacttcgtaggaacggaccgaccggcctattagttacttacgtgtgcgtnttgttagtggtattacgactactattatttgctcgtacccg

SEQ ID NO: 9675 - DNA, 672 bp, Homo sapiens
  misc_feature: GYAE6OF01D3R6N.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccaggtgcagctggtacagtcggggctgagatagaagacgccgtggggcctcagtgatgtactttccngcacgacatcgtagactaccaccttccaccgtaccttccttatacgtagttacgggtaccgacgaccggccccgtaggaccggtaggggtccttaggaggtggtacgttgggttactaacgtaccgtaacccgttagggtcggtacgacttaccttaacgtaacgttactacgaagtaagaagagtacggacgacgggtacctaacttaccagtacgaacgaacgacgaaccgtacgtaccgacgtacgtaacgtacgtactaacgtaggtagggacggtagacggtacgtacggtaccgtaggaacgtactacggtagggaccgaaccggtaccggtactagttacgttacgttacgtggtacgtacgttacgttgttaaggtacggttaacttaacgtaacttaacttaagtttagtttcgtacgccggtaaccggg

SEQ ID NO: 9676 - DNA, 627 bp, Homo sapiens
  misc_feature: GYAE6OF01DGS5U.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggactacacccttcacccgtactcccttatactagttcgggtacgacacggtcccccgtaggaccgagggggtcttggaaggtggagtgggtactaaactccgtaacccctaggtggtaggtatacctaacgaagttacctacaacaagaagaatgcgaagggacctaattaccatacgaaccaagacgaacctaccgtaccaacgtagtaactacggtactaacgtagtagggaggtgacggcacgccgtggaagtacgtacgtaggacggaccgacggcctaagttcgttaagtttacgtcggtacggcgtagttacgtttaaggtaggttaacttaacggaaccttaactaaagttttagttttcgtaccgacggtaacccgg

SEQ ID NO: 9677 - DNA, 756 bp, Homo sapiens
  misc_feature: GYAE6OF01B8DX8.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgtacttttccgtgccacgacattcgtaggtactacctaccttaccacccgtaccttcccttaatactagttacgggtaccgacgaccggtccccgtagggacgtaggggtcttaggacggttggtaggtcgggttacctaacgtaccgtaaacccgttggtcgggtaggtacttacgtaaacgtaacgtttaccacaacgaaggaagaagtcggacggaacgggtacccgtaaattaacccgagtacgaaccaggtaacgaaccgtaacgtacccgaacggtaacgttaaccgaacgttactaacgtaggtacgggtagggtacgaacggacgaacggtaccgtaggaacggtacttaccggagggtaaccggaaccggtaaccggtacccgtaggttaccggtttaacgtttacggtcggttacggtacgttaacgtttacggttaagggttaacgggttaacctttaaccggtaaccttaaacgtttaacgttttaacgttttacggtaccgtaccgggttaaacccggg

SEQ ID NO: 9678 - DNA, 688 bp, Homo sapiens
  misc_feature: GYAE6OF01CCAON.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccaggtgcagctggtacaagtcggggctgagataggaagacgccgtggggcctgagtgatgtactttcctgacacgactatcgtggaactacctaccttccaaccgtaccttcccttaataccgtagttcgggtacgacgaccgggccccgttgggacgtaggggcttggaggtgggaagttcggggtactaacgtaccgtaaacccgttaggtggggtaggtacttacgtaaacgtaaacgtttactacaacgaaggaacgaagttgggacgaacgggggtaaccctaaatttaccgagtacgaaccgaacggacggaaccaccggtaccaacggaacgtaactacgtacctaacgtaggtacgggaggtggaacgcgtacgaccgtaggaagtacgtcggtacggaagggaccgaccggtactaagttacgtattaccgttgtacgacgttattaccggtttaggtacggttactttaacgaacttaacttaagtttaagttttcgaccgacgtaacccgg

SEQ ID NO: 9679 - DNA, 545 bp, Homo sapiens
  misc_feature: GYAE6OF01ET8XJ.53.73.G07.1.454.CMB.1.raw
  modified_base (405)..(405): a, c, t, g, unknown or other
  misc_feature (405)..(405): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccgagggaaacgcccctagactcctgatctataagacgttctactttagacaggtgggtccatcaaggttcagcgcagtggatcgtgggacagtagtcactctcaccattagcagcctgcagctgatgtatttgactaattattacngaccaacagtaactaagttactttgacggtacgttcggaccgtaagggacctaagggtagaaactacgaaacgtacgtggtacggcttaggacctaccgacttcgtacgttaccttactacttcccgttcccgccttacg

SEQ ID NO: 9680 - DNA, 798 bp, Homo sapiens
  misc_feature: GYAE6OF01D58OH.53.73.G07.1.454.CMB.1.raw
  modified_base (236)..(236): a, c, t, g, unknown or other
  misc_feature (236)..(236): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatagaagaacgccgtggggcctcgagtgatgtactttccngcacgacatcgtgactaccaccttccaccgtaccttacccttatacgtagttcggggtaaccgaccgaccgggtcccccgtagggaccggtagggggtccttagggacggttagggtacgttacggggttaacctaaacgttacccgtaaacccggtttagggtcgggttacggtaacttaccgttaaacgttaaacgtttaaccacgtaacgaaggtaacgtaacgtcggaccggtaacgggtaacccgtaaacttacccgaagtaccgaaccgaaggtaaccgaaccgtaaccgtacccgtaacggtaacgtaacctacgttaccgtaagtaacggtagggtaacggtacggtaacgcgtaacggtcccgtaaggaacgttacgttaccggtacgggtaaccggaacccggtaccggtaccttaaggtttaccgttaaagtttccggtacggttaccggtacggttaacgttttaggttaacggttacggttaaacctttaaccggtaaactttaaacgttacgttttaacgtttcggtaaccgtacccggtaaaccggg

SEQ ID NO: 9681 - DNA, 822 bp, Homo sapiens
  misc_feature: GYAE6OF01DI27K.53.73.G07.1.454.CMB.1.raw
  modified_base (132)..(132): a, c, t, g, unknown or other
  misc_feature (132)..(132): n is a, c, g, or t
  modified_base (171)..(171): a, c, t, g, unknown or other
  misc_feature (171)..(171): n is a, c, g, or t
  modified_base (232)..(232): a, c, t, g, unknown or other
  misc_feature (232)..(232): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttntgcttgctgtcagtagctccaggtgctcgctcccaggtncagctggtacagtcggggctgagatgaagaagccgtggggcctcgagtgatgtactttccngacacgactactcgtaggacttaccgtacctttcaacccgtaccttaccctttaataaccgtacggtttacggggtaccgtaccgaccgggtacccccgttaggggaaccggtacggggggttcctttagggaacggttcgggtaagttcggggttaacttaaacgtacccgtaaacccgttaagggtcgggtacgtacttacgtaaccgtaaacggtttaccacgaacgtaaggaacgtaaacgttcggaccggtacggggtaacctaaacgtttacccgaagttaccggaaaccgaaggaacggtaaccctaaccggtacccgtaaacggtaacgttaaccgaagttaccgtaacgtaggtaacggggtacggtacggacggtaccgacgtccgttaggaacgtacgttaccgtagggacggtaaccgaccggtaccttaggttacgtttaacgttacgtacggttacggacgtttaagtttaccggtttaaacggttaacgggttaaaccgtttaacccgttaaaaccgttaacgtttaaaacgttttacggtttttaaccgaacccgttccggtaaaaccccgggg

SEQ ID NO: 9682 - DNA, 655 bp, Homo sapiens
  misc_feature: GYAE6OF01E0YX3.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgtatttccngcacgacatctaggataccaccttccaccgtacttacccttatacgtagttcgggtacaccgacggccccgtaggaccgtagggggtcttggaggtggagttcgggtactaagtaccgtaacccgttaggtggtaggacttaccgtaacgtaacgttacctacaacgtaggaacgtaagtcggacggacgggtaccgtaaattaacccgagtacgacctaaggaacgaccaccgtaccaacgtaacgtacgacgtacgaacgtaggtaggaggtcgagcgtacgccgtaggacgtagtcggtaggaacggacgacggtactagttagttacgttacgtgtacgtacgtacgtttagtaagggttacgtaacgttaaccggtaacttaacgttaatttaattttcggacctacggtaacccgg

SEQ ID NO: 9683 - DNA, 548 bp, Homo sapiens
  misc_feature: GYAE6OF01BE9TX.53.73.G07.1.454.CMB.1.raw
  modified_base (431)..(431): a, c, t, g, unknown or other
  misc_feature (431)..(431): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgatttcctgcacgacatctggatacaccttcaccgactcccttatacattggtacgacaggcccctggacaggggcttggagtggatgggtactatcaaccctagtggtggatctacaagttactacacagagaatgcacgggccaattaccatcgaccagagacacgtcacgagtacagtctacatgggaggtgagcacgctgagntacgtggaggacacgggacctagttgttaactacgttgtagcgtaacgttcgtttaaggtggtaactttaacggaacttaactaaagtttagtttttcgtacgtacggtaaccccgg

SEQ ID NO: 9684 - DNA, 695 bp, Homo sapiens
  misc_feature: GYAE6OF01C2WU4.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgtatttcctgcacgactatcgtggactacaccttcaccgacttcccttatactagttcgggtacgacgacggccccgtggaccgaggggtcttggaggtggagtcgggtactaactccgaaaccgttggtgggtacggtacttaccgttaaacgtaaacggtttacctacgacgtaaggaagtaaacgtcggacgacggggtacctaaatttaacccgagttacgaaccgaaggacgtaaccgaccgtaccgacgtaacgtacgagttaccaacgtagtagggaggtagacgacgaggtccgaggtacgtactcggtaacgggaacgggaccacgggtacctagttacggttaatttaacggtggtacgtaccggttacttaccggttaaggttacgggttaaactttaaccggtaaaccttaaacgttaaagttttaacttttacggtaaccgtacccgggttaaacccgg

SEQ ID NO: 9685 - DNA, 563 bp, Homo sapiens
  misc_feature: GYAE6OF01BEHQF.53.73.G07.1.454.CMB.1.raw
  modified_base (352)..(352): a, c, t, g, unknown or other
  misc_feature (352)..(352): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatacagttgggtacgacacggccccgtggacaggggtcttggagtggatgggtctaatcaacccgtgtggtggatctacaagttacncacagagaatgacgagggacctaattaccatacgaccagacgacacgtccacgagtacagtctacgagtgggaggtgacgcgacgccgtaggagtagtcgtaggaacggaccgacggacctagtgttaacttcgtggtcgacgtacttacgttaggtcggtaacgtttaaccgaacgttaactaatttagttttcgccgtacggtacccgg

SEQ ID NO: 9686 - DNA, 752 bp, Homo sapiens
  misc_feature: GYAE6OF01BUEAK.53.73.G07.1.454.CMB.1.raw
  modified_base (234)..(234): a, c, t, g, unknown or other
  misc_feature (234)..(234): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcggggctgagatggaagacgccgtggggcctcgagtgatgtactttccgngcacgactatctggactacctaccttccaccgtaccttaccttaatactagttacgggtacgacgacggtccccgtaggaccgtaggggtcttaggaggtggagttcgggtactaacgtaccgtaacccgttaggtcggtacggtacttacgtaacgtaaacgtttacctaacgaacgtaaggaaacgtaacgtcggaccggtaacgggtaacccgttaaaacgttaaccgaacgtaacggaaccgaacggtaacgtaaccgaacccgtaccgaaacggtaacgtaaccgtaaccggttactaaccgtagggttagggtaacgggtacggaacggaccgtacgggtacctagggaacgtacgtacgtaacgggaaccggtaccgaccggtacgtagttacgttaacgttacggtcgttacggtacgttacgttacggttacggttaacgttaacgttaaccgttaaaccttaactttaacgtttaacgttttacgtaaccggtacccggtaacccggg

SEQ ID NO: 9687 - DNA, 512 bp, Homo sapiens
  misc_feature: GYAE6OF01ENTHT.53.73.G07.1.454.CMB.1.raw
  modified_base (406)..(406): a, c, t, g, unknown or other
  misc_feature (406)..(406): n is a, c, g, or t
  modified_base (489)..(489): a, c, t, g, unknown or other
  misc_feature (489)..(489): n is a, c, g, or t
  modified_base (509)..(509): a, c, t, g, unknown or other
  misc_feature (509)..(509): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggcagccaaagtataagacctggtgctggtatcagcagaaaccagggaaagcccctagactcctgatctataagacgtctactttagacagtgggtcccatcaagttcagcggcagtggatcgtgggacagacgttcactctcacattagcacgcctgcagcctgatgtatttgctaacttattactgaccaangtaacaattacttgtaggtacgttcggaccgaagggtaccaagggtagaaataccaaaacggtactgtggtctggacacactntgttcttacattctcccgtntac

SEQ ID NO: 9688 - DNA, 585 bp, Homo sapiens
  misc_feature: GYAE6OF01BVAHQ.53.73.G07.1.454.CMB.1.raw
  modified_base (230)..(230): a, c, t, g, unknown or other
  misc_feature (230)..(230): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtgggcctcgagtgatgatttccngcacgacatctaggactaccaccttcaccgtaccttcccttaataccgtagttcgggtaccaaccgacggtcccctagggaccgaggggtctttggaggtggagtgggtactaagtccaaccgtgtggtggatctaactagttacncaacgaganagtcgcgacggacctaataccatacgacagacacacgacgacgatacagtacacagtaggagtagagcgagtcgtagagatgacgacgacgacgacctagtacgttagttacgtgtacggtacgtacgttacgttaggtacgttaacgttaaccgtacttaaacgttaatttacgttttacgaccgtacccggtaaccgg

SEQ ID NO: 9689 - DNA, 778 bp, Homo sapiens
  misc_feature: GYAE6OF01B5J90.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggaggtcttctgcttgctgtcagtagctccaggtgctcgctcccaggtgcagctggtacaagtcgggggctgagatagaagacgccgtgggcctcagtgatgtatttccgtgcacgacatcgtagactaccaccttaccacccgtaccttacccttatacgtagtttcggggtaaccacgtacggcccccgtggaccgaggggtcttaggaggtggtagtcgggtactaacgtccgtaacccgtaggtggtagacttacgtaagtaacgttacctacgaacaaggaagtaagtcggacgtacggggaacctaaacttacccgaagttaccgaacctaaggaaaccgtacccgtaacccggtacccgaaacggtaacgttaacgtaacgttaccgttaacgtaggttacggggtaaggtggaaccggtacgtaacggtacccgttagggaaacgtacgttaccggacgggtaaccggggaccgaacccgggtaccttaggttacgtttaacgttttaacggtcggttaacggaccggtttaacgtttacccgggtttaaagggtttccgggtaaaacgttttaaaccccggtaaacgttttaaaccgtttaaagtttttaacggttttccggaaacccgtacgggttaaaccccgggg

SEQ ID NO: 9690 - DNA, 868 bp, Homo sapiens
  misc_feature: GYAE6OF01DIJDT.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcggggctgagatgaagaacgccgtggggcctcgagtgatgatttcctgcacgacatccgtaggactaccaccttcaccgtactcccttaatactagttcgggtaccgacgtacggcccccgtagggaccgtaggggctttaggacggtggacgttggggtacttaaacgtccgaaacccgttaggtcgggttaggtaacttacgttaaacgtaaagtttaccacgtaacgaaaggaaggtaactcggaccgaacgggggtaccctaaagtttaaccccgaagttacggaaacccgaaggtaaccggtaacccgtaaccggttacccaaaccgggtaaacgttaacccgtaacgggtttacccttaaccgtaagggttacggggtaaacgggtcggtaaacgggcccgtaaggtaccccggtagggtaacgggtaacgtttcccggtacggggtaaaccgggaacccggtaaccgggttaaccccgttaaaggtttaccggttttaaccggtttaaccgttacggggttaacggttaacccgggtttaaacgttttacccgggtttaaaacgggtttaccggggttaaaaccgttttaacccggggttaaaacccttttaaacggttaaaacgtttttaacgtttttttaaccgggaaacccgttaccgggttaaaccccccggg

SEQ ID NO: 9691 - DNA, 645 bp, Homo sapiens
  misc_feature: GYAE6OF01CHSSF.53.73.G07.1.454.CMB.1.raw
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (637)..(637): a, c, t, g, unknown or other
  misc_feature (637)..(637): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagaccaaagtactaagacctggttggcctggtatcagcaagaaaccagggaaaccnccctagaccctnagtactataacgtacgtacttacttaacgtacgacggtcgggtacccgtactacgaacgttacgtacgacggcgaggtaggtagtacggtacgggacggaacgtacggttaccgtaacctacgttccaaccttaacgttaagtaccgacgtacctcggacgaaccgtccgtagtagtacgtttagtttaacgtaccttaacttaactttactacgacctaaacgaagttactaaacttacgtttgtacggtacggttacccgtacgggaacggaacggtaacgtaaggaactaacaaacgacgtgtacggcgtcaccgactgttccttgttccgttactactccgttaccccncctatacg

SEQ ID NO: 9692 - DNA, 609 bp, Homo sapiens
  misc_feature: GYAE6OF01EMML3.53.73.G07.1.454.CMB.1.raw
  modified_base (273)..(273): a, c, t, g, unknown or other
  misc_feature (273)..(273): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacgttggcccgggcagaccaaagtattaagacctggttggcctggtatcagcaagaaaccagggaaacnccctagactcctgatctataagacgtctactttagacaggtcgggtcccatcgaaggttcagcggcaggtggatcgtagggacagtacgttcactctacacctattacgcacgcctgaccagtcctgtacttgtatttgacttaactttattactcgtacctaaacgacgttaactaagttacgtttggtacgggtaccggttacgggtaaccgtaaacggggtaaccgtaaagggtacggtaaaactacgaaaaccggtactacgggtacgggtaccgttaggacctaccgtacgttcgttacgttaccttactacgttcccttccccgcctacg

SEQ ID NO: 9693 - DNA, 673 bp, Homo sapiens
  misc_feature: GYAE6OF01BOIKZ.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgctcccgaggtgcagctggtacaagtcggggctgagagtagaagaagccgtaggggcctcgagtgatgtacttcctgcacgacatcgtggtactactaccttccaccgtaccttcccttataccgtagttcgggtaccacgtccggccccgtggacgtagggtcttaggaggtgagtggtactaacgtaccgtaaccgtagtgggtagtagttaccgtaactaaacgttacctacgaacaacggaagtaacggtacgacggaacgggtaaccctaaagtttaaccaacgtacgaccgaagaacgtaaccgaccgtaacgacgtaacgtaactacgtacgtaacgtagtagggtacggtagacgacgacgtccgtagtaacgtaaccttcggaacgggtaacggacccgaacggtacctaggttaacgttataccgttaggtcgtacgttacgttacggttaaggtcggttaacttacgaacgttaattatttagtttacgcgaccgtaccgg

SEQ ID NO: 9694 - DNA, 698 bp, Homo sapiens
  misc_feature: GYAE6OF01CCHLC.53.73.G07.1.454.CMB.1.raw
  modified_base (234)..(234): a, c, t, g, unknown or other
  misc_feature (234)..(234): n is a, c, g, or t
tcagcgcgtatacacacgaccggtgctcgatttagctctacgctcaggggatcatccaacaaccacatcccttctctacagaagcctctgagaggaaagttcttcaccatgactggacctggagggtcttctgcttgctgtcagtagctccaggtgctcgctcccaggtgcagctggtacagtcggggctgagatagaagaacgccgtggggcctcgagtgatgacttttccgngcacgactatctggatacctaccttacacccgtaccttcccttatacctagttcgggtaaccgacgaccggccccgtggacgtaggggtctttaggaggttggagttcggggtactaacgtaccgtaaacccgttagggtacgggttaggacttaccgttaacgtaaacgtttacctacgaacgaagagtaacgtcggacgtacgggaccgtaaacttaccgagtcgaaccgaaggaacgaccgtaccgtacgacgtaagtacgtacgtactacgtagtagggaggtagacgcgacggtccgtaggaacgagttaccggtaggaacggaaccgtacccggtaccgtagttaaggttacttacggttggtacgtacgttacgtttagttaacgggttaggttaacttaaccggttaaacttaacgttaagttttacgttttacgtaccgaccgggttaaacccgg

SEQ ID NO: 9695 - DNA, 761 bp, Homo sapiens
  misc_feature: GYAE6OF01CLL3U.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtcctcccttccaccctgtctgcatcctgtcggagacagacgtcaccgtcacgttcggccgggaccaagaccaaaagttacttaacggaccgttgggttcggccgttggtactacgagacaaacggaaaccggaagggaaaccgtccccgtaagtacctaccgtagtacttactaacgtaacgtacgttacttaacgttacggacgtacgggttaccgggtaccctaacgttacgtaacggttcgaacgggcgggtacgtaggtggtacgttacggtacgggacgtaggtacgttctaccttactaccgtaacctaagttacgccgtaccgtccgtaggaccgacgtccttaggtaactttcggttaactttacgtacttaaacctttagttaccgtacgaaccctaaaggtacctttaaacttaaccgtttacggtttgggtaccgggttaccggttaaccgggtaaccgtaaacgggtaccgtaaagggttaacgaaacgtaacccgtaaaacggtcgttaggtaccgggtcttaacgacccgtaacgttacgttcgtttacgtaccctttaccgaaccgtttcccttcccgatttaccg

SEQ ID NO: 9696 - DNA, 504 bp, Homo sapiens
  misc_feature: GYAE6OF01EV3X8.53.73.G07.1.454.CMB.1.raw
  modified_base (338)..(338): a, c, t, g, unknown or other
  misc_feature (338)..(338): n is a, c, g, or t
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctanaagttactcacagagaatgcagggccgaattaccatgaccagagcacgtccacgagtacagtctacagtggaggtgagcagcctgagatcgtagaggacacggaccagtagtattactgtgcgtattcttaggtgtattacgacttanaattatttgcngtacccg

SEQ ID NO: 9697 - DNA, 141 bp, Homo sapiens; identical to SEQ ID NO: 9544
  misc_feature: GYAE6OF01DIUEM.53.73.G07.1.454.CMB.1.raw
  modified_base (141)..(141): a, c, t, g, unknown or other
  misc_feature (141)..(141): n is a, c, g, or t

SEQ ID NO: 9698 - DNA, 676 bp, Homo sapiens
  misc_feature: GYAE6OF01BV8PR.53.73.G07.1.454.CMB.1.raw
tcagcgcgtatacacacgaccggtgctcgatttagctctacgctcaggggatcatcccaacaaccacatcccttctctacagaagcctctgagaggaaagttcttcaccatggactggacctggagggtcttctgcttgctgtcagtagctccaggtgctcgctccgaggtgcagctggtacaagtcggggctgagatagaagagccgtgggcctgagtgatgtactttcctgacacgacatcgtaggactacctaccttccacccgtacttacccttaataccgtaggttcgggtaccacgaccggtccccgtaggacgaggggtcttaggagtggtatgggtactaagtcctaacgtaggtcggtagtacttacgtaacgtaaacgttacacgtaacgagtaagaagtcggaccgaagggtaccctaaacttaccagtaccgaacacggaagaaccgtaaccgtaccgaacgtaacgttaaccaggtttacaacgtaggtagggacggtgaacgtcgtacgccgtaggagtaacgttcggacgaacggaccgacgtactaagttacggttattacgtggttaccgagttaccgttaggtttaacggacgggtttaaaccttaaccgaacttttaaacgttagttttaacgtttcggaaccgtacggtaacccgg

SEQ ID NO: 9699 - DNA, 599 bp, Homo sapiens
  misc_feature: GYAE6OF01A8RF0.53.73.G07.1.454.CMB.1.raw
  modified_base (446)..(446): a, c, t, g, unknown or other
  misc_feature (446)..(446): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgattttccgtgcgacgacatcgtggactacctaccttccaccgtaccttacccttaatactattggggtaccgacacgggcccctggacgaggggcttggagtggagtgggtactaactcaacccgtaggtggtaggtatacctaactaaagtttacctcaacaggaagaatgcgacgggacctaattaccatcgaaccgagacgacacgtaccaagagtacngtactacagtgggagtgagcgacgcgtagagtactcgtagacggacgaccggactagttacgtattacgtggtcgaccgtagttcgttaaggttacggttaacttaaccgtaacttaaacgtaagtttagttttcgtacgtaacggtacccgg

SEQ ID NO: 9700 - DNA, 583 bp, Homo sapiens
  misc_feature: GYAE6OF01EW1UM.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctggagatgaagaagccgtggggcctcgagtgatgtactttcctgcacgacatctggatacaccttcaccgtactcccttatacagttgggtacgacacggcccctggacgaggggcttggagtggagtgggtactaatccgaacccgttaggtggtggattctaacaaagttactacaacagaagaatggaccgagggaccgtaaattaccagtacgaaccgagacgacacgtcaacgagtacagtcaacgagtgggaggtagacgcacggccgtagagtatcgtaggaacggaccacgggcctagttcgttatttacgttggtagtcgtagttcgtttaaggtaggtacttaacgtaacttaactaattagttttcgcgtacgtacccgg

SEQ ID NO: 9701 - DNA, 596 bp, Homo sapiens
  misc_feature: GYAE6OF01C5QAM.53.73.G07.1.454.CMB.1.raw
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgactccttatacagttggacgacacggccccgtggacgnggggcttggaggtggatgggtactaactcaacccgtaggtggtaggatactaacaagtttacncaacaagagaatgcgagggaccgtaaattaccaagtacgaaccgagaacgaccgtaaccgtacccgaacggaacgtaacaaggttacctaacgtagtagggaggtggagcgagcctagagagttcgagacggaccgacgacctagttagttagttacgtggtacgcgtacgttacgttaggtggttaacttaacggaacttaactaaagtttattttacggcgtaacggtaacccgg

SEQ ID NO: 9702 - DNA, 823 bp, Homo sapiens
  misc_feature: GYAE6OF01CCD5L.53.73.G07.1.454.CMB.1.raw
  modified_base (196)..(196): a, c, t, g, unknown or other
  misc_feature (196)..(196): n is a, c, g, or t
tcagcgcgtatacacacgaccggtgctcgatttagctctacgctcagggggagtcagacccagtcaggacacagcatggacatgagggtccccgctcagctccgtggggctcctgctgctctggctccaggtgaccaaatgtgacatccagatcgacccagtccttcccttccaccctgtctgctatctgacgganacagagtccaccgtcacgtcggccgggcaacgaccaaagttactaacgccgtggttcggcgtggtatcgagacaacggaaaccgacgggaaacctcccgtagacctccgtagacttacgtaataacgtaccgttaccgttaacgttaacggaccgtaacggttccggggtaaccctagtaccgtaaggttaccgacgggtacgacggtaggtacggtaacgttcggtaacgggtacgtaacgtacggttacctacgttacctaaccgtaccttaagttaccggacgtaaccggtccgtaaggcccgttaacggtcccgttagtaacgtttagtttacgtttaacgaccgtttaacctttaacgtttacgtacccgtaaacttaaccgtaactttaagttaaacccgtttagggtttacgtaacccggggttaacccggttaaccgggaaccggtaaaaccggggtaaaccgttaaagggtaaccggtaaaacttaaccggtaaaacggttacccggttaggtaccgggtaccgttaaccgggtaacctaaccccgtttagtaccccgttttacgttacccgtttacccgtaccgtttacccccgggttaccttacccgtttaaccgg

SEQ ID NO: 9703 - DNA, 578 bp, Homo sapiens
  misc_feature: GYAE6OF01B276K.53.73.G07.1.454.CMB.1.raw
  modified_base (268)..(268): a, c, t, g, unknown or other
  misc_feature (268)..(268): n is a, c, g, or t
  modified_base (343)..(343): a, c, t, g, unknown or other
  misc_feature (343)..(343): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtataagacctggttggcctggtatcagcagaaaccagggaaacnccctagacctcctagactctataacgacgtctaactttagactaggtcggggtacccatcgaaggttcaggcggnaggtggatcgtggacaggtagtcactctacacctattagcagcctgcagtcctgatgtatttgacttaacttattacacgaccaatacgtaactaattacgtttggtacggtaccggttcggaccgaaagggtacctaagggtagtaaaacgtaccgtaaaacgtacgtaggtacggactacgacctaccgtagttccgttacgttccttactactttcccttccccgtctaacg

SEQ ID NO: 9704 - DNA, 597 bp, Homo sapiens
  misc_feature: GYAE6OF01D4JMV.53.73.G07.1.454.CMB.1.raw
  modified_base (588)..(588): a, c, t, g, unknown or other
  misc_feature (588)..(588): n is a, c, g, or t
tcagcgcgtatacacacgaccggtgctcgatttagctctacgctcaggggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacgttgccgggccagccaaagtattaaagacctggttggcctggtatcagcaagaaaccagggaaacgcccctagactcctgatctataagacgtctactttagacaggtcgggtccatcaaggttcagcgcagtggatgtgggacagagttccatctcgaccagttagactagcctgaccagtcctagactgtacttttcgacttaactttattacctagacctaaactaggtaactaatttacgtttagggtacggttaaccgttccggaaccgaaacggggtaaccgaaagggttaggaaaacttaccgaaaaacgtaccgttggtacggtctaggaaccaccgtacttcttaggtcctttacaacgtttcccgttcccncgttaaccg

SEQ ID NO: 9705 - DNA, 833 bp, Homo sapiens
  misc_feature: GYAE6OF01BSA79.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggcctcccgaggtgccaaatgtgacatccagatcgacccagtcctccttcccaccctgtctgcatctggtcggagacgagacgtccaccgtctacgttcggcccgggccaagacctaaagttacttaacggaccgttgggttacggcctaggtactcgacgacgaacgaaaccgaacgggaaccgtacccgtacgacctccgtagtaactacgtaacgtaacggtaccgtttaccgttaacgtttacgacgtacgggttccgggtaccctagtaccgtaacggttaccgagggtcggtacgtacggtaggtaacgttccgggtaacgggaaccgtacggtacgttacccgtaccttcccgtaccctaacccgttaaggttaacggccgtaaccggtcccgttaggtacccgtaaacggttccttaagggttaacgtttacggtttaacgtttaacggtacccttttaaaccgtttacgtttaaccgtacccgtaacctaaacgttaacgtttaaccgtttaaacgtttacggtttcggtaaccgggttaccggttacggggtaaacccggtaaacgggtaaaccgggttaaggtaacggtaaacgtaaaccggtaaaccgggtacgttacggaccggtcgtaaccgtacctaccgttacgttaccgttacgttaccttaccgttacctttccccggttacccgtccttacgg

SEQ ID NO: 9706 - DNA, 579 bp, Homo sapiens
  misc_feature: GYAE6OF01ARM97.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcggagacagagtcaccgtcacttggccgggcagccaaaagtattaagacctggttggcctggtatcagcaagaaaccagggaaacgccctagacctcctgatctataacgacgtctactttagacagtcggggtcccatacaaggttcagcggtcagtggatcgtggacagagttcacgtctacactatagcagcctgacacgctgattgtatttcgactaacttacttaacgtcgacctaatacgtactaacgtttacgtttagtacgggtaccgttacggacgtaacgggaaccgtaagggtaacgaaagtaccgaaaagtacgtaggtcggtactgaacgccctaacgttcgttaccgttcttactaccgttaccgttccccgacttacg

SEQ ID NO: 9707 - DNA, 818 bp, Homo sapiens
  misc_feature: GYAE6OF01BPNVJ.53.73.G07.1.454.CMB.1.raw
  modified_base (216)..(216): a, c, t, g, unknown or other
  misc_feature (216)..(216): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccaggtgctcgctcccaggtgcagctggtacaagtcggggctgagatgaagagccgtggggcctnagtgatgtactttcctgacacgacatctaggactacaccttcaccgacttcccttatacagttcgggtacgacacggtcccctagggacgtacggggtcttggacggttaggacgtttcggggtacttaaacgtacccgaaaccccgttaagggttgggtacgggtaacttaccgttaaaccgtaaacggttttaacctaccgaacgtaaacggaacgggtaaaacttcgggaccgtaacgggggtaaccccgtaaaaacgttttaaccccgaagtttaccggaaacccggaacgggtaaacggaaacccgtaacccgggtaccccggtaaacccgggtaaacgttaaccggtaaaccggttaaccgtaaccggttaacggttaacggggggttaagggtacgggtaacgggacccgaaggttaccccgttacgggaaacggtaacgttaccggtagggtaaccgggaaccgtaacccgggtaccctaagtttacgtaacgtttaccgttaggtacgtcggtaattaccgttaggttaggtaacgtttaaccgtaaacttaaccttaaacgtttaagtttttcggaacgtacggtaacccgg

SEQ ID NO: 9708 - DNA, 547 bp, Homo sapiens
  misc_feature: GYAE6OF01AQNZM.53.73.G07.1.454.CMB.1.raw
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
tcagcgcgtatacacacgaccggtgctcgatttagctctacgctcagggggagtcagacccagtcaggacacagcatggacatgagggtccccgctcagatcctggggctcctgctgctctggctcccaggtgccaaatgtgacatccagatgacccagtctccttccaccctgtctgcatctgtcggagacagagtcaccgtcacttgccggcagccaaagtataagcctggtgcctggtatcagcagaaaccagggaaagcccctagactcctgatctataagacgtctactttagacagtcggggtccatcaaggttcagcggcagtggatctgggacagagttcactctcaccattagcagcctgcagcctgatgntttnactaacttattactcgaccaacagtacaattactttgtacggtacgtttcggaccgtaagggacctaagggtacggtaaacgtcaaaacggtacgtacggtaggtcctaggacctaccgtactccttacgttcctttacaacttccttccccgtcgttaaccg

SEQ ID NO: 9709 - DNA, 549 bp, Homo sapiens
  misc_feature: GYAE6OF01ANYV2.53.73.G07.1.454.CMB.1.raw
  modified_base (350)..(350): a, c, t, g, unknown or other
  misc_feature (350)..(350): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatacattggtacgacacggcccctggacaggggcttgagtggatgggtctaatccaaccctgtggtggatctacaagttactcanagagaatgcagggaccaattaccatgaccagacgacacgtaccacgtacgtacagtctacgagtggagtgacgcgacgtccgtagacgtagtcgtaggaacggaccgcggaccagtgttaacttactaggtcgacgtacttgtttaaggtcggtaacgttaccgtaacgtaactaatttagttttctcgaacgtacccg

SEQ ID NO: 9710 - DNA, 908 bp, Homo sapiens
  misc_feature: GYAE6OF01AJJU9.53.73.G07.1.454.CMB.1.raw
tcagcgcgtatacacacgaccggtgctcgatttagctctacgctcgagggggagtcagacccagtcaggacacagcatggacatggagggtccccgctcagctccgtggggctcctgctgctctggctcccaggtgccaatgtgacatccagatgacccagtctccttccaccctgtctgcatcgtgtcgagacagagtcaccgtcacttcggccgggccagaccctaaagttacttaacggaccgttgggttcggtcccgtgggtactaccgaggaccaaggaaaccggacgggaaacgccccctaaggaccttcccgtagtacgttactaagtaacgtaaccgttcttaacgtttacggaaccggtaacggttcgggggtacccctagttaccgtaacgggttcgacggtccgggtaccgtaagggttacggtacgttacggttacgggggaacctaaacggggttacgtttacccgtaacccgtttaccgtaacccgtaaacccgttaagttttaaccgggacccgttaaccggtacccgttaacgggcccgttaaccgggaccccttacggttaagtttaacggtttaacgttttacccgggtaaccctttaaaccgttttaacgtttacccgttaaccgtaacccgttaaaccggttaaccgggtttaaacctttaaaccgggttttaaccgttttttacggggtaaaccgggtttaaccccggtttacccggggtaaaccccgggttaaaggggtaaacccgggttaaagggttaaacccggaaacgtttaaaccggaaaaccggtttaaccggtcgggtaaccggtaccgtacggtacctaacccgtattcccgttacggttccctttacctacccgtttccccgttcccgacccgttacg

SEQ ID NO: 9711 - DNA, 139 bp, Homo sapiens
  misc_feature: GYAE6OF01CCVLH.53.73.G07.1.454.CMB.1.raw
  modified_base (136)..(139): a, c, t, g, unknown or other
  misc_feature (136)..(139): n is a, c, g, or t
tcagcgcgtatacacacgaccggtgctcgatttagctctacgctcagggcacgaccggtgctcgatttagtacacgtgattagggattgggtgatagggtacgcactcgtctgagcgggctggcaaggcgcatagnnnn

SEQ ID NO: 9712 - DNA, 864 bp, Homo sapiens
  misc_feature: GYAE6OF01BTMB1.53.73.G07.1.454.CMB.1.raw
  modified_base (196)..(196): a, c, t, g, unknown or other
  misc_feature (196)..(196): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccgaggtgctcgctcccgaggtgcagtcgtggtacaggtcggggntgagagtagaagacgccgtggggcctcgagtgattgtactttccgtagaccacgactacgtcgtacggaactacctaccttaccgaccgtaccttccttaatacgtagttacgggtaccaccgccggtccccgtaggaccgtagggtcttaggaggttggacgttacggtactaacgtaccgtaaccgtgggtacggtacggtaacttacgtaacgtaaacgtttaccgaacgaacgtaaggtaacgtacgtacgggaccggtaaaccggggtaaccttaaacggttacccgtaacggttaccggaaacccgtaacgggtaacccgaacccggttaaccccggttacccgaaaacgggttaacggttaaccgtacggtttaaacccgtacggtaaggggttacgggtaacgggttacggacggtaccgtaacggtaccgttaacggtacggtagttaaccgggtaagggtacccgggaaccggttacggtaccctttaaggtttaacgggttaacctttaacgggttcggttaacgggttaccgtttaaacggtttaaccggttttaacggggtaaacgtttaaaccggttaaacccgtttaaacgtttaaacggttaacgtttttaaccggttttacgggaaacccggttaccgggtaaacccgggg

SEQ ID NO: 9713 - DNA, 726 bp, Homo sapiens
  misc_feature: GYAE6OF01D3XK7.53.73.G07.1.454.CMB.1.raw
  modified_base (234)..(234): a, c, t, g, unknown or other
  misc_feature (234)..(234): n is a, c, g, or t
  modified_base (422)..(422): a, c, t, g, unknown or other
  misc_feature (422)..(422): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtcgctcgctcccgagtgcagctggtacagtcggggctgagatagaagacgccgtggggcctcgagtgatgtactttccngacacgacatcgtagatacctaccttaccaccgtaccttccttaataccgtagttcgggtaacaccgtacggccccgtaggacggtaggggtcttaggaggtcggaggtcgggttactaacgtaccgtaaacccgttaggttgggtacgacgttactaaacgtaacgtttaccacgaacgaggtaaanacgtaggaccggacgggtaacctaaattaccaagttccgaaccgaaggaaccgaacgtacccggtaaccgtaacggtaacgttaacgacgttaccgtaacgtaaggtcgggtaaggtggaaccgtcggtaccgtcgtaaggcgaacgttaggacgggacggacccgtacggtaccgtagttacgttacgttaacgtggttacggtacgttaacgtttaggttaagggttcggttaaacgtttaaccgtaaacgttaacgtttaaagttttacgttttaacggtcccgtaccgggtaaacccggg

SEQ ID NO: 9714 - DNA, 150 bp, Homo sapiens
  misc_feature: GYAE6OF01A6CMR.53.73.G07.1.454.CMB.1.raw
  modified_base (150)..(150): a, c, t, g, unknown or other
  misc_feature (150)..(150): n is a, c, g, or t
tcagcgcgtatacacacgaccggtgctcgatttagctctacgctcagggacgaccggtgctcgatttagctctacgctcagggctctacgctcagggacgaccggtgctcgatttagcagacgtctgagcgggctggcaaggcgcatagn

SEQ ID NO: 9715 - DNA, 653 bp, Homo sapiens
  misc_feature: GYAE6OF01D0ZID.53.73.G07.1.454.CMB.1.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (472)..(472): a, c, t, g, unknown or other
  misc_feature (472)..(472): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcgggggctgagagtgaagagccgtgggcctnagtgatgtatttccngcacgacatcgtggactacaccttcaccgtaccttccttatacagttggtacgacacggcccctggacgngggtcttggaggtggagtcggttactaacgtaccgtaaacccgttagggtcgggtagacttaccgtaactaaacgtttactcaacgagaaagtaacgtggaccggaacgggtaccgtaaacttaccgaagttaccgaaccgaagacgacgaccgtaccgaacgtaacgtacncgttacagagtgggagtgacgcagtcctaggacgtatcggtagggaccgacggaccgtactagttacggttaacttacgtggtacggtacgttacgttacggtttagggttacggtaaccgtttaaccgaacctttaaacgttaacttttaaggttttacgtaccgtacggtaaccccggg

SEQ ID NO: 9716 - DNA, 660 bp, Homo sapiens
  misc_feature: GYAE6OF01CXDDN.53.73.G07.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (392)..(392): a, c, t, g, unknown or other
  misc_feature (392)..(392): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatagaaagaagccgtggggcctcgagtgatgtactttccngcacgtanatctaggataaccnccttcaaccgtacttcccttatacctagttcggaacacgacggccccgtggacgtagggcttggaagtggagtcggtactaacaccgtaaccgtaggtggtagtacttactaaagtaacgttacacgaacgtanaagagtcgaacggacggaccgtaactacgaagtaccgaacgaagtaaccgacgtaccgtaacgaacggtaacttacgaacgtacttaacgaaggtagggtagtaggaacgcgacgcgtaggacgtatacgggtaggaaccggaaccgtacggaacttaaggtttagtaaccgtttgccggttaggtaaccgttaagtttaccggttagttaacggtaaccgttaacgaacgttaacttaagtttactttcgacgtaaccgtacccggg

SEQ ID NO: 9717 - DNA, 644 bp, Homo sapiens
  misc_feature: GYAE6OF01C9HFP.53.73.G07.1.454.CMB.1.raw
  modified_base (170)..(170): a, c, t, g, unknown or other
  misc_feature (170)..(170): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgctcgctcccaggtncagctggtacagtcggggctgagatgaagagccgtggggcctgagtgatgtactttccgtgacacgacatcgtaggactacctaccttacaaccgtacccttacccttaatactaggttcggaaccgacgtccggccccgtaggacgtaggggtcttaggacggtggtacgttacgggtacttaaacgtccgtaaacccgttagggtcggtaggtacttactaacgtaaacgtttcacgaacgagaagtaagtcggacgacgggtactaactacagtacgaacaagacgtaccgacgtaccaagacgtaacagtacactagtggagtacgagacgacgtcgaggaagtacgtcgtaacgggaacggacgaccggtaactagttaagttacgttacgtggtacgacgttagttacggttagtacgttaacgtaccttaaacgtacttaacgtttattttcgacgtacgtaaccgg

SEQ ID NO: 9718 - DNA, 614 bp, Homo sapiens
  misc_feature: GYAE6OF01EV3KH.53.73.G07.1.454.CMB.1.raw
  modified_base (365)..(365): a, c, t, g, unknown or other
  misc_feature (365)..(365): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccggccagaccaaagtataagaccgttggtcggctggtatcagacaacgaaaccgaagggaaacgcccctaagacctcctagtactacgtaataacgtacgttactactttaacgacgtacgggttcgggtacccaagtacgtaaggttcaggcgngaggtgatcgtggactagtacgttcactcgacaacctattagcacgtctcgcacgtctgtatcgtatttcggacttaactttacttactacgaacctaatacgttaactaagttactttggacggtaccgttacgggacctaaggggaaccgtaagggtaacgtaaactaccgaaaacgtacgtggtacggtacttaggaccctaacgtacgtcgtttactcctttacactttcccgtcccgacgttac

SEQ ID NO: 9719 - DNA, 180 bp, Homo sapiens
  misc_feature: GYAE6OF01APFOC.53.73.G07.1.454.CMB.1.raw
  modified_base (173)..(180): a, c, t, g, unknown or other
  misc_feature (173)..(180): n is a, c, g, or t
tcagcgcgtatacacacgaccggtgctcgatttagctctacgctcagggcacgaccggtgctcgatttagctctacgctcagggcacgaccggtgctcgatttagctctacgctcagggcacgaccggtgctcgatttagcagacgtctgagcgggctggcaaggcgcatagnnnnnnnn

SEQ ID NO: 9720 - DNA, 693 bp, Homo sapiens
  misc_feature: GYAE6OF01DGY8R.53.73.G07.1.454.CMB.1.raw
  modified_base (255)..(255): a, c, t, g, unknown or other
  misc_feature (255)..(255): n is a, c, g, or t
tcagcgcgtatacacacgaccggtgctcgatttagctctacgctcaggggatcatccaacaaccacatcccttctctacagaagcctctgagaggaaagttcttcaccatgactggacctggagggtcttctgcttgctgtcagtagctccaggtgctcgctcccaggtgcagctggtacaagtcggggctgagatagaagaagccgtggggcctcgagtgatgtactttccgtgcacgacatctaggactaccnccttacacccgtacttcccttaatacgtagttacgggacacgaccggccccgtaggaccgaggggtctggagtggagtgggtactaacgtccgtaacccgtaggtcggtagacttacgtaacgtaacgtttacacgaacgaagtaacgaagtcggaccggtaacggggtaccctaaactttaaccgagttaacgaaccaaggtaaccgaaccgtaaccgtacccgaaacggtaacgtaactaaggtacctaacgtagtagggaggtagacgacgacgtaccgtaggaagtacgtacgtaagggaccggaaccgtaccgtacctagttagttaacgttacgtggttacgacgttaacgttacggttaaggtacggttaaacgttaaccgtaacgttaaacttaaagttttagttttacggaaccgtccggtaacccggg

SEQ ID NO: 9721 - DNA, 635 bp, Homo sapiens
  misc_feature: GYAE6OF01CIVVQ.53.73.G07.1.454.CMB.1.raw
  modified_base (233)..(233): a, c, t, g, unknown or other
  misc_feature (233)..(233): n is a, c, g, or t
  modified_base (570)..(570): a, c, t, g, unknown or other
  misc_feature (570)..(570): n is a, c, g, or t
  modified_base (624)..(624): a, c, t, g, unknown or other
  misc_feature (624)..(624): n is a, c, g, or t
tcagcgcgtatacacacgaccggtgctcgatttagctctacgctcagggatcatccaacaaccacatcccttctctacagaagcctctgagaggaaagttcttcaccatggactggacctggagggtcttctgtcttgctgtcagtagctccgaggtgctcgctcccgaggtgcagctggtaacagtcggggctgagatgaagagccgtggggcctgagtgatgtatttccgngcacgacatcgtaggactacaccttcaaccgtacctcccttaatacgtaagttcgggtaccgacgtacggcccctaggacgtacgggcttgaggtggtagtcggtactaacgccaaccgttgtggtggtatacgtaacgtaacgttacacgaacgagaacgtaagtcgacgacggggtacctaaattaccgagtaccgaacgaacgacgaccgacgtacccgaacggtaacgtaacgtacgttacgtaacgacggtagggtaggtacgaacgccgtaacggccgtaggtacgaagttcggtaaggaacggaaccgacggacctagttagtattacgngtcgagtacttcgttaggtcgttaagttaacgacgttaactaagtttagtttcncgaccgtacgg

SEQ ID NO: 9722 - DNA, 751 bp, Homo sapiens
  misc_feature: GYAE6OF01AB5BU.53.73.G07.1.454.CMB.1.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtctcccttccaccctgtctgcatcgtgtcgganacagagtccaccgtnacgttgccggcagccaaagtnttaacgccttggttcgacctggtatcgacgacaacgaaaccgagggaacncccctagacctccgtgacttactagtaagtaccgtacttacgtttagacgtagggtcgggtacccagtacgtaacggttcaaggcggacgaggttacggacgtacggtagggaactacggtacgttacacgttcctaacgtacctagttacgccgtacggtcctacggaccgtaccgtccgttagtacgtttgtttacgttttaacgacctttaaacttttccgttaacgtacccgtaactaaaccgttaacgttaaaccgttaagttttaccgggtttacggttaaccgggttacccggtttaacccgggtaaccggtaaaccggggtaaaccgttaaggggtaaccgtaaaaccgttaccgaaaaccgggttagttccggacggttaccgtaaccgttaccgtaccgttaacgtttccgttaaccgttaccctttaccgacccttttacccggtcccgttacgttacccg

SEQ ID NO: 9723 - DNA, 701 bp, Homo sapiens
  misc_feature: GYAE6OF01AGNZR.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctggtcggaagacgagacgtcaccgtcacttggccggccagccaaagtataacgacgtggtgccgtgtatcagcaagaaaccgagggaaacgccctacgactcctagactactaataacgacgtactacttagacgtaggtcggggtacctatacgtaacggttcgaggtcggacaggtgagtcgtacgggactacgtacgttcactactaccaacctacttacggcgtacgcccgtgaccgtaccgtccgtggtaacttacggttacttttaacgtaacctttaactttaacttaaccgtacgaaccctaaactacgttaacttaacgtttaacgttttcggtacgggttaccggttaccgggaacccgtaaacggggtaaccctaaggggtacgtaaaacggttaacccgaaaaggtaacccgttgggtaccggtacgttacgaaccgtaaccgttacttacccggttcgttaaccctttacgtaacctttccccgttaaccccgtaccgttaacccg

SEQ ID NO: 9724 - DNA, 574 bp, Homo sapiens
  misc_feature: GYAE6OF01E4KX5.53.73.G07.1.454.CMB.1.raw
  modified_base (274)..(274): a, c, t, g, unknown or other
  misc_feature (274)..(274): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagaccaaagtattaagaccgttggttggcctggtatcagcaagaaaaccagggaaacncccctagacctcctgatctataagacgttctactttagacaggtcggggtcccagtcaaggttcaggcggcaggtggatcgtagggacagtaggttccactcctccaaccattacgccacgcctgcacgcctgattgttatttgactaacttntactcgaccaanagtaacattacgttggtacggtaccgttcggaaccgtaacgggaccgtaagggtacggaaactacgaaacgtacgtggtaggtcctagaccctactactcgttactacttactaccttccgttccccgcttaacg

SEQ ID NO: 9725 - DNA, 964 bp, Homo sapiens
  misc_feature: GYAE6OF01DBTB5.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtctccttccaccctgtctgcatcgtgtcggagacgagacgtccaccgtctacgttcggcccgggccaacggacctaaaagttaagttaaacggaccgttgggttcggccttgggtataccaggaccaaacggaaaaacccgaacggggaaaaccgcccccgttaacggtacccttacccgtggtaacttaaccgttaataaaacggtaaccggtttacctttaaccgttttaacggaaccgtacggggttaccgggggttaccccctaagttaaccgtaaacgggtttaccgagggccggtacgtaggtacgggtacgttacggtacggggaacgtaaggttaccgtttactaacccgttaccttacccgtaaccctaagtttaaccgaccgtaaccgtcccgttaggaccccgtacggtcccgttagggtagttttacggttaacttttttaccggaaaccctttttaaaccgttttaacgttttaaacccccggtaccgtaaaccccgttaaaacgttaacccggtttaaacctttaaacgttttttaaccggtttacggggtttaacccggggttaaacccggggtttaccccgggggtaaacccgtaaaccggggggttaaacccggttaaaggggtttaacgggtaaaaaccttaaacccgggtaaaaacccggttacgttaccggggttaccgggtaccttaccgggtaaccctaaacccggttacgtttcccgtttaaccgggtttaccctttaaccgtttacccgtttacccccggtccccgttccccgttaaacg

SEQ ID NO: 9726 - DNA, 762 bp, Homo sapiens
  misc_feature: GYAE6OF01AJP3S.53.73.G07.1.454.CMB.1.raw
tcagcgcgtatacacacgaccggtgctcgatttagctctacgctcagggggagtcagacccagtcaggacacagcatggacatgagggtccccgctcagctccgtggggctcctgctgctctggcctcccgaggtcgaccaaatgtgacatccaagatcgacccagttcctcccttccaccctgtctgcatcgtggtacggagacagacgtcaccgtcacgttcggaccggaccacgaccaaaggttacttaacggtaccgttggggtacggccgttaggtactcgaaggaccgaaacggaaaaccggaacggggaaacctccccgtaagtacctaccgtactaacgttacctaagtaacgtaccgttacttaacgtttacggaccgtacgggttaccgggtaccctagtacgtaaggttccaggtccggagtaggtcgtacgtcggtagggaactaggtaccgttacaccttcacctactagttacgcgacgtctacgacgtcgtacgtggtattacggttactttacgtaaacctttaacgtttacgtaaccgttccgaacctaaacgtacgttaacctttaacgtttacggtttaccgggtacgggtacccggttaaccgggaaccggttaacgggtaaccggtaaggtaacggtaaaccttacgggaaaccggttacggtacgggtaccgtacgtaccgtaccctacttccggttacgtccgttaccgttaacttacccgttccctacccgtctacgg

SEQ ID NO: 9727 - DNA, 145 bp, Homo sapiens
  misc_feature: GYAE6OF01EWLU1.53.73.G07.1.454.CMB.1.raw
  modified_base (144)..(145): a, c, t, g, unknown or other
  misc_feature (144)..(145): n is a, c, g, or t
tcagcgcgtatacacacgaccggtgctcgatttagctctacgctcagggcacgaccggtgctcgatttagctctacgctcagggcacgaccggtgctcgatttagtgtcgtcgcaagagagagcgggctggcaaggcgcatagnn

SEQ ID NO: 9728 - DNA, 658 bp, Homo sapiens
  misc_feature: GYAE6OF01C4LNQ.53.73.G07.1.454.CMB.1.raw
  modified_base (235)..(235): a, c, t, g, unknown or other
  misc_feature (235)..(235): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagacgccgtggggacctcgagtgatgtactttccgngcacgactagtcgtaggtactacctaccttccgaacccgtaccttcccttaatactagttacgggtacgacgacggtccccgtaggacgtggggtcttggagtggagtcggtactagtacctaaccgtaggtcggtagactacgtaactaagttcacgagtagagaagtcgacgacgggacctaattaccgagtacgacgacgaacgtaccacgtaccgaacgaacgtacacgtacgtacgtagtacgggagtggacgacgacgtccgtaggaacgtacgtacgtacggaacggtaccgaccggtacgacgttacggttacgttaacggtgtacgtacgttacgtacgtttagggtacgttaacgtttaaaccgtacgttaaacttaactttagttttaccggaccgtaaccggtaacccggg

SEQ ID NO: 9729 - DNA, 652 bp, Homo sapiens
  misc_feature: GYAE6OF01EGAGH.53.73.G07.1.454.CMB.1.raw
  modified_base (232)..(232): a, c, t, g, unknown or other
  misc_feature (232)..(232): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcagtgatgtactttccngcacgacatcgtgactacctaccttaccacccgtacttcccttatacgtagttacgggtaaccgacgaccggtccccgtgggacgtagggggtccttaggaggtggtagttgggttactaacgtaccgtaacccgttaggttggtacgaacttactaaacgtaacgtttacacgaacgaggaagtaagtcggaccgaacgggaccgtaaacttaccagtacgaaccgtaaggaacgaacctacgtacccgaacgtaagtacctaacgtactaacgagtaggaggtacgacgacgagccgtaggaacgtatacgtaggaacggaccgacggtctaattagttacttacgtggtagtaccgtagttaggttaggtacgtaacttaacgtaacttaatagtttatttcgacgtacgtacccgg

SEQ ID NO: 9730 - DNA, 737 bp, Homo sapiens
  misc_feature: GYAE6OF01CJKIA.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggcctcccaggtgaccaaatgtgacatccagatcgaccctagtccttcccttcccaccctgtctgctatcgtgtcggagacagacgtccaccgtcacgttcgccgggccaagaccaaagttagtaacgaccgtggttcgctggtatacgacgacaacggaaaccgaagggaacctcccgtaagaccgtcctagactactataacgtcttactacttagacgtacggtcggtacctagtacgtaaggtcgaggtcgacgtaggtagtacgtcggacggtaacacgtacgttaccgacttccgtactaaccgttaacgtacgtaccgtacgtacccgttgaccgtacgtaccgttacgttattacggtttactttacgactttaactttacttaccgaccgtaactaaaccgttaataacctttaacgttttcgttaccgggtaacgggttacccggtaaccgggtaaccgggtaaacgggtaaccgtaaagggttacgtaaaacggtaccgaaaacgttaccgggttagtaccggtcttaccgaaccctccgttaaacgtttcccgttaccggtttactacccggtttaaccctttccccgtccccgttaactacgg

SEQ ID NO: 9731 - DNA, 661 bp, Homo sapiens
  misc_feature: GYAE6OF01DU320.53.73.G07.1.454.CMB.1.raw
  modified_base (171)..(171): a, c, t, g, unknown or other
  misc_feature (171)..(171): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccaggtgctcgctccaggtncagctggtacaagtcggggctggagatagaagaagccgtggggcctcagtgatgtactttctgcacgacatcgtgactacaccttcacccgtacttcccttatacgtagttgggtaccgacgacgggtcccctagggacgagggggtcttacggaggtaggtagtagggtacctaactaccgtaaccgtaggtggttacggattacgtaacgtaacggttacctacgtaacgaagaagtaagtcgacgtaacgggaccgtaacgttaccacgttacgaccgaaggaacgtaccgaccggtaccgaacggtaacgtaacgtagtaactaacgaggttacgggaggtacgaacggcgacgtccgtaggtaacgtacgtcggtaaggtacggaccgtacggtactagttcgttaacgttcgtcgtagacgtagttacttaggtcggtaacttaacgtacttaaacgttaatttactttcgacgtaccggtacg

SEQ ID NO: 9732 - DNA, 760 bp, Homo sapiens
  misc_feature: GYAE6OF01DTIOZ.53.73.G07.1.454.CMB.1.raw
  modified_base (578)..(578): a, c, t, g, unknown or other
  misc_feature (578)..(578): n is a, c, g, or t
  modified_base (718)..(718): a, c, t, g, unknown or other
  misc_feature (718)..(718): n is a, c, g, or t
  modified_base (723)..(723): a, c, t, g, unknown or other
  misc_feature (723)..(723): n is a, c, g, or t
  modified_base (730)..(730): a, c, t, g, unknown or other
  misc_feature (730)..(730): n is a, c, g, or t
  modified_base (755)..(755): a, c, t, g, unknown or other
  misc_feature (755)..(755): n is a, c, g, or t
tcagcgcgtatacacacgaccggtgctcgatttagctctacgctcgagggggagtcagacccagtcaggacacagcatggacatgagggtccccgctcagctccgtggggctcctgctgctctggcctcccgaggtcgaccaaatgtagacatccagactcgaccctagttcctcccttcccaccctgtctgcatcgtggtcggagacagtacgtaccaccgtctacgttcggccgggaccctaagacctaaaagttaacttaacggtaccgttgggttaccggtccgtttacggtactaccgacggaaccgaaacggtaaaaacccggaagggggaaaaccctacccccggttaaggtacccctttacccgtagtaaacgtttaacctaaacggttaaacggttaccgtttaacctttaaacggttttacggaacggtacgggtaccgggttaacccaacgtttacggtaaacggttccgagggtaccggtacgtaggtacggtacgttacgtacggggaactaggtacgttacaccgttcctacgtaaccctagttaacgcctacgtcctacgacncgtacgtacgtagttacgttaatttcgaacttactttacgtctacgtaacctaagtaacgttataagtttcgtttacgggaccggttaccgtacggaaccgtaagggacgtaagtaggaaactacgaacgtcgtaggtcncgtanccgtacnttccgtcgtactcgtacctcgtccngtacg

SEQ ID NO: 9733 - DNA, 719 bp, Homo sapiens
  misc_feature: GYAE6OF01CNZ92.53.73.G07.1.454.CMB.1.raw
  modified_base (230)..(230): a, c, t, g, unknown or other
  misc_feature (230)..(230): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccaggtgcagctggtacagtcggggctgagatagaagagccgtgggcctgagtgatgtacttttccngacacgacatcgtaggaacttacctaccttaccaacccgtaccttacccttaatacgtacggtttacgggaaccacgaccggtccccgtagggaccggtaggggtcttaggacggtgggtagttacgggtaaccttaacgtaccgtaacccggttagggtggtacgtaacttacgtaacgttaacgttaccacgaagagaagaacgtacggacgtaacgggtaccttaattacccgaagtccggaaccgaaggaacgtaacccgacgtaaccgtaaacggttacgtaacgtaacggtttacctacgggtaaggttcggggacggtagtacgacgtacggtaccgtaggtaacgtcgtaacggtaccggaacggtaccgtaccggtacttagttacgttaagttcgtaggtacgtagttaaccgttaggttacggtacgtaacttaactaacgttaattagtttacgttacgaacggaccggtaaccggg

SEQ ID NO: 9734 - DNA, 625 bp, Homo sapiens
  misc_feature: GYAE6OF01AR6NU.53.73.G07.1.454.CMB.1.raw
  modified_base (223)..(223): a, c, t, g, unknown or other
  misc_feature (223)..(223): n is a, c, g, or t
  modified_base (240)..(241): a, c, t, g, unknown or other
  misc_feature (240)..(241): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccggcagccaagtntagcctggtgctggtannagcagaaccgaggaacgccctagactcctgatctataagacgtactactttagacgtaggtcggggtcccagtactaaggttcaggcggacgaggtggatccgtagggacagtagttccacttcctacaccgtattacgactagcccgtgccagcccttagtactttaggtacttttacgacctaactttacttaaccgtcgaaccctaacgtaacgttaactaacgtttacgttttacggtcgggttaaccgtttacggacccgtaaacggggtacctaacgggtaggtaaactaccgtaaaacgtagttggtaacgggcttacggaccgtaccgtaacgttccgttagtaccctttacctacttcccgttccccgcttaccg

SEQ ID NO: 9735 - DNA, 185 bp, Homo sapiens
  misc_feature: GYAE6OF01D3W1S.53.73.G07.1.454.CMB.1.raw
  modified_base (177)..(185): a, c, t, g, unknown or other
  misc_feature (177)..(185): n is a, c, g, or t
tcagcgcgtatacacacgaccggtgctcgatttagctctacgctcagggcacgaccggtgctcgatttagacagtatatatccgcgggcacgaccggtgctcgatttagctctacgctcagggcacgaccggtgctcgatttagcagacgtctgtagcggctggcaaggcgcatagnnnnnnnnn

SEQ ID NO: 9736 - DNA, 641 bp, Homo sapiens
  misc_feature: GYAE6OF01CBBEP.53.73.G07.1.454.CMB.1.raw
  modified_base (554)..(554): a, c, t, g, unknown or other
  misc_feature (554)..(554): n is a, c, g, or t
tcagcgcgtatacacacgaccggtgctcgatttagctctacgctcaggggagtcatcctaacaacctacatcccttctctacagaagcctctgagaggaaagttcttcaccatggactggaccgtggagggtcttctgcttggctgtcagtagctccaggtgctcgctcccaggtcgcagctggtacaagtccgggggctgagatgaagaagccgtggggcctcgagtgatgatttcctgacacgactatcgtggatacctaccttcaccgaccttcctatacagttcggacaccacggcccctggacgagggtcttaggagttgggattacgggtactaacgtcctaacccgtagtcgggtagactcgtaagagttacacgacgagagaattcgacgagggtacctaattaccgaagtacgaacccaggaacgaaccgtacggtacccgaagtaacgtacgtagttaccgtaactaggttgggacggtagacgacgagaccgttagaacgtaatcgtacggagggaacctcgggacagttacgtacgttacgnggtaacggcgttaattcggttaacggttgaacgtttaacccgaactttaaccaagtttttacttcggttaaccgacggtaaccccgg

SEQ ID NO: 9737 - DNA, 553 bp, Homo sapiens
  misc_feature: GYAE6OF01ANF6T.53.73.G07.1.454.CMB.1.raw
  modified_base (190)..(190): a, c, t, g, unknown or other
  misc_feature (190)..(190): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacagagtcaccgtcacttgccgggccagccaaagtattaagacctggttggcctggtatcagcagaaaccagggaaagcccctagactcctgactctataagacgtctactttagacagtgggtcccatcaaggttcagcggcagtggatcgtggacagagtcactctcacattagcagcctgcagcctgatgtatttgactaacttattactgaccaaacagtaacaattacttttggtacggtacgttcggaccgtaaaggggacccaaagggttagaaaactcaaaacgtaacgtggtacgggcttacggactacccaattcgtacgttacctttacaacttcccgttccccgacctacg

SEQ ID NO: 9738 - DNA, 762 bp, Homo sapiens
  misc_feature: GYAE6OF01A1GRL.53.73.G07.1.454.CMB.1.raw
  modified_base (710)..(710): a, c, t, g, unknown or other
  misc_feature (710)..(710): n is a, c, g, or t
tcagcgcgtatacacacgaccggtgctcgatttagctctacgctcagggggagtcagaccagtcaggacacagcatggacatgagggtccccgctcagctcctggggctcctgctgctctggctcccaggtgccaatgtgacatccagatgacccagtctccttccacctgtctgcatctgtcggagacagagtcaccggtcacttcggccgggccagaccaaagtacttaagaccgttggttggtcctggtatccagacagaaaccgaggaaacgccctaaggacctcctagactcgtaagtaacgacgttacttactttaggactaggtcgggtaccatacgtaaggttcaggcggactaggtaggtactacgtggaacaggtacgtaccgtacgttacctacctacccgtaagtttaccggacgtaacgtccgtcggaccgtagtacccgtggtaacgtttaggttaacgttttttaccggaacctttaaccttttaacttaacccgtaccgtaaccgttaaaccgtaacgttaacctaaacgtttcgttttaacgggtaccggggttaaccgtttacccgggggaaaccgttaaaccgggggttaaccggtaaagggttacggaaaaccgttacggaaaaccggtaccggttacggttaacgggtccgttaccggtaaccgtaacccggttaacttccccggtttnttaccccgtttacggtaacccctttccccggttaaccccgtacccttaccgg

SEQ ID NO: 9739 - DNA, 716 bp, Homo sapiens
  misc_feature: GYAE6OF01A4FNR.53.73.G07.1.454.CMB.1.raw
  modified_base (191)..(191): a, c, t, g, unknown or other
  misc_feature (191)..(191): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcgganacagacgtcaccgtcacgttcggcccgggccaagaccaaaagttattaagaccgttggttggcctggtatcgagacaagaaaccagggaaacgtccccgtaagacctacctgacttactaagtaacgtacgttacctactttacggacgtacggtcggggtacccctagtaccgtaaggttccgaggccggtacgaggttacggacttcgtagggaacctaggtacgtttaccgacgttccgtacctaacctagttacgactacgccgtgaccacgtcccttagtacttggttacttttacggaccttaaacgttttactaaccgtacgaacctaaaccttaacgttaactaaacgtttcgtttacgggtaccggttaccggttaccgggacccgtaaaggggtaaccctaaaggggtacgaaaaacgtacggtaaaacgtaccgttcgggttaggaccttagaccctacgttacgttccgttacgttaccctttacaacttttcccgttcccgtaccgttaacg

SEQ ID NO: 9740 - DNA, 667 bp, Homo sapiens
  misc_feature: GYAE6OF01BEQWX.53.73.G07.1.454.CMB.1.raw
  modified_base (277)..(277): a, c, t, g, unknown or other
  misc_feature (277)..(277): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcggagacagagtcaccgtcacgttggcccggccagacctaaagtacttaacgaccttggttcggcctggtatcagcagaaacgagggaacnccctagactcctagatctataagacgtctactttagactaggtcgggtacccagtacgtaaggttcaggtcggacgtaggtggacgtcgtagggacctaggtacgttctaccgtcgtacctaaccgtactttacgacgacgtccgttacgacgacgtccgtagtatacggttattttcgaacctttaactttacgttacctacggtaaccctaacgttaacggttaacctaacgttttaccgtttacgggtaacggtaccggtttaccggaaccggtaacgggaaccgtagggtacgaaactacgaaacggtacgtacggtaggtcctagtacctacgtacgttcgttacgttcttaccttaccgttccccgttaccccgtcgttaaccg

SEQ ID NO: 9741 - DNA, 644 bp, Homo sapiens
  misc_feature: GYAE6OF01CK8E5.53.73.G07.1.454.CMB.1.raw
  modified_base (233)..(233): a, c, t, g, unknown or other
  misc_feature (233)..(233): n is a, c, g, or t
  modified_base (322)..(322): a, c, t, g, unknown or other
  misc_feature (322)..(322): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgctcgctcccaggtgcagctggtacaggtcggggctgagatgaagacgccgtggggcctgagtgatggtactttccgngacgacgactatcgtaggtactacctacccttaccacccgtaccttacccttatacctagttcgggtaccacgacggccccgtggacgnggggtcttggagtggagtgggtactaagtccgtaaccgttggtggtagtacttactaacgtaacgtttacacgtacaaggtacgaagtcggaccggaacgggtacctaacttaccagtaccgaacgacgacgaccgaccgtcgaacggtagtacgagtactacgagtaggcgtgtacgacgtacgtcgtagagtagtacgaggtacggacgaccggtacgtattagttaacgttcggtagtacggtacgttagttacggtttaggtacgttacgttaaccgttacttaactttagtttacgtttccgacgtacgtacccggg

SEQ ID NO: 9742 - DNA, 192 bp, Homo sapiens
  misc_feature: GYAE6OF01DPSP0.53.73.G07.1.454.CMB.1.raw
  modified_base (71)..(71): a, c, t, g, unknown or other
  misc_feature (71)..(71): n is a, c, g, or t
  modified_base (118)..(118): a, c, t, g, unknown or other
  misc_feature (118)..(118): n is a, c, g, or t
  modified_base (120)..(121): a, c, t, g, unknown or other
  misc_feature (120)..(121): n is a, c, g, or t
  modified_base (123)..(192): a, c, t, g, unknown or other
  misc_feature (123)..(192): n is a, c, g, or t
tcagcgcgtatacacacgaccggtgctcgatttagctctacgctcagggcacgaccggtgctcgatttagngacatctcgcagttctcgtgagcgggctggcctaaggcgccatagcntnngnnnnnnnnnnnnnnnnnnnnnnnnnnnnnnnnnnnnnnnnnnnnnnnnnnnnnnnnnnnnnnnnnnnnnn

SEQ ID NO: 9743 - DNA, 789 bp, Homo sapiens
  misc_feature: GYAE6OF01AXB6F.53.73.G07.1.454.CMB.1.raw
  modified_base (171)..(171): a, c, t, g, unknown or other
  misc_feature (171)..(171): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtncagctggtacagtcggggctgagatgagagccgtgggcctcagtgatgtatttccngcacgacatctaggactacnccttcaccgtaccttccttatactagttcgggtaccacgtacggtccccgtaggaccgtagggggtcctttaggacggttcgggtaacgttcggggttaccttaaacggtcccgtaaaccccggttagggttacgggtacgggtacttacccgttaacgtaaacggtttacccgtacgtaacgtaacggtaaacggtaacgtttaccggaccggtaaccggggtaaccccgttaaaagttttaccccggaaattccgggtaaacccgtaacgggtaaaccgtaaccggtaacccggtttaccccgggaaaacggtaaccggttaacccgtacggtttacccgtaacgtaacggttacggggtaacggttacggacggtaccgtacggtacccgttaaggaacggtacgtacggtacgggtaaccgggtaactaccgggtactaacgttggtaaccgttacgtcgtacgtacgtacgtttacgttacgggagttacgttacgtaacgttaccgttaagtttagtttcgaccgtaccggtaccg

SEQ ID NO: 9744 - DNA, 993 bp, Homo sapiens
  misc_feature: GYAE6OF01DCPXZ.53.73.G07.1.454.CMB.1.raw
  modified_base (193)..(193): a, c, t, g, unknown or other
  misc_feature (193)..(193): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtcgacatccagatcgacccagtctccttccaccctgtctgcatcgtgtcgganacagacgtcaccgtcacttcggccgggaccagacctaaagtacttaacgaccgtggttcggcctaggtactcgagacaacggaaaccgaagggaaaccgccccgtaagtaccttccgtagtaactacgttaagtaacggtaccgtttacgttaacgtttaaggaccggtacgggttaccggggttacccctaaagttaaccggtaaacgggtttaccgaacgggtaccgggtaccgtagggttacgggtaacgtttaccggtaacgggggtaaaccgtaagggttaaccgtttacccgtaacccttacccgttaaacccgaaccccgttaaacggtttaacccggaacccgtaccggttacccgtaccgtacccgtaacggttaccccgttaggttaacgttttacggtttaacgtttttaccggtaaacccgttttaaacgtttttaaacgtttaaccccgtacccgggtaaaccccttaaaaccggttaaaccgggtttaaaacccttttaaacgggtttttaacccgggttttaacccggggtttaaccgggggtttaacccccggggttttaacccggggtaaaccccggggtaaaacggggttaaaccccggtaaaagggggtaacccgggttaaaaaccggttaaaccccgggtaaaaaaccggttaccgggttacgggttaaccgggtaaccgttacccggaacccgttaacccgttaccgttaccgttttaccggttaccctttaccccggttaacggtttccccccgttaacccggggtccctttaaccgg

SEQ ID NO: 9745 - DNA, 814 bp, Homo sapiens
  misc_feature: GYAE6OF01DCQCX.53.73.G07.1.454.CMB.1.raw
tcagcgcgtatacacacgaccggtgctcgatttagctctacgctcagggggagtcagacccagtcaggacacagcatggacagtgagggtccccgctcagctccgtggggctcctgctgctctggctccaggtgccaaatgtgacatccagatcgaccctagtcctccttccacctgtctgcatcgtgtcggagacagacgtccacgtctacgtcggccggacacgacctaaagttactaacgaccgttggttcggccgtaggtactcgacgacgaaacggaaaccgacggggaacctcccgtagtacctcgtagacttacgtaagtaacgtacgttacttaacttacggacgtacggtcgggtaccctagtacgtaacggtcgacggcggacgtaggtacgtactcggtacggactacgtacgtcacttacgactaacgtacgttacgccgacgtccgtacgaccgtaacgtccgtagttacgttcgtttaacgtttacgtaaaccgttaacttttacgtaaccgtacggtaaccctaaaacgtacggtttaaacttaacgttttaccggtttaggggtaacccgggttaacccgggtttaacccgggaaacccgggtaaaacggggtaacccgggttaaaagggttaaccgtaaaaaccggttaaccggaaaaaccgggttaccggttacgggtttaacccgggacgttaacccggaacccgttaaccgttaagttttaccccggtttcggtttaaacccctttacgggtaaccccttttccccggggttaaccccctaaggtttaacccgg

SEQ ID NO: 9746 - DNA, 704 bp, Homo sapiens
  misc_feature: GYAE6OF01AH59P.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgtatttcctgcacgactatcgtggaatacctaccttccaacccgtaccttccccttaatacgtagttcggggtaaccgaccgtaccgggcccccgtagggaaccgagggggtccttagggaggttgggagttcgggtaccttaaacgtaccgtaaacccggttagggttagggtaggtaacttaccgtaacgtaaacggtttaccacgaacgaaggaagtaacgtcggaccgtaacggggtaccgtaaattacccgaagttaccggaacccaaggaaccgaaccgtacccggtaacccgaacggtaacgtaccgaagttacctaacgtaggtacgggaggtcgacgtacgacgtccgaggacgtacgtcgtaggacgaccgacggtacctagttcgttaagttcgtggtcgacgtacgttaggttaggtcggtaacttaaccgtaacttaacgttatttacgtttgaccgtaggtacccgg

SEQ ID NO: 9747 - DNA, 896 bp, Homo sapiens
  misc_feature: GYAE6OF01BLFTV.53.73.G07.1.454.CMB.1.raw
  modified_base (799)..(799): a, c, t, g, unknown or other
  misc_feature (799)..(799): n is a, c, g, or t
tcagcgcgtatacacacgaccggtgctcgatttagctctacgctcaggggggagtcagacccagtcaggacacagcatggacatggacgggtccccgctcagctccgtggggctcctgctgctctggcctccgaggtgaccaatgtgacataccagatcgacctagttcctcccttcccaccctcgtctcgctacgttccgttcggtacggaacgaacgaacggtacgttaccgaacccggttccttaccgttccgggacccgggggacccaaacggtaacccgtaaaaaggttaacgtttaaacggtaccggtttagggggttccgggtccgttagggttactaccgaacggaaccggaaaacggaaaaccggaaacgggaaacccgtacccgttaacggtaccttaccgtacgtaacttacgttaaagtaaccggttaacgtttaccgtttaaaccggttaacggtaaccgggttacgggttacccgggggtaaccctaacggttaaccggttaagggtttaccgacggggtaccgggtacggttaacgggttacgggtaacggttacgggtaacgggaacgtacgggtaacgttacctaccgttacctaccgtaacgttaacgttacgaccgtacgccgttcgactacgttcaggtacttagttacgtttacgaactttaacgtttacttaccgtacgtaaccctaagtaacttaacgtttaccgtttagtttacggtacggtaccgggttaacgggtaaccgaaacggtaaccggtaaagggtacccggtaaaanaaccggtaaacgtacggtttacgacggttacctaacgtacccgtaattccgttacgttccctttaacgtacttacccgttcccttcccggaacttcg

SEQ ID NO: 9748 - DNA, 160 bp, Homo sapiens
  misc_feature: GYAE6OF01DSJ79.53.73.G07.1.454.CMB.1.raw
  modified_base (154)..(160): a, c, t, g, unknown or other
  misc_feature (154)..(160): n is a, c, g, or t
tcagcgcgtatacacacgaccggtgctcgatttagctctacgctcaggggctctacgctcagggcacgaccggtgctcgatttagctctacgctcagggcacgaccggtgctcgatttagcagacgtctgtcgcgggctggcaaggcgcatagnnnnnnn

SEQ ID NO: 9749 - DNA, 655 bp, Homo sapiens
  misc_feature: GYAE6OF01DRSZL.53.73.G07.1.454.CMB.1.raw
  modified_base (281)..(281): a, c, t, g, unknown or other
  misc_feature (281)..(281): n is a, c, g, or t
tcagcgcgtatacacacgaccggtgctcgatttagctctacgctcagggggagtcagacccagtcaggacacagcatggacatgagggtccccgctcagctcctggggctcctgctgctctggcctcccaggtgaccaaatgtgacatccagatgacccagtcctccttccaccctgtctgcatcgtgtcggagacagagtcaccgtcacgttgcccggcagaccaaagtattaagaccgtggttggcctaggtatcgagacaacgaaaccgagggaaacnccctagactcctgtatctaataagacgttctactttagacgtaggtcgggtcccatacgtaaggttcgaggtcggactaggtggatcgtgggacagtagtccactctacgactatacgactagcctagcaacgtccgtagtattgtaacgttttcgacttaacgtttacttaccgtacgaacccgtaactagttaaaccctaagttttacggtttacggttcggtaaccggtttccgggaccgtaaacggggtaaccgttaaagggtagtaaaaccgtaaaccgtaaacgtaccgttaggtacggtacttacggacccttaaccacggtttctacggttccttaaccgtacctttacccggtccctacctaacg

SEQ ID NO: 9750 - DNA, 671 bp, Homo sapiens
  misc_feature: GYAE6OF01BD32S.53.73.G07.1.454.CMB.1.raw
  modified_base (228)..(228): a, c, t, g, unknown or other
  misc_feature (228)..(228): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgaccagtctccttccaccctgtctgcatctgtcggagacagagtcaccgtcacttggcccgggccagaccaaagtnttaacgaccgtggtcggcctggtactcagcaagaaaccgagggtaaacgcccctagacctcctgatctaatagacgtactactttagactaggtcgggtcccatcgtaaggttcacggcggacaggtggatcgtagggacacggtagttccgactcctacgaacctagttacgctacgccttggcacgtctaggtattcgtattttcggaaccttaactttacgttaactacggtacccaaacgtaacgttaactaactttaaccgtttggtccgggttaacggttaccggggtaacccgaaacggggtaacccgtaaaggggtacgtaaaacgtccgaaaaaaccggttaccggtaacgggttggacccggttaggaccctaaaccgttacgttaccttacgggttcctttacctactttccccgttccccgtacctaaccg

SEQ ID NO: 9751 - DNA, 713 bp, Homo sapiens
  misc_feature: GYAE6OF01AMAUK.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgtacttcctgcacgacatcgtggactaccaccttcaccgaccttcccttatacagttcggtaaccgacacggcccctaggacgagggcttggagtggatgggtactaactaccgaaccgttaggtgggtacggtattaccgtaacgtaacgtttacctcgaacgaaggtaacggaattcggaccgaacggggtaaccgtaaacgtttacccgaagtaccggaacccgtaaggaacggaccgtaaccggtacccgaaccggtaacgtactaacggttacctaacgtaggtacgggtaggtcggacgtacgacggtcccgtaggtaacgtacgttacgtacgggaacggtaacccgaccggtacctacgttacgttacgttacggttcggttacgggaccgttacgtttacgggtttacgtacgggttaaacttaaccggtaaacttaaccgttaagtttttacgttttacggtaaccgtcggtaaccccgg

SEQ ID NO: 9752 - DNA, 724 bp, Homo sapiens
  misc_feature: GYAE6OF01BLZQT.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagacgtcaccgtcacttcgccggacacgaccaaagtataacgaccgtggttgcctaggtactcgagacaagaaaccgagggaaacgccctagacctcctagatactaataacgtacgtaccttaacgtttagacgtagggtcgggtacccctagtacgtaagttcgacggtcggtacgaaggtcgagttcggtagggaactaggtacgttacacctactaccgtaacctagttacgccgtaacgccgtgaccgtacggccttaggtacttacggttactttacgtaaccgttaaacttttcttaacgtaccgtaactaaccgtacgtttaaactacgtttaacgtttcgggttaacggtacccggtaccgggtaaccggttaaacgggtacccgtaaaggggttaaccgtaacgtaaacccgaaacggttacggtacggtaccgggtactacgggtaaccctacgtaaccgtttccggtttaacgtaccttttacccaacccggttttcccttacccccgtaacggtttacc

SEQ ID NO: 9753 - DNA, 647 bp, Homo sapiens
  misc_feature: GYAE6OF01C1SLD.53.73.G07.1.454.CMB.1.raw
  modified_base (303)..(303): a, c, t, g, unknown or other
  misc_feature (303)..(303): n is a, c, g, or t
  modified_base (392)..(392): a, c, t, g, unknown or other
  misc_feature (392)..(392): n is a, c, g, or t
tcagcgcgtatacacacgaccggtgctcgatttagctctacgctcagggggagtcagacccagtcaggacacagcatggacatgagggtccccgctcagctccgtggggctcctgctgctctggcctcccgaggtgaccaaatgtgacatccagatcgacccagtcctcccttcccaccctgtctgcatcgtggtacggagaacgagacgtccaccgtctacgttcggccgggaccaacgactaaagtaataacgacgtggttcggctaggtatacgagacaacggaaacgacggggaaaccncccgtaacgacctcctagaactactaacgtaaacgacgttacctacgtttaacgacgtaggtcgggtacctagtacgtaaggtcacggnggactaggtcggattacggtagggactacggtactcgtacctcctacgtactagtacgacacgaccgtgaccgtcgaccgtagattgtatttacgacttaacttctacgacgtacaacgtataaccttaagtacgtttcggaggttacccggtacggtaacgtaagggtaactaagggagtaaacgaaccgtaagtacgtggaccgtctacgactactattccgtgttaccctatacccgtcctcccgttgtacg

SEQ ID NO: 9754 - DNA, 680 bp, Homo sapiens
  misc_feature: GYAE6OF01C9F9Z.53.73.G07.1.454.CMB.1.raw
  modified_base (304)..(304): a, c, t, g, unknown or other
  misc_feature (304)..(304): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccaggtgcagctggtacaagtcggggctgagagtgaagaagccgtggggcctcgagtgactgtactttcctgcacgacatctggatacaccgttacaccgaccttcctatacagttaggtacacgacggcccctggaacgnggggcttggagtggagtgggtactaataccaacctaggtggtgactctacaagttaccacgacgagaagactcggcgaacggtaccgaattacccagttacgaaccgaaggtacgaacgtacccgaccgtaacgtaacgtaacgtagttacctaagtaacggtgggtaaggtacgaacgtccgaacgcgttaggaaacgtgtaccgttaggaccgggaacgaccggtacgtacgttacggttaactttacggtgggtacgtacccggtaagtttacccggtttaaggtaacgggttaacccgtttaaaccggtaaactttaacggttaaaactttttcggttttaaccggttaaccgtaaccgggttaaaccccgg

SEQ ID NO: 9755 - DNA, 627 bp, Homo sapiens
  misc_feature: GYAE6OF01ED6DE.53.73.G07.1.454.CMB.1.raw
  modified_base (229)..(229): a, c, t, g, unknown or other
  misc_feature (229)..(229): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagccgtggggcctgagtgatgtattccngcacgacatctggatacaccttcaccgaccttcccttatactagttcgggtacacgacggcccctgggacgaggggtcttggaggtggagtgggtactaactccaaccgtaggtggtagatctaataagttactcaacagaacgaatgacgagggtaccgaaattaccagtacgaaccgaaggacgaaccgtacgtaccacgaagtaacagtactaacgagttggaacggtgaacgcgaacgccgtaggaatagtcgtaggacggaccgaccggacgtagttagttaatttaccgtaggttagtccgtaagtttacgtttaacgggttaggtaacgtttaaacccggtaaactttaaccgtaaattttaagtttttacgtacgtaccggtaacccggg

SEQ ID NO: 9756 - DNA, 726 bp, Homo sapiens
  misc_feature: GYAE6OF01AC5JZ.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtcctcccttccaccctgtctgcatctggtcggagacagacgtccaccgtcacgtcggccggccacgtaccaaagttattaacggaccgttggttcggccttggtatcgagacaacggaaaccgaacgggaaccgcccgtaagacctaccgtagaacttacgtaacgtaaggtaccgttacttaacgtttacggtaaccgtagggttaccggggtacccctaagtacgtaacggttccgagcgggacgaggtggacgtcgtaggactacggtacgttccaccgtcctaccacctagtacgccgaacgtcccgtgaccgtaaggtccctttaggtaacgtttacgttacttttacggaaccctttaaacttttaccgtttaaccaccggtaaccaaacgttacttaacttaacgtttacggtttcggacggttaccggtaccggaaccggtaaacgggtacgaaacgggttcgtaaaacgtaacctaaccggtagttcgggtacgtcgtacccgactacccgtagttcgtttacgttaccgttacaccgtttcccctcccgattaccg

SEQ ID NO: 9757 - DNA, 626 bp, Homo sapiens
  misc_feature: GYAE6OF01EG3LH.53.73.G07.1.454.CMB.1.raw
  modified_base (157)..(157): a, c, t, g, unknown or other
  misc_feature (157)..(157): n is a, c, g, or t
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (488)..(488): a, c, t, g, unknown or other
  misc_feature (488)..(488): n is a, c, g, or t
tcagcgcgtatacacacgaccggtgctcgatttagctctacgctcagggatcatccaacaaccacatccccttctctacagaagcctctgagaggaaagttcttcaccatggactggacctggaggtcttctgcttgctgtcagtagctccgaggtnctcgctcccgaggtgcagctggtacagtcggggctgagangaagagccgtgggcctgagtgatgtactttccgngcacactatcgtggataccaccttcacctaccttcccttaatactacgtttacgggaccgaccacgggccccgtgggacgtacggggtcttggagtggtagtcgggtactaataccaaccgtaggtggtacgtatactaacgtaactactcaagagagaagtcgacgaacgggacctaacttacagtacgaccagaccgacacgtacgacgaacgtacacgtactactagtgggagtagacgacacgacgtgaacgngtacgtaggacggaccgtaccggacctagttagttaatacgttccgggtagtaccgttaagttacgttaaggttacggtaaacttaacggtaaccctaaattaaacgtttaattttcggaacgtaccggtaaacccgg

SEQ ID NO: 9758 - DNA, 715 bp, Homo sapiens
  misc_feature: GYAE6OF01BVQEE.53.73.G07.1.454.CMB.1.raw
  modified_base (234)..(234): a, c, t, g, unknown or other
  misc_feature (234)..(234): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccaggtgcagctggtacaggtcggggctgagatagaagacgccgtggggcctgagtgatgtacttttccgngacacgacatcgtaggactacctaccttccaccgtaccttcccttaatactagttcgggtaccacgaccggccccgtaggaccgtaggggtcttggacggtggagttacgggtacttaacgtaccgtaacccgtaggttcgggtagtaacttaccgtaacgtaaacgtttacctacgaacgaaggtaagtaacgtacgggaccggaacggggtaccgtaaacttaaccgaagttacgaaccgtaacggtaaccgaaccgtaaccggtaccgaacggtaacgttacgtaacgttaccgtaacgtaaggttaggggtagggtacgacggtacgtacggtaccgtaggtacgtacgttacggtagggaaccgggaaccgaccgggtacctagttacgttacgttacgtcgtacgtacgttagttagttaggtacgttacgttaacacgttaacttaattttagttacgtacgacgtaacccggg

SEQ ID NO: 9759 - DNA, 688 bp, Homo sapiens
  misc_feature: GYAE6OF01B43X1.53.73.G07.1.454.CMB.1.raw
  modified_base (178)..(178): a, c, t, g, unknown or other
  misc_feature (178)..(178): n is a, c, g, or t
  modified_base (678)..(678): a, c, t, g, unknown or other
  misc_feature (678)..(678): n is a, c, g, or t
tcagcgcgtatacacacgaccggtgctcgatttagctctacgctcagggggagtcagacccagtcaggacacagcatggacatgagggtccccgctcagctccgtggggctcctgctgctctggctccgaggtgccaaatgtgacatccagatcgaccagtctcctccacccgtgtcngcatcgtggtcggagacagacgtccaccgtctacgtcggaccgggccacgaccgaaagttaattaacggaccgttgggttcggccgttggtaactcgacggacaaggaaaccgtaacgggaaccgacccgtagaccgttcctaggacttacgtaataacggtacctttacgttaacgttacgacgtacggtaccgggtaccctaaggtaccgtaaaggttccgaacggccgggtacgaaggtcggtaacgtcggtaggacgtagtacgtcaaccgtcacactgtacgctacgccgtgacgtcgtacgtagtacttggttaactttacaactttaacgtcttacggactaactaacgacgttaattacgtttaaccgtttgggtaaccgggttaccgtaccgggtaaccggtaaggtaaaccggtaagggtacaaaacgtacgtaaacggtacgtcggtacggcttacggaacctgtacgtctacgtcttacaccgtttcnccctgtaccg

SEQ ID NO: 9760 - DNA, 652 bp, Homo sapiens
  misc_feature: GYAE6OF01B6V8T.53.73.G07.1.454.CMB.1.raw
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
tcagcgcgtatacacacgaccggtgctcgatttagctctacgctcagggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcgagtgatgatttcctgcacgacatctggactacaccttcaccgtactccttatacattcgggtacacgacggcccctggacgnggggcttggaggtggatgggtactaagtccaacccgtaggtcggtaggacttcgtaacgtaagtttacncaacgtagaacgaatcggacgacgggaccaagttaccagtcgaacaggacgaaccgacgtaccaacggaacgtacgagtactacgaggtacgggaggtcgaacgccgtaagcccgtaggaacgtacttacggtagggtaaccggaaccggaccgggtaccctaggttacgttaacgttacgttcggtacggtacgtacggttacgtttagggtcggttaaacgttaaccgtaaccttaacgttaaagtttaacgtttttcggtacccgtacggtaaccccggg

SEQ ID NO: 9761 - DNA, 770 bp, Homo sapiens
  misc_feature: GYAE6OF01ARDFN.53.73.G07.1.454.CMB.1.raw
  modified_base (231)..(231): a, c, t, g, unknown or other
  misc_feature (231)..(231): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagccgtggggcctcgagtgatgattttccngcacgacagtcgtggatacctaccttccaccgtaccttacccttataccgtagttcgggtaccgaccgacgggcccctagggaccgaggggtctttaggaggttaggacgttacggggtacttaaacttaccccgaaaaccccggttagggttacgggtcgggtaacttaccgttaaccgttaaacggtttacctaccggtaaacaaacggtaagtaacggttacgggacccggtaaacgggggtacccctaaaacgtttaacccgaacggttaccgaaaccgaacggaaccggtaaaccgtacccgttacccgaacggtaaacggttacgtaacgttacctaacgacggttacggggaggttagggacgaaccgtacggtacccgttaggaacggtacgttacggtacgggaacgggtaccgacccggtaactacgttaggttaacttcgtaggtcggtacgttacggttacgtttaaggtggttaacgttaacgtacttaaacttagtttaacgttttacgtaccgacggtaaccgg

SEQ ID NO: 9762 - DNA, 590 bp, Homo sapiens
  misc_feature: GYAE6OF01DYJZ7.53.73.G07.1.454.CMB.1.raw
  modified_base (333)..(333): a, c, t, g, unknown or other
  misc_feature (333)..(333): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccggcagccaagtatagactggtgctggtatcagcagaaccagggaaacgccctagactcctgatctataagacgtctactttagactaggtgggtcccatcgaaggttcagcggcagtgatcngggacagattcactctacacctattacgcacgcctgcagctgattgtatttgaccttaatttacttactcgacccaactagttaactaatttacgtttggtacggtaccggtttaccgggaccgtaaacggggaccgtaaggggtacggtaaaacttaccgaaaaccggtacgttagggtacggtacgttaggaccctaaccgtagtttcccgttacgttccgtttacctacctttcccgttccccggtcttaaccg

SEQ ID NO: 9763 - DNA, 777 bp, Homo sapiens
  misc_feature: GYAE6OF01BP64O.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccgaggtgcagctaggtacaagtcgggggctgagatagaagagcgtggggcctgagtgatgtatttcctgccacgacatctaggataccaccttccgaaccgtaccttaccccttaataccgtagtttacggggtaaccgaccgtaccggccccctaggggaccgtagggggtcctttaggaggttacgggagttacggggttaccttaaaacgttacccgtaaaccccgttagggttacggggtacggtaacttaccgttaaacgtaaacggttttaactacccgaagtaaaccggaaagtaaacgttcggaaccggaaggggtaaccccgttaaaactttacccgaaagttaccggaacccgaagtaacgaaccgtaacccggtaccaacggtaagtaactacgtacgtaacgagttagggaggttagagcgacgtccgtaggacgtactacggaggacggaccgacggtacctaaggttgttaacgtttacgtagggttaggtaccggtttacgtttacgtttaacggggttacgttaaacgtttaaacccgtaacgtttaaaccgtaaagtttttaacgtttttcgtaacccgtaaccggtaacccgg

SEQ ID NO: 9764 - DNA, 865 bp, Homo sapiens
  misc_feature: GYAE6OF01CRSUI.53.73.G07.1.454.CMB.1.raw
  modified_base (170)..(170): a, c, t, g, unknown or other
  misc_feature (170)..(170): n is a, c, g, or t
tcagcgcgtatacacacgaccggtgctcgatttagctctacgctcagggggatcatccaacaaccacatcccttctctacagaagcctctgagaggaaagttctcaccatggactggacctggagggtcttctgcttgctgtcagtagctcaggtgctcgctcccaggtncagctggtacagtcgggggctgagagtgaagaacgccgtggggcctcgtagtcgattgtactttcctgacacggactagtctaggtactaactacccgttcacccgtaccttcccttaatactagttacgggaccgacgtaccggcccctagggaccgtaggggtctttaggacggttagggtacgttacggggttccttaaacgttaccctaaaccccggttagggtcgggttcgggtaacttacccttaaacgtaaaccggtttacctaccgtaacgaaacgggtaacggtaaacgttacgggcccggtaaaggggggtaccccctaaaaagtttacccccgtaaagttacggaacccggttaacggaaccggtaaacccgtacccggttaacccgaaacccggggtaaacgttaccgtaaacggttacccgttaacgtaacgggttacgggtaacggggtttcggaacggtaccggtaaccgtaccggttaggtaacgtaccggttaaccggttacgggaaccgggtaccgaacccggtaccgtagtttaacggttacgttaacgttcgggttacggtaccgttaacgtttaccggtttaagggttcgggtaaaccgtttaacccggttaaacctttaaacgttaaacttttccgttttaaacggttcggtaaccccgggttaaaccccggg

SEQ ID NO: 9765 - DNA, 772 bp, Homo sapiens
  misc_feature: GYAE6OF01DIZCK.53.73.G07.1.454.CMB.1.raw
  modified_base (183)..(183): a, c, t, g, unknown or other
  misc_feature (183)..(183): n is a, c, g, or t
  modified_base (278)..(278): a, c, t, g, unknown or other
  misc_feature (278)..(278): n is a, c, g, or t
  modified_base (711)..(711): a, c, t, g, unknown or other
  misc_feature (711)..(711): n is a, c, g, or t
tcagcgcgtatacacacgaccggtgctcgatttagctctacgctcagggggagtcagacccagtcaggacacagcatggacatgagggtccccgctcagctcctggggctcctgctgctctggctccaggtgccaaatgtgacatccagatgaaccagtctccttccacctgtctgcattcgnggtcggagacaggagtcacgtcacgttgcgggcagaccaaagttataagaccgtggttacgctggtatcgagacgaagaaaccgacgggtaaacncccgtaagacctcgagtaactactaagtaacgtactacttaacgttacgacggtacggtcgggtacctaagtacgtaaggtacgacggtacggacgtacggtggtacgtaccgggtacggaacgtaacgttacgtttaccgaacttaccgtaacgtaaccttaagttaccggacgtaccgtaccgtacgtaaccgtaccggtaccgttaagtacgttacgtttaacggtttaactaacgttaaccgtttttaagtcccgttaaacgaacccgttaacgttaacgttaaacgttaaccgtttacggttttacggtaacggggttaacccgttaccggggaaacccgtaaaaccggggtacgggtttaaaacggaacggtaaaaccggttaaaccgtaaaaacgggtacgtttacggggaaccggttaccggtanacccgtaacgttactacgttccgtaacttaacccgtacttccccgggtacctcgttaacgg

SEQ ID NO: 9766 - DNA, 781 bp, Homo sapiens
  misc_feature: GYAE6OF01DD9UC.53.73.G07.1.454.CMB.1.raw
  modified_base (238)..(238): a, c, t, g, unknown or other
  misc_feature (238)..(238): n is a, c, g, or t
tcagcgcgtatacacacgaccggtgctcgatttagctctacgctcaggggatcatccaacaaccacatcccttctctacagaagcctctgagagaaagttctcaccatggactggacctggaggtcttctgcttgctgtcagtagctccaggtgctcgctcccaggtgcagctggtacaagtcggggctgagatgaagaagccgtggggcctcgagtgatgactttccgtgcacgacntctaggactaccgtaccttaccgaaccccggtaccttacccgttaactaaccgtacggtttacggggtaaccgtaccgtaccggtccccccggtaggtaaccggtaacgggggttccgtttaggacggttacggggtagttacggggttaaccttaaacgttacccgtaaacccgttaggttcgggtaggtaaccttaccgtaacgtaaacggttaccctaccaacgtaaggtaacggtaagtacgacggtaacgggtacctaaacgttacccgaagttacggaacccgtaagaaccgtaaccgtaacgtacccgaaggtaacgtaacctaaggttacctaacgtagttacggggaacgttgaacggccgtacggtccgttacggaacgtacgtaccgtacgggaacgggaccgtaccgggtaccttagttaggttaaccttaacggttcgtagtacccgtaagtttacgttaaggtaccgggtaacttaacggtaaccgtttaactaaagtttgttttaaccgccgttaacggtaaccccgg

SEQ ID NO: 9767 - DNA, 589 bp, Homo sapiens
  misc_feature: GYAE6OF01CSBVF.53.73.G07.1.454.CMB.1.raw
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacngagtcaccgtcacttgccggccagaccaaagtattaagacctggttgcctggtatcagcagaacaggaacgccctagactcctgatcgtataagacgtctactttacgacgtaggttcggggtccccagtacgtaaggttacaggcggacaggtcggatcgtgggacagtagttccaaccgtctacaacctattaggccaagtccgtagcctagcctgattgttaatttgacctaactttatactgaccaacgtagtactaagttcgtttagtacgggtaccgtttaccgggaccgtaaagggtaaccaagggttagaaaactccgaaaacgtacgttggacgtacgtaggacctaccgagttcttaggttcttacacttccctacccgcgtaacg

SEQ ID NO: 9768 - DNA, 600 bp, Homo sapiens
  misc_feature: GYAE6OF01AL07S.53.73.G07.1.454.CMB.1.raw
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacgttgccgggccagccaaagtattaagacctggttggcctggtatcagcagaaaccaggggaaacgccccgtagactcctagatactagtaagacgtctaactttagacaggtggggtcccatcaaggttcagcggnagtggatcgngggacaggagttcacgtctacacctattacggcaacgcccgtgacctagcccttgacttcggtattttacgactaaactttagttaaccgttcgaacccaatacggtaactaaagtttacgttttaggtacgggtaccgttccgggacccgtaaagggaccgtaagggtacggaaactacgaaaccgtactggtacgtcgtgccactacgtcttacgttccgttacacttccttccccgtcgtaaccg

SEQ ID NO: 9769 - DNA, 574 bp, Homo sapiens
  misc_feature: GYAE6OF01A69SJ.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgtattttcctgcacgacatctgatacaccttcaccgactccctatacagttggtacgacgacggccccgtggacgaggggtcttggagtggagttgggtactaatccaaccgtaggtggagatactaataacgttacacacgagaagagtgacgacgggcctaaattaccgagtcgaacgagagaccacgtaccgacgagtacgagtactacgagtaggagtgagcgacgcgtagagagtcgtagacggaccgtacgactaagttgtaattacgtgtcggtacgttagttacgttaggtccggtaattaacgtaacttaactaagtttacttttgaccgtacggtaacccg

SEQ ID NO: 9770 - DNA, 733 bp, Homo sapiens
  misc_feature: GYAE6OF01CSEUJ.53.73.G07.1.454.CMB.1.raw
  modified_base (269)..(269): a, c, t, g, unknown or other
  misc_feature (269)..(269): n is a, c, g, or t
tcagcgcgtatacacacgaccggtgctcgatttagctctacgctcagggggagtcagacccagtcaggacacagcatggacatgagggtccccgctcagctccgtggggctcctgctgctctggcctccccgaggtcgaccaaagtggtgaccatcccagatcgacccagtcctcccttcccaccctgtctcgcatctggtacggagacgagtacgtccaccgtctacgtcggccgggccagacctaagtatacgcgtggtcgctgtancagacaacgaaccgaacggaaccgccctagacctccgtgactactaagtaacgtcgttacttacgttagacgtacggtcgggtaccctagtaccgtaggtacgacggcggacgaggtcggtacgtcggtagggactagtacgtacctacgtctacgtactagttacgctacgtcctacgacgtacgtcgtagtagtttacggttatttaccgtacttaactttaccgttaccgtactaacccgtaagtaaccgttaacttaacgtttacggtttacggtaccggggttaccggttaccgggacccggtaacggggtaaacccgtaaggggtacgtaaaacgtaccggtaaaccggttaacggttcggacggttaccctacggtaaccctaccgtttaccgtttaccctttccggtttacccttacccgttaccctttacccccgttcccccggtaccgttaccg

SEQ ID NO: 9771 - DNA, 978 bp, Homo sapiens
  misc_feature: GYAE6OF01A7KLT.53.73.G07.1.454.CMB.1.raw
  modified_base (238)..(238): a, c, t, g, unknown or other
  misc_feature (238)..(238): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtaacaagtcgggggctgagatggaagaagccgtggggcctcgagtgatgtactttccgngcacgacatcgtaggactacaccttcaccgactacccttagtactagttacgggtacgaccgacggtccccgtaggaccgtaggggtcgttaggacgttggagttcgggtactaacgtacgtaacccgttaggtacgggtcggtaacttaccgttaaactaaacggtttacctaaccgtaaacgtaacggtaaggtaacggttacggtaacccgggtaacgggggtaacccgttaaaaacgtttaacccgtaacgtttaaccgggtaacccgtaaacgggtaaccgggtaaccccgtaaacccgggtttaacccccggtaaaacccgggttaaaaccggttaaacccgttaaaccggttaacccggtttaaacggtaaacggtttaacggggggttaaaggggttaaccggtaaccgggtaaccggttaacgggtaccccggttaaggggtaaaccgttaaccgggtttacccggttaacgggggttaaccgggtaaaaccccggggttaaccccggggtaaacccgttaacggtttaaccgggttttaaacgttttaaacccgggttacggggtttaacccgggttaaccgggttaacgttttaacccgggtttaaacgggtttaaaccgggtttaaacccggtttaaacggtaaaccccgtttttaaacgttaaaacggtttttaacgggtttttttaaacccggtaccgggttaaacccggtttaaaccccccgggg

SEQ ID NO: 9772 - DNA, 646 bp, Homo sapiens
  misc_feature: GYAE6OF01ASNLK.53.73.G07.1.454.CMB.1.raw
  modified_base (518)..(518): a, c, t, g, unknown or other
  misc_feature (518)..(518): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccaggtgcagctggtacaagtcggggctggagatagaagacgccgtgggcctcgagtgatgtactttcgtgacacgactatcgtaggactacctaccttaccaccgtaccttacccttatacgtacgttcgggtaaccaccgaccggccccgtagggacggtacggggtctttacgggaggttaggacggttcgggtactaacgtaccgtaaacccgttggtcgggtacgtacttacgtaacgtaacgttactacgagtaaggaataagcggacgacgggaacttaacgtacgacgtacgaaccaggacacgtaaccgacgacgacgtacgatacacgtagtaggtcgacgancgacgtcgagagacgtcgagggacgaccgacgactagttacgtacttacgtcgagtacgtacgttaggtagttacgtacgtaccgtaacgttaacttagttttacgtttcgaccggtaccgtaccggg

SEQ ID NO: 9773 - DNA, 694 bp, Homo sapiens
  misc_feature: GYAE6OF01ESL49.53.73.G07.1.454.CMB.1.raw
  modified_base (174)..(174): a, c, t, g, unknown or other
  misc_feature (174)..(174): n is a, c, g, or t
  modified_base (240)..(240): a, c, t, g, unknown or other
  misc_feature (240)..(240): n is a, c, g, or t
  modified_base (376)..(376): a, c, t, g, unknown or other
  misc_feature (376)..(376): n is a, c, g, or t
  modified_base (481)..(481): a, c, t, g, unknown or other
  misc_feature (481)..(481): n is a, c, g, or t
  modified_base (684)..(684): a, c, t, g, unknown or other
  misc_feature (684)..(684): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgctcgctcccgaggtgcancgtggtacaaggtcgggggctggagagtaggaagacgccggtgggcctcgagtgatgtactttcgngacacgacacgttcgtaggactacctacccgttaccaacccgtaccttacccttaatactaggttacggacgtaccgaccgggtccccgtagggacgtacggggtcttaggacggtagggtaggttcggtaacctnaaaaccttaccgaaccgttaggtggtaggtactacctacgtaaagttaccgtacaacgtaagaagtagtcggacggaccgggtaacgtaaacttaccgacgtacngggaacccaaggaaccggtaccaacgggtacctaaccgaaggttaccaacgtacttacggaagtttagggaacggttcgaaggccctaggaccgtagtacgtagtacggtacgtacggggaccaacggtccgtaattcgtattacgtcggtagtcgttaagttcgttaagttacgggaactttaccggaactttagtttagtntttaggtccc

SEQ ID NO: 9774 - DNA, 765 bp, Homo sapiens
  misc_feature: GYAE6OF01DAIWX.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccaggtgcagctggtacaagtcggggctgagagtgaagagccgtggggcctcgagtgagttgtactttcctgccacgactatcgtggactacctacccttcacccgtaccttcccctttaatactacgtttacgggtaccgaccgtaccgggccccgttaggaccggtagggggtcctttggacggttgggtaagttcggggttaacttaacgtaccctaaacccgttagggttcgggtaggtaacttaccgttaaacgtaaacggttttaccaccgtaaacgaaggaagtaagtcggaccgggtaaacgggtacccgtaaaatttacccgagttaccgaaaccgtaacggaacggtaaaccccgtaccggtaacccgtaaaccggttaacgtaaccgtaacgttacccgtaacgtacggtaggggtaacgggtacgacggaccgtacggccgttagaacgtactcggtacggaaccggtacgaccgtacgtattacggttacttagtcggttacgcggttagttacggtttacggtgtaaaccgtttaaccgaaacctttaacgttaaactttttgtttacggtcgtccggtaaacccggg

SEQ ID NO: 9775 - DNA, 733 bp, Homo sapiens
  misc_feature: GYAE6OF01BKYAK.53.73.G07.1.454.CMB.1.raw
  modified_base (247)..(247): a, c, t, g, unknown or other
  misc_feature (247)..(247): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatagaagaacgccgtggggcctcgagtgatgtactttcctgcacgacatcgnggataccaccttccacccgtacttacccttatactagttacgggtacgacgacggccccctgggacgaggggtcttggaggtggagttcgggtactaaacgtaccgtaaccccgttaggttgggtggtaacttactaactaagtttactacaacgagaacgtaatcggacgaacggggacccgtaaacttaacccgagtaccggaaccgtaacggaacgaaccgtaaccggtacccgaaaccggtaaacggttaacctaacggttacctaaccgtaggtaggggtagggtacggacggtacgtacggacccgttaggaacggtaattaccggtagggaacgggtaccgaaccggtaccgtagttacgtttaacgttacgttggtacggtaccgtacgtttaggtttaggtacgggttaacgttaaccgttaaacgttaaccgtttaaagtttaactttttacggtacccgtaaccgtaaccccggg

SEQ ID NO: 9776 - DNA, 782 bp, Homo sapiens
  misc_feature: GYAE6OF01ESRM3.53.73.G07.1.454.CMB.1.raw
  modified_base (237)..(237): a, c, t, g, unknown or other
  misc_feature (237)..(237): n is a, c, g, or t
tcagcgcgtatacacacgaccggtgctcgattttagctctacgctcagggagtcatccaacaaccacatcccttctctacagaagcctctgagaggaaagttcttcaccatggactggaccgtggagggtcttctgcgttggctgtcagtagctccaggtgctcgctcccaggtgcagctaggtacaagtcgggggctgagatggaagagcctggggcctcagtgatgtactttccngcacgacatctggataccaccttccaaccgtaccttacccttaatactagttacgggtacgacgtacggtccccgtagggacgacggggtcgtggagtggtagtcgggtactaagtccgaaacccgtacggtggtacggacttacgtaactaacgttacctaccgaacgaacggaacggtaaacgtcggtaccggtaaccgggtaccccgtaaacgttaacccgtaacgtaccgtaacccgaacggaacgaaccgtaacccggtacccgaaaccgggtaacgtaaccgtaacggttaacccgtaaccgtacggttacggggtagggtacggaccggtacgtacggtaccgttacggtaacggttaacttaccggtacggaacgggtaacccggtaaccggtaccggtaacggttacggttaacggtttaccgtacgggttacggtacgttaacggtttacgttaacgggttacggttaaacgttaaccgttaaacgttaacgtttaaattttacgttttacggtaacccgtacggtaaacccggg

SEQ ID NO: 9777 - DNA, 680 bp, Homo sapiens
  misc_feature: GYAE6OF01B59FW.53.73.G07.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (248)..(249): a, c, t, g, unknown or other
  misc_feature (248)..(249): n is a, c, g, or t
tcagcgcgtatacacacgaccggtgctcgatttagctctacgctcagggggagtcagacccagtcaggacacagcatggacatgagggtcccccgctcagctccgtggggctcctgctgctctggctcccaggtgaccaaatgtgacatccagatcgacccagtctcccttcccacctgtctgcatcgtggtcgganacgagngtcaccgtcacgtcggccggcagacaagtatagcgtgtgctgtannagcgagaacgagaacgccctagactccgtagatctaataacgacgttactacgttagacgtaggtacggtacctagtacgtaacggtacgaggtacggacgtaggtagtacgtcgtaggtactaggtacgttaccacgtacctacacctagtaccgcacgtcgtcgacgtacgtacgtagtagttacgttaacgtttacgtaccttaacgtttaacttacgtaccctaacgtaaacggttaacttaacttaacgttttacggttaggtacccggttaccggttaccgggtaaccggaaacgggtaccgggtaaagggttaccgtaaagttaacccgaaaaccggttcgtaacggtaaccgtcggaacctaccgtacccgtacgttacgttaccttacggttaccctaccgtttcccttcccgtaccttacg

SEQ ID NO: 9778 - DNA, 639 bp, Homo sapiens
  misc_feature: GYAE6OF01C5YFK.53.73.G07.1.454.CMB.1.raw
  modified_base (94)..(94): a, c, t, g, unknown or other
  misc_feature (94)..(94): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (401)..(401): a, c, t, g, unknown or other
  misc_feature (401)..(401): n is a, c, g, or t
  modified_base (623)..(623): a, c, t, g, unknown or other
  misc_feature (623)..(623): n is a, c, g, or t
tcagcgcgtatacacacgaccggtgctcgatttagctctacgctcagggggagtcagacccagtcaggacacagcatggacatgagggtccccnctcagctccgtggggctcctgctgctctggctcccaggtgccaaatgtgacatccagactcgacccagtcctcccttccaccctgtctgcatctgtcggagacagacgtcaccgtcacgttcgccggcagacaaagtatacgacgtggttgctggtatcagcaagaaaccgaagggaacnccctagacctctanatctataagcttactattagctaggtcggtactatacaggttcagcggatggtcgatcgaggactagtacgttcacgtctactaaccgagttacgacctcgtcccttggaccncggtcctagggaatttcgttactttacgaaccgttaacttactttaacgccgtaaccaaaccgttaataacctaagtttaccgtttggacgggttaccgtaccgggaccgtaaaggtaaccggtaagggtacgtaaacgtaaccgaaaccgtacgtacggtacggccttagaaccctaccttagtcccgtttacgttaccgtttaccccattttaccccccncccgtaccccgttacg

SEQ ID NO: 9779 - DNA, 827 bp, Homo sapiens
  misc_feature: GYAE6OF01DBJCI.53.73.G07.1.454.CMB.1.raw
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaggtcggggctagagatagaagacgcgtcggggcctacagtgatgtactttccgngacacgactatacgtaggactacctaccttaccgaccgtaccttacccttaanacgtagttacgggtacacgacggtccccgtaggacggngggtcttaggacggttaggtacgtacgggttaactaacgtacccgtaacccggttagggttcgggtaggtaaccttaccgtaaacgtaaaccgtttaccgtacgaacgtaacggtaagtaaacggtccgggacggtacgggaaccgtaaactttaacccgacggttaacgaacccgtaaggaacccgtaaccgtaccggtaacccgaacggttaaccgtaacgtaacgttaccgtaacgaagggttacgggtacggtagaaccgggtactaaccgggtaccgtaggaacgttacgtaccggtaacggggaacgggtaacccggtacggttaaccgttagtttacgggttttaaacgttcggttacgggttaaccggtcggtttaaacgttaacccggggtttaggttaaccggttaaaccgtttaaacccgtaaacgtttaaaaccggtttaagtttttaccgttttaaccggacccggttaaacccggtaaacccgggg

SEQ ID NO: 9780 - DNA, 715 bp, Homo sapiens
  misc_feature: GYAE6OF01D441G.53.73.G07.1.454.CMB.1.raw
  modified_base (264)..(264): a, c, t, g, unknown or other
  misc_feature (264)..(264): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtctccttccaccctgtctgcatctgtcggagacagagtcaccgtcacttgccggccagaccaaagtataagacctggtgctggtatcagcagaaccgaggaacnccctagactcctagatctaataacgtacgttacttaacgtttagacgtacggtcggggtacccaatacgtaaggttccgaggcggcgtaggtggtatcggtagggacaggtacgtttccacttccgtacctaaccgtaagttacgacacggtccctacgaccgtacggtacccgtttgtaagtttggttaacgtttttcggaaccctttaaactttttaacgtttaaccttacccgtaaccctaaaccggtaacgttaaacccgttaagtttaaccggtttttcggtaacggggttaacccggtttaccggggaaaccccggtaaaggggtaaccccgtaaggggtaacggtaaaccttaaccgaaaaccggttacgtaggttaccggacgttacgaccctaacctcgttccttacgtttcttaccctacgttccccttacccgccttacg

SEQ ID NO: 9781 - DNA, 697 bp, Homo sapiens
  misc_feature: GYAE6OF01A1NA8.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcagtgatgtactttcctgcacgtacagtctaggactaccgaccttccaccgtacttcccttatactagttcgggtacgacgaccggcccgtggacgtagggtcttaggacgtggagttcgggtactaactacctaacccgtggtaggtaggtactacgtaacgtaagtttacctacgaagtaacggaagtaacgtcggacgaacggggtacccgttaaaagttaacccgaagttaccgggaacctaaggaaccgaacccgtaacgtacccgaacggtaagtaccgtaagtaccgtaacgtaggtagggacggtaggacgacgtacggaccgttaggaagtacgttacggacggaaccgggaaccgaccgggtacctaggttacgttacgtttagtccggtaggtacgtagtttacggttaggtacggttaattaaccggtaacttaacttaagtttagttttacgtccgtacggtaacccgg

SEQ ID NO: 9782 - DNA, 754 bp, Homo sapiens
  misc_feature: GYAE6OF01A5ETG.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagagtgaagaagccgtggggcctcagtgatgtactttcctgcacgacactcgtaggtactacctaccttaccacccgtaccttacccttaatacctagttcggtaccgaccgacggtccccgtggaccgtagggcttaggaggtggtagtagggtactaactacctaaccgttaggtggtaggtacttactaacgtaacgttaaccacgtaacgaaggaagtaacgtcgaccggtacgggtaacccgtaaactttaacccgagtaaccgaacccgaacggtaaacggaaccgtaacccgtacccgaaaccggtaaccgttaaaccgtacggttaacctaaccggtaggttaacggggtaagggtaggtaccgacggtaccgtaaccgtaggtaacggtacttacggtacgggaccggtaacgggtaccgaccgtaacgtttaggttaacgtttacgtacggtttacgtaacggttacttaggttaacggttaacgttaacggttaacccgttaactttaacgtttaagttagtttttaacgccgtaacccggtaacccggg

SEQ ID NO: 9783 - DNA, 599 bp, Homo sapiens
  misc_feature: GYAE6OF01BNF2U.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggataccaccttcaccgactcccttaatacattgggtacgacacggcccctggacaggggtctggagtggagtgggtactaactcaacctggtggtggatactaacgaagtttactacaacgagaagtaatgaccgaaggggaccgtaaattacccgaatacgaaccgaagaacgaaccaacgtacccaacgaagtaacgacgttacctacgtatgggaggtggacgacgacggcctaggaagtactcgtaggaacggaccgacgcctagttagttatacgtggtcgtacgtacttaggttaggtggtaacgttaacaacgttaactaaagtttattttcgtaccgtaggtaccccgg

SEQ ID NO: 9784 - DNA, 764 bp, Homo sapiens
  misc_feature: GYAE6OF01DA2WA.53.73.G07.1.454.CMB.1.raw
  modified_base (190)..(190): a, c, t, g, unknown or other
  misc_feature (190)..(190): n is a, c, g, or t
tcagcgcgtatacacacgaccggtgctcgatttagctctacgctcgagggggagtcagacccagtcaggacacagcatggacatgagggtccccgctcagctcctggggctcctgctgctctggcctcccaggtgaccaaatgtagacatccagactcgacccagtccttccctccaccctgtctgactntcgtggtacggagacgagacgtccaccgtctacgtcggccggacacgacctaaagttacttaacgtaccgttggtcggtcctaggtactcgaacggacgaaacgaaaaccggtaacgggaaacctccccgtaagtacctccgtagtaatactaagtaacgtaccgttacttaacgttacgacgtacggtacggtacccaagtacgaaggtacgacggacgcgtaggtcggacgtcgggtacggaacgtagtaccgtacctacgttactacgtaacgtagttaccgacgtaccgtacgtaccgacgtacggtacgtagtactttacggttaacgttttaccggaaccttaaacttttacggttaaccctaccgtaaaccttaaacttacgttaaacttacgttttacgggttacgttaccggggtacccgtttaacggggacccgtaaaggggtaaaccgaagggttaaccgaaaacgttaaccgtaaacggttcggtaacggtccgtacgtacgacctacgttacgttcgttacttacccgttaactacccgttcccgttaacccgcgttaccg

SEQ ID NO: 9785 - DNA, 128 bp, Homo sapiens
  misc_feature: GYAE6OF01AM55E.53.73.G07.1.454.CMB.1.raw
  modified_base (128)..(128): a, c, t, g, unknown or other
  misc_feature (128)..(128): n is a, c, g, or t
tcagcgcgtatacacacgaccggtgctcgatttagctctacgctcagggcacgaccggtgctcgatttagtacacgtgattagggattgggtacgcactcgtctgagcgggctggcaaggcgcatagn

SEQ ID NO: 9786 - DNA, 601 bp, Homo sapiens
  misc_feature: GYAE6OF01BAETK.53.73.G07.1.454.CMB.1.raw
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (466)..(466): a, c, t, g, unknown or other
  misc_feature (466)..(466): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgtatttccngcacganatcgtggataccaccttcaccgtacttcccttaatactagttcgggtaacacgacggccccgtaggacgaggggtcttggaggtggagtcgggtctaataccaaccgtaggtggtaggatacgtaacgtaagttactacgaacgaggaagtaagtcggacgacgggacctaaattaccgagttacgaaccgaagacgaccaccgtaccgaacgagtaacagtactanagtggagtagagcgagctagagatcgagacgacgacgactagtacgttattacgtgtgtacgtacgttagttaggtacggtaacgttaaccgtaacgttaactaagttttattttcggaccgtacggtaacccgg

SEQ ID NO: 9787 - DNA, 603 bp, Homo sapiens
  misc_feature: GYAE6OF01BB27B.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagccgtggggcctcgagtgatgtactttccngcacgacatctggatactaccttccaccgacctcccttatactagttcgggtacgacacggcccctgggacgaggggcttggaggtggagtgggtactaactaccaacccgttaggtggtacgtatactaactaaaggttactacagaagaagaagtggacgacgggtacctaaattaccagtacgaaccgagacgaccacgtccaacgtacgtacacgtactacgagtaggaggtagagacgagacagtagagtaacgtcgtaggacggtacgacggtactacgtagttacttacgtgtaggtcgttaagttcgtttaggtacggttattaacgtacttaacttaagtttattttacgtcggtaaccgg

SEQ ID NO: 9788 - DNA, 814 bp, Homo sapiens
  misc_feature: GYAE6OF01E0VOF.53.73.G07.1.454.CMB.1.raw
  modified_base (328)..(328): a, c, t, g, unknown or other
  misc_feature (328)..(328): n is a, c, g, or t
tcagcgcgtatacacacgaccggtgctcgatttagctctacgctcagggggagtcagacccagtcaggacacagcatggacatgagggtccccgctcagctcctgggctcctgctgctctggcctccaggtgacaaattgtgacatccagactcgaccccacgttccttcccttcccacccgtgtccgtggactagttcgtcggtacggacgtacgagacgtaccaccgtcacgttcggaccggccacgaaccgaaagttacttaacggtaccgttcgggttacgaccgttaggtactacgacgacgaacggaaaccgacgggaaccncccgtagtacctcgtagtactactaagtaacgtcgttacctacgttacggacgtgggtaccggtacctacgtacgtaacggttcgacggtcggacgtacggttggtacgtgggtaacgggactacggtacgttaccgacttccgtaacctaccgtagttacgaccgcgttccgacgtacccgtagtaccgttagtaacgtttcgttaacgttttacgaaccttttaacgtttaccgttaacggtaacccgtaaccgttaaactacgttttaacctaacgtttacggttttaccgggacgggttacccggttaccggggaaaccggtaacggggtaaccgttaaacgggtaacgtaaaaccgttaaccggtaaaaccgggttaccggttaaacggtaccggtaccgttaacgaacccgttaccgttacttacccggtttaccttacccgtttacgtaaccctttcccccggtttacctcgttaaccg

SEQ ID NO: 9789 - DNA, 935 bp, Homo sapiens
  misc_feature: GYAE6OF01EZL9C.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagacgtcaccgtcacgttcggcccgggtccaacgacctaaaaggttacttaaacggaccgttggggttcggaccgttgggtaactacaaggaccgaaacggtaaaacccgaacgggggtaaaaccgcccccgttaaaggtaaccccttaccgttaggtaacttaccgtaaagttaaacggtaccggtttaaccttaacgttttaacggaacgtacgggttccggggtaccctaaggttcgtaaacgggtttccgaaggtacccgggtactaacgggttagggtaacgttccggtacggggtaactaagggttaacggtttaccaaccgtttcctacccgtaaaccgttagtttaaaccggaccgtaacggttcccgtacggtaccgtaacggtcccgtttaaggtaacgttttacggttaaacgttttttacgaaaccgttttaaaacttttaacgtttaaccgttaccgtaacccgttaaaaccgtaacgttaaaccgtttaaacgttttaacggttttacgggttaaccggggttaaacccgggtttaccggggtaaacccgggttaaaacgggggaaaaccccgttaaggggttaaaccgggtaaaaacgtttaaacccggaaaacggttaaaccggttacgggttacgggtccgtaacgtaacccggtaaccgttacgtttcccggtttacgttcccgtttaacgtaccgtttccccgtttccccggtaaccttaaccg

SEQ ID NO: 9790 - DNA, 748 bp, Homo sapiens
  misc_feature: GYAE6OF01B8KD4.53.73.G07.1.454.CMB.1.raw
  modified_base (238)..(238): a, c, t, g, unknown or other
  misc_feature (238)..(238): n is a, c, g, or t
tcagcgcgtatacacacgaccggtgctcgatttagctctacgctcaggggatcatccaacaaccacatcccttctctacagaagcctctgagaggaaagttcttcaccatgactggacctggaggtcttctgcttgctgtcagtagctccaggtgctcgctcccaggtgcagcgtggtacaggtcggggctgagatagaagacgtccgtggggcctacgagtgattagtacttttccngccacgacatcgtggaactacctaccttccgaacctacccttaccttatacgtaggttcggtaccgaccgaccggtccccgtagggacggtacggggtcttaggaggtcgggagttacgggttacctaacgtacccgtaaccgttaggtcgggtagaacttcgttaactaaacgtttactacaacgtaaggaacgtaagtcggacgtaccggggtaaccttaaacttacccgaagtacgaaaccgtaggaacgtaacccgtaaccgtaccgaaacggtaacttaacgtacgtttaacctaacgtagggttaacggggacgtacgggaacgtcccgtaaggtacccgttaggtaacgtaacttaccgggtaacgggaaacggaacgtacccggtacctaaggttcgttaaacgtttgtacggtacggtacgttacgtttaggttaaggtacggttaacttaaccgtacgtttaaacgttaatttggtttaccgtaaccgacggtaaccggg

SEQ ID NO: 9791 - DNA, 746 bp, Homo sapiens
  misc_feature: GYAE6OF01B6HRU.53.73.G07.1.454.CMB.1.raw
  modified_base (687)..(687): a, c, t, g, unknown or other
  misc_feature (687)..(687): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgaccagtcctcctccacctgtctgcatctgtcggagacagtatccgaccgtctaccgttcggcccggggacccaggaccctaaaaggttacttaaggacccgttggggttacggcccgttaggtactcgaagacaaacggaaaacccgacggggaaacctccccgtaagaccttccctagtaacttaccgtaataaacggtaccgttacttaaccgtttaggaccgtagggttcggggttaccccagtaccgtaaggttcgaggtcggacgtaggtggtaatcggtaagggactaggtaactttcgacctccgtaccacctagttaccgctacggtcctgaccgacgtaccgtaggtaccgttagttactttacggaacctttaacttttacgttacgtacccgtaacctaacgtaacgtttaactaacgttttaacggtttcgggttaaccgggtaccgtttaccgggaccgtaaacgggtaaccgtaagggtaacgaacgtaaccgtaaaccgtagtgggtacgtccggtanaccctacttagttacccttcgttacccgttacttacccttccctttccggacccttacg

SEQ ID NO: 9792 - DNA, 698 bp, Homo sapiens
  misc_feature: GYAE6OF01A78ZA.53.73.G07.1.454.CMB.1.raw
  modified_base (307)..(307): a, c, t, g, unknown or other
  misc_feature (307)..(307): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcggagacagagtccaccgtctacgttcggcccgggaccaacgacctaaagttacgttaacggaccgttgggttacggccttaggtactcgaagtaccgaaacggaaaaccgagggaaaccnccccgtaagtaccttcctagtacttactaagtaacgtacgttaccttaacgtttacgacggtacggttaccgggtaccccagttaccgaaagggttccaacgggtccgtacgaggttacggagttcggtagggaactaggtacgttaccacttccgacaaccgttagttaccgcgtacgccttggactacgtcctagtacttggttacttacgacttaacgtttacttaccgacaccgtaatagttaacctacgtttacgttggtacggtaccggttaccggacgtaaacgggtaacctagggtaacgtaaacgtaccgaaacgttcggtacgtacggtctacgacctaccttgtcgttacggttccttacgtcttcccgttccgcttacg

SEQ ID NO: 9793 - DNA, 797 bp, Homo sapiens
  misc_feature: GYAE6OF01CZEYX.53.73.G07.1.454.CMB.1.raw
tcagcgcgtatacacacgaccggtgctcgatttagctctacgctcagggggagtcagacccagtcaggacacagcatggacatgagggtcccccgctcagctcctggggctcctgctgctctggcctcccgaggtcgaccaaatgtagacatccagatcgacccagtcctcccttccacctgtctgctagtctggtacggagacgagtacgtccaccgtcgtaccgttcggcccggtaccaagaccaaaagttacttaacggtaccgttggttcgccgttaggtactacgacgacaacgaaaaccgagggaaaccgtcccgtaagtaccttccgtaggtacttacgtaacgtaaggtaccgtttacttaacgtttacggaaccggttacggggttacccgggtaccctaaaggtaccggttaaacgggttaccgacgggcggtacgtaaggttccggagttaccggtaggggaactaacggtacgttaccctacgttccctaacgtaaccgtagtttacggaccgtcgtaccacggtacctacgtaccgtagtagtttacgttaacgtttacaaacctttacgttaactttaccgaccgtaaaccttaagtaaccgttaacgttaaccgttttcggtttaacggtacggttacccggttaacgaacccggtaacgggtacgttaaacgggagtaaaacgtaaccgaacgttacggtgtaccgggtactacgaacccttgtaaccgttcgttaccgttaccttaaccgtcccgtttacccgtccccgtaacttaccgg

SEQ ID NO: 9794 - DNA, 786 bp, Homo sapiens
  misc_feature: GYAE6OF01AD3ND.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggagcagctggtacagtcgggggctggagatgaagaagccgtggggcctcgagtgatgactttccngcacgacatcgtggactacctaccttaccacccgtaccttacccttatacctagttcggggtaaccgacgtaccgggcccccgtaggggaccgacgggggtcttgggaggttagggtacgttggggttacctaaagttacccgtaaacccgttagggttcgggtaggtaactaccgttaaccgtaaacggtttacctacgaacgtaaggtaacggaactcggggtaccgaacgggggtaaccgtaaaccgtttacccgaacgttaccgggaacccgaacggtaaaccggaacccgtaccggttaaccccgaaacgggttaaaccggttaaccgtaacggtttaaccctaccgggtaggttaacgggggtagggttacggaacgggtccgaacggttcccgtaaggacggtaacgttccggtacgggaacgggaaccgtaccgggtaccttagtacgttacgttaccggttgtcggtacgtagttacgtttagggtagttaaccgttaccgtaaacgttaacgtaactttagtttacgacgtacgtaacccggg

SEQ ID NO: 9795 - DNA, 611 bp, Homo sapiens
  misc_feature: GYAE6OF01E46KU.53.73.G07.1.454.CMB.1.raw
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagccgtggggcctcgagtgatgatttcctgcacgacatctggactaccaccttccaccgtaccttcccttatactagttgggtaccgacacggcccctgggaccgtaggggcttggaggtggagtgggtactaactcaacccgtggtggtagatacgtaactaagttacncanagagatgcgaggccaattaccatacgacagacgacacgtccacgacgtacagtacacgtagtggagtgacgcgacgccgtaggacgtagtcggtacggacggtaaccgaccggtaccgtagttacggttaacttacgtggtacggtacgttacgttacggtttaggttacggttaaccgtttaaccgtaacgttaacgttaactttagtttttacggtacccgtacggtaacccgg

SEQ ID NO: 9796 - DNA, 689 bp, Homo sapiens
  misc_feature: GYAE6OF01DX7FD.53.73.G07.1.454.CMB.1.raw
  modified_base (235)..(235): a, c, t, g, unknown or other
  misc_feature (235)..(235): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagataggaagaagccgtgggggccctcagtgatgatttccngcacgacatctggataccaccttccacccgtaccttcccttatacgtattcggggtaccgaccgacgggcccccgtgggaaccggagggggtccttggaggtgggtagtcggggttacttaaactccgtaaaccccgttaggtacgggttaggtaacttaccgttaaactaaacggtttacctaccgaacgtaaagggaagaaacgttcgggacggaacggggtacccgtaaaacttacccgtaagtcgaaccgaaggaacgaccaacggtaccaacggacgtaacgacgtacgtacagtgggaggtcgagacagccgtgacgtatcggtaggaggaccgtacggacacgttacggtaacttagtggtcgtacggtacgtttagttagggttcggtaactttacggtaacgtttaacttaacgtttatttttaccggtcgtcccgtaacccggg

SEQ ID NO: 9797 - DNA, 753 bp, Homo sapiens
  misc_feature: GYAE6OF01CTKKX.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgatttcctgcacgactatcgtggactacaccttcaccgtacttcccttaatacagttacgggtaccgacgacggccccgtggacgaggggtcttggaggtggtattgggttactaacgtaccgaacccgttaggtgggtacggattaccgtaacgtaaacggtttaccacgaacgaaggtaacgtaagttcggaccggtaacggggtaacccgtaaaagtttacccgaagttaccggaacccgaaggtaaccgaaccgtaacccgtacccgaacggtaacgttaaccgaacgttacctaacgaggttagggaagggtaggacggaccgacggtccgtaaggacgtacgttacggtacgggtaacggaaccgtaccgggtacctaggttaacgttaacgttttacgtacgggttacgaccggttaagtttacggtttaaagggttacggttaaaccgtttaaaccgtaaaccgtttaaaacgttaaacgtttttaagtttttacggtaccgtaaaccgggtaaccccggg

SEQ ID NO: 9798 - DNA, 791 bp, Homo sapiens
  misc_feature: GYAE6OF01EX2TZ.53.73.G07.1.454.CMB.1.raw
  modified_base (231)..(231): a, c, t, g, unknown or other
  misc_feature (231)..(231): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagcgtggggcctcgagtgatgtatttccgngcacgactatcgtaggactacctaccttaccgaaccgtaccttacccttaatacgtagtttacggggtaaccaaccgaccgggtcccccgttaggggaaccggtaaggggggtcctttagggagggttaggggtaacggttacggggttaaccttaaacgttacccgtaaaccccgttaggggttacgggttagggtaacttacgttaaacgttaaacggtttactaccgaacgaacggtaagtaaactcgggaacggtaacggggtaacctaaacgtttaccgaagttaccggaacgaacggaaccgtaccgaaccggtaccgaacggtaacgttaaccgtaacgttaccgtaaccgtaagggttagggtaacgggttacggacggaacggtacgtacccgttaggaacggtagtaccgtagggaaccggtaaccggtaccggtaaccgtattaggttaacgttacgtcggttacgacggttacttacggtttaagggtacggttaaacttaccgaaacttaacgttaatttacgttttagaccgtaccgtaaaccggg

SEQ ID NO: 9799 - DNA, 589 bp, Homo sapiens
  misc_feature: GYAE6OF01B8BIC.53.73.G07.1.454.CMB.1.raw
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
  modified_base (486)..(486): a, c, t, g, unknown or other
  misc_feature (486)..(486): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagccgtggggcctcagtgatgatttccngcacgacatcgtggactacaccttcaccgacttcccgttatacctagttcgggtaccgacgacggcccccgtgggacgnggggtcttggaggtggagtgggttactaacgtccaacccgtaggtggtaggtactactaacgtaagttacctacaacgagaacgtaactggaccgaaggggacctaaacttaccagtacgaccagacgacgaccgtaccacgacgtacagtctagagtgggaggtgacgcacgccgngacgagtcgaggacggacacggctagtcgttagttacgtgtcgtacgtattacgttaggtaggtattaacgtactaactatttactttagtacgacggtaccg

SEQ ID NO: 9800 - DNA, 818 bp, Homo sapiens
  misc_feature: GYAE6OF01DCOKF.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagcctccaggtgctcgctcccgaggtgcagtctaggtacaaggtcgggggctaggagtagtaggaagaaggccgtacggggtccctcgagtgatgtactttccgtagacgtaacgacctagttcgtaggtactaacctacccgttaccaaccccgtaacccttaccctttaagttaaccgtacgttacggggtaaccaccggtacgggtaccccccgtagggaaccggtacgggggtcgttacgggaggttaggtacggttacggggttacttaaacgtaccgtaaacccggttagggtcgggttaacgtactttaccgtaaaccgttaaacgtttaccgtacgtaacgtaacggaaggtaacgttcggaccggaaccggggtaacctaaacgttaaccgacgtacgaacccgtaacggaacccgtaaccgtaaccggtaacccgaacgggtaacgtaaccgtaagttccgtaacgtaggtacgggtaaggacggaacgtacgaacgtaccggtagaacgtacgtacggacggtaacggaccggacggtactagttaacgttaacgttacggtggtacggtacggttacgttaacggtttaggtacggtttaacgttaacgttaaacctaaacgtttaactttattttaccggacgttaccggtaacccgg

SEQ ID NO: 9801 - DNA, 749 bp, Homo sapiens
  misc_feature: GYAE6OF01C13JE.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacagtctaggactaccaccttccacccgtaccttcccttaatactagttcggggtaaccgaccgacgggcccccgtgggacgaggggtcttggaggtggattgggtacctaatcctaacccgtggtcggtgacttctaactaagttacacgaacagaagaagtcggacgacggggtaccgtaaatttacccgaagtacgaacccgtaacggaacgaaccgtaacccggtacccgaaacggtaacgttaacgaacgttcccgtaacgtaaggttagggtaacgggttcggaaggtcccgaacggtcccgtaggaacggtacgttacggtacggaacgggaccgtaccgggacccgttagttacggttaacgtttacgttacggttacggtacggttaccgtttaccggttttaaagggttccgggttaaacgttttaaacccggtaacctttaaaaccgttaaaacgtttttaaccgttttttacggtacccgtaaccgggtaaacccccgggg

SEQ ID NO: 9802 - DNA, 877 bp, Homo sapiens
  misc_feature: GYAE6OF01DTB22.53.73.G07.1.454.CMB.1.raw
tcagcgcgtatacacacgaccggtgctcgatttagctctacgctcaggggatcatccaacaaccacatcccttctctacagaagcctctgagaggtaaagttcttcaccatggactggacctggagggtcttctgcttgctgtcagtacgctcgaggtcgctccgcctcccgaggtgccagtccgtaggtaacgaggtcgggggctaggagataggaacggacgtccggtggggccctagaggtagtagttacgtacgtttccgcgaccaacgtaactacgttacgtacggtaacttaaccctacccttaccgaaccgtaccctttccctttaatacgtacggtttacgggaccgaccggacccgtccggtacggaccggacggggtctagggtacggttaggtacggttacgggtaccctttaaacgtaacccgttaacccgtagggttacggtaacggttacctacgttaaccgttaaacggtttaccaacggtaaccaaagggaacggtaacgtacggtaccgggtaaccggggttaaccttaaaccgttaacgacggtaaccggaaccgtaaccggaacggtaccccgtaaccggtacccgaacggtaacggttaacctacgttaaccgaacggttaacggtacggggttacgggagaacgtaccgggtaaccgtacgggtacggaagtttaacccggttacgggaaaccgggtaaccgggtaaccgggaacccgggttacttaaggtttacccgtttaagtttaccggtcgttacgggtacggttaactttttaacgggacggtttaggaaacgtttaaccgtaacttaagtttacggtttaactttcggggaaactccgggttaacccggg

SEQ ID NO: 9803 - DNA, 731 bp, Homo sapiens
  misc_feature: GYAE6OF01CN51S.53.73.G07.1.454.CMB.1.raw
  modified_base (290)..(290): a, c, t, g, unknown or other
  misc_feature (290)..(290): n is a, c, g, or t
tcagcgcgtatacacacgaccggtgctcgatttagctctacgctcagggggagtcagacccagtcaggacacagcatggacatgagggtccccgctcagctcctggggctcctgctgctctggcctccgaggtcgaccaaatgtgacatccagatcgaccagtcctcccttccaccctgtctgctatctggtcggagacagacgtcaccgtctacgttcggccggcagacctaaagtattaacgccgttggttcggctggtatcagacgaaacgaaccgaagggaaaccncccgtagtaccgtcctagtactactaagtaacgtaccgttacttaacgttagacggtacggtccgggtacctaagtacgtaacggttcgacggcggtactaggtggatcggtacggacgtagtaccgttacaccgtacctaccgtaacgtaacgttacgccgtacgtcccgtacgaccgtaacggtccttaggtaagtttacgttaacttttacgaacctttaactttacttaaccgtaccgtaacctaagtaacgttaactaacgttttcgttagggtacggttaccgggtaaccgggtaccgtaaacgggtaccgtaaagggtacgaaaaccgttaccggaaaacggttcgtacgggacgtacccgttaggaaccctacttaaccgtacgtttccgttaaccctttactacccctttccccgtcccgtacctttaccgg

SEQ ID NO: 9804 - DNA, 638 bp, Homo sapiens
  misc_feature: GYAE6OF01BS5ZL.53.73.G07.1.454.CMB.1.raw
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (390)..(390): a, c, t, g, unknown or other
  misc_feature (390)..(390): n is a, c, g, or t
  modified_base (470)..(470): a, c, t, g, unknown or other
  misc_feature (470)..(470): n is a, c, g, or t
  modified_base (506)..(506): a, c, t, g, unknown or other
  misc_feature (506)..(506): n is a, c, g, or t
  modified_base (522)..(522): a, c, t, g, unknown or other
  misc_feature (522)..(522): n is a, c, g, or t
tcagcgcgtatacacacgaccggtgctcgatttagctctacgctcaggggatcatccaacaaccacatcccttctctacagaagcctctgagagaagttctcacatggactggacctggaggtcttctgcttgctgtcagtagctccaggtgctcgcctccaggtgcagcgtagtaacgaaggtcggggctgagactaggaaaggacgccgtgggcctgagtgaactgtatttccgngacacgtantcgtagactacncttacaccgtacttcctaatactagttacgggacacgtaccggacccctgggaccgtaggggcttggacggtaggacgtcgggtaactaactacgaaaccgtggttggtacgacttactaacgtagttaacnaactagaacgtaagacgcgaacgggacctaaataccgatacgaacgtagacgacctacgaccaagtactacgtacgttanacgtaggtagacggtgacgcgtagcgtagacgtacnggtaagaacggaaccncggtaactagttcaacggtttacgtgtacggtaacgttacttagggtcgttaaacggtaactttaacggaaccctttaattaacgttttaaggtttcctaaggacccggttaacgg

SEQ ID NO: 9805 - DNA, 778 bp, Homo sapiens
  misc_feature: GYAE6OF01CU0W6.53.73.G07.1.454.CMB.1.raw
tcagcgcgtatacacacgaccggtgctcgatttagctctacgctcaggggatcatccaacaaccacatcccttctctacagaagcctctgagaggtaaagttcttcaccatggactggacctggagggtcttctgcttgctgtcagtagctccgaggtgctcgctccgaggtcgcagcgtaggtaacaggtcggggctagaagagtagaaacgtacgtccggtcgggacctagtagtcgtatgttaccgtttccgacgaccgacgtatacgtacgtagtaacctacctacccttacccgaacccttacccttaaccttaagttacgttaacggttaccgggaaacctaccggtacccggtacccggtacggaacgggtcgggtcgttaggagggttggtagttcggtaactaacgtaccgaacgttggttacggatacctacgtaagtaacgtttcaacgtacgaaaggtagtaacgtcggaaccggtaacgggtaaacccttaacgttaacgacgtaacgaacgtaacggaccgtaaccgtaaccgtaccgtaaccgtaagtaacgtaccgtacgaacggtagggtacggtaggtacgacgaccgtacggaccgtagaacgtacgtcgaaacgggaccgacgtaccgtacttagttacgttaaggttcgtacgggtacttacgggttactttaacgggttacggttacgttaaaccgttaacgttaaacgtttaacgttttacgtttacgttcgtaacccgtacggttaaacccggg

SEQ ID NO: 9806 - DNA, 783 bp, Homo sapiens
  misc_feature: GYAE6OF01ESJN7.53.73.G07.1.454.CMB.1.raw
tcagcgcgtatacacacgaccggtgctcgatttagctctacgctcagggggagtcagacccagtcaggacacagcatggacatgagggtccccgctcagctccgtggggctcctgctgctctggctccaggtgacaaatgtgacatccagatcgacccagtcctcccttccgaccctgtctgctatcgtggtcggagtacgagacgtaccaccgtctaccgtcggacccgggaccaagaacctaaaaggttaacttaacgaccggttggttcggaccgttaggtactacgaacggacgaaacggaaaaccgaacgggaaaccgtccctaagtaccctaccgtaggtaccttactaaacgtaacggtaccgtttaccgttaacgttaacgtaccgtacgggttccgggtaccccaagttaccgtaaacgggttccgaacggtcggactaaggtcggaacgttcggtacggaacgtaggtaaccgttacctacgttaccacctaacgttagtacgcgtacgtacctcgtacgtacgtacgtagtagttagttaacgtttacgtaacctttaacttaacgttacctaacgtaacccgtaacgtaacgttaaccttaagtttaacggtttacggtaccgggtaccgtacgggtaaccggaaacgggtacgtaaagggtaaccgttaaaccgaaacggtaaccgtaggttacggtacggtaccgtaaggacccttaccgtacgttctttaccgttccttacggtaccctttcccgtcccgtctaaccg

SEQ ID NO: 9807 - DNA, 616 bp, Homo sapiens
  misc_feature: GYAE6OF01A7R1V.53.73.G07.1.454.CMB.1.raw
  modified_base (395)..(395): a, c, t, g, unknown or other
  misc_feature (395)..(395): n is a, c, g, or t
  modified_base (611)..(611): a, c, t, g, unknown or other
  misc_feature (611)..(611): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtctccttccacctgtctgctatctgtcggagacagagtccaccgtcacgttcggcccgggccagacctaaagtattaacggccgtggttcgcctggtatcgagcaagaaaccgagggaaaccgcccctagaccttcctagtactacgtaataacggtaccgttaccttacgtttacgacgtacggtcggggtacccagttacgaggttcaggtcgcgtagtggtatcgtggaacngtacgttcactacgacaaccgtattacgctacgccgtcgacctacgccttagtacgttagttactttacgacttaacctttacttacgaccgtacaacgtactaacttaactttcgttagtacggttaccgttacggaccgtaacggtacgtaaggtacgaaacgtcgtaagtacgtagtcggctacgacactagtcttcttctcacttcctccgnttacg

SEQ ID NO: 9808 - DNA, 628 bp, Homo sapiens
  misc_feature: GYAE6OF01ALOP8.53.73.G07.1.454.CMB.1.raw
  modified_base (497)..(497): a, c, t, g, unknown or other
  misc_feature (497)..(497): n is a, c, g, or t
  modified_base (577)..(577): a, c, t, g, unknown or other
  misc_feature (577)..(577): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctgtacaagtcggggctgagatgaagaagccgtggggcctcagtgatgtactttcctgcacgacattcgtggataccacccttcaccgaccttccctttatactagttcgggtacgacacggccccgtagggaccaggggtccttggagtggtagttggggttacctaagtccaacccgttggtggtggtactacgtaacgtaagttacctcaacgaggaagagtgacgagggacccgtaataaccgtatacgaccgtagacgacctaccggtaccaacggtaacgtaccgagttacgtaccgagtgggaacggtgacgacgngacgtagagtcgtcggtagacggaccgaccggtacctagtcgttaacgtcgttacgtcggtagtacgttcggtttaacgnggttaactaccgtaactaaccttagtttactttcgtaccgcgtaacccggg

SEQ ID NO: 9809 - DNA, 572 bp, Homo sapiens
  misc_feature: GYAE6OF01BOWM4.53.73.G07.1.454.CMB.1.raw
  modified_base (265)..(265): a, c, t, g, unknown or other
  misc_feature (265)..(265): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttcaccctgtctgcatctgtcggagacagatcaccgtcacttggccggccagaccaaaggtataagcctggttcgcctggtatcagcagaaaccgaggaanccctagactccgtgatctataagacgtactaactttagactaggtcgggtccatcgaaggttcagcgcagtgatcgtggacagtagtcactctcacattagctacgctcgcagtcctgatgtatttcgacctaactttattactagaccctaacgtaagttaacctaagtttacgtttaggtacggtaaccggttcggggaacctaaaggggtaacccgaaagggttacgtaaaaacgtccgtaaaacggtacgtacggtagtcgtacgactaccgatctacgttctctactccgttcccgcgtacg

SEQ ID NO: 9810 - DNA, 567 bp, Homo sapiens
  misc_feature: GYAE6OF01AM6NE.53.73.G07.1.454.CMB.1.raw
  modified_base (357)..(357): a, c, t, g, unknown or other
  misc_feature (357)..(357): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttggccgggccagccaaagtattaagacctgggttgcctggtatcagcagaaaccgagggaaacgcccctagactcctgatctataagacgtatactttagactaggtcgggtccatcaaggtcagcggcagtggatgtggacagagttcnctctcactatagcagcctgcagcctgatgtatttgactaactttattactcgacctaacgtagtaactaattacgttttggacggttaccgttacggaccgaagggacctaagggtaggaaactacgaaacgtaacgtcggacggtctagacctaaccgtacttaccgttacgttaccttacctactttccccgttccccggtccttacg

SEQ ID NO: 9811 - DNA, 863 bp, Homo sapiens
  misc_feature: GYAE6OF01DZHQR.53.73.G07.1.454.CMB.1.raw
tcagcgcgtatacacacgaccggtgctcgatttagctctacgctcaggggatcatccaacaaccacatcccttctctacagaagcctctgagaggaaagttcttcacatggactggacctggagggtcttctgcttgctgtcagtagctccgaggtgctcgcctcccgaggtgcagcgtaggtacgtaaggtcgggggctggagagtagaagacgccgtcggggacctcgagttgatagttactttccgtagacctaacgacacttcgtacggtaactaccctaccctttaccgacccgttacctttacccttaactacgttacggttcgggtaaccgaccggtaccggtacccccggtagggaccgggtacggggttacgttaggggtaggttagggtacggttcgggtaaccttaaacgtacccgtaaacccggttgggtacgggttacggtaccgttaacgttaacgtaaacggtttacctacgaaacgtaggtaaacgtaggtaacgggtaccgggaaacggggtaacctttaaaccgttaacccgtaacggtaacccggtaacgaaccgggtaaccgtaacccggtaaccccggtaaccgaacggtaaacgttaacgtaaccgttaaccgtaacggtaggttagggggaacggtacggaaccggtacgtaacggtaccgtacggtaaggtacgtttaccggacggggtaaacccgtaacgggaccgtacttaggtaccggtttaacgttacgtacggttaccggtacgttaacgtttagggtttaacggtaaggttaacctttaccgaaacttttaacggttaactttaagttttacgccggtaaacccggttacggg

SEQ ID NO: 9812 - DNA, 1011 bp, Homo sapiens
  misc_feature: GYAE6OF01DS55M.53.73.G07.1.454.CMB.1.raw
tcagcgcgtatacacacgaccggtgctcgatttagctctacgctcaggggatcatccaacaaccacatcccttctctacagaacgcctctgagaggaaagttcttcaccatggactggacctggagggtcttcgtgcttgctgtcagtacgctccgaggtcgcgtcgcgtcccgaggtgacgtacgcgtacggtactaaggtcggggctaggagagtaggaacgaacggtccgtggggccttacgaggttagtagtacggtaccttttccgacgaccgtaacggtacgtagttaccgtacggtaacctaccttacccgttttacccgacccgttaccctttaccccgttaaacgttaaccgtacggtttacggggtaaaccccgtaccgggtaccccgggtacccccggtttagggaacccggggttaggggggtacccgtttaaggggtaacgggttacgggggttaacggttttacccggggttaaacctttaaacccgggttaaaccccgtaaaccccgggttttaagggggttacccggggttaaagggttaaacccgtttaaccggtttaaaacccggttaaaacggtttaaaccccgttaaccggaaaaacgtacggggttaaaaaccgttaacgggtacccggtacccggggtttaaacccggggaaaccccgtttaaaccgttaaacccggtaaacgggttaaccgaaaccccggtaagggtaaaacccggtaacccggttaccccggaaacccgggtaaacggttaaaccgttaacccggttaaacgttaccgttaacgggtaacggtacggggttaagggtaacgggacgtaaccgggtacggtaaccgtaagtacgggttaactacggacggggtaaacgccgtaacggacttaggttaacgttcgttagggtcgtacggttacgtcgtttaccggttaaggtcggttaacttaaacggtacgtactttaacggttattacggtacggacccgttacggg

SEQ ID NO: 9813 - DNA, 720 bp, Homo sapiens
  misc_feature: GYAE6OF01CVH1I.53.73.G07.1.454.CMB.1.raw
tcagcgcgtatacacacgaccggtgctcgatttagctctacgctcgagggggagtcagacccagtcaggacacagcatggacatgagggtccccgctcagctcctggggctcctgctgctctggctcccaggtgccaaatgtgacatccagatcgacccagtcctccttccaccctgtctgcatcgtgtacggagacagacgtcaccgtctacgttcgccgggccagacctaaagtataacgacgtggttcgacgttggtatacagacaacgaaaccgaacgggaaacgcccctagtacctccgtagacttactaacgtaagtaccgtacttacgttaagacgtaggtaccggggtcccctaagtacgtaaggtaccgtacggacggtacgagtacggtactacggtacggaacgtaggtacgttcctaccttccgtacaaccgttagttacgaccgacgtccgtacgcgtacgtcctgtaacttgtttagtttacgacctttaacgttaattaccgtacgaaccttaacgaacgttaacttaagttaccggttttggacggttacccggttaccggaaccggtaacggtaaccgtaagggacgtaaaacgtaaccgaaaacggttacgttacgggtagtaccgacggtaacccctaaccgttacttaacccggttgttaccctaaccgtttccctaccccgtttacccgcccggttaac

SEQ ID NO: 9814 - DNA, 786 bp, Homo sapiens
  misc_feature: GYAE6OF01D4A9N.53.73.G07.1.454.CMB.1.raw
  modified_base (716)..(716): a, c, t, g, unknown or other
  misc_feature (716)..(716): n is a, c, g, or t
  modified_base (768)..(768): a, c, t, g, unknown or other
  misc_feature (768)..(768): n is a, c, g, or t
tcagcgcgtatacacacgaccggtgctcgatttagctctacgctcagggggagtcagacccagtcaggacacagcatggacatggagggtcccccgctcagcctccgtggggctcctgctgctctggcctccgaggtcgaccaaatgtgacactccagatcgaccctagtcctcccttccaccctgtctgcatccgtggtcggagacgaggacgtaccaccgtcaccgtcggacccgggacaacgaaccgtaaaagttacgttaacgtcggttaggttcggccgttaggtactgaacggacaaacggaaacgtaacgggaaccaccccgtagaccgtaccgtagactactaagaacgtaccgttattaacgtaggactacgggtcggtaaccccaattacggtaacgttacggacggccggtaatagggtacgacgttacggagggaactacggtacctttacccagtttaccaacccgttaacgtaagttccggaccttaggcccgtacggtaaccgtaaccggcgtttaagttacgtttaacgttaacggtttacaacctttaagttacctttaaaccgggaccaaattaacccgttaagtttacgttaaactttcggggtacgtttacgggaaccccggtagggtaacccggaaacggtaccggtaaaggtacgaaaccgtaacgtaaacgttgtaacgggttcaacccggtntaaccgtaaccgttcgttaccggtttaactccttaacgacccgtttttcccncccgggtattaaaccggg
